United States Patent 11,001,841 (CCCTC-BINDING FACTOR (CTCF) RNA INTERACTOME) - sequence listing, part 47

SEQ ID NO: 111502 - DNA, 1034 bp, Homo sapiens
tctgagcatagctcagaattatctaattgactagaggaatcatttaatcaaaagcggctatcagattgatacacagtgatgccttagtggccctgaggtatgttggagtttgagaaccttctctaaatggcactttcatttaaatttcatatgtgggctgttctttttggtttgctttcttctgtctttgtaattggtcagctgttcttggaagcaaaacaaccaaccagccttattagaactgcatataaagtaagagaagttcatcctgattgttgaatgtagatgcttgggttttgatgcttgggttttacaatatttattttgttttctcagagtattttttgcttaatctttgattatcagctgtcttgttgaggtttcctgataagtaatttaatgagtatttgttaaatgcccatttttctgccaggtattgcacaaagctctgggtatataatgaaacccaaaatgaaacacacatagtttctgccctcatggagtttacagctaatagacaaattttatctgataaagttgcactgaaggaaatggatgagatcctgtgattgaaaataatgtgattaggaagaacctctctgaggaagctaacatttaggaaggatgagagtcctgtcaggagcccctggatctggagaacagcaggtgccaagactccaagccaaaacaagcttgacttgcctgaggaactgaaaggatacctctatattatggctagaatatagtgaacaaaggggataatgtcttgaaatgaggttggagggttcagtaggggccagaaaggattgtaaaggaattagaatgaaatttagaaggttatagaagcagcttccataagacatgatagtggccccagctagggtgttgatctctagattaaaggagttattacagttctgtgtgtaaaccatcaaatttcacagcttttcctatgaggtatggaaatacatagcagtggccacttttgctgtctaattcctcagttcttatgtttgttttggtctgtttatttt

SEQ ID NO: 111503 - DNA, 1049 bp, Homo sapiens
gcttatgtaatgctttaatttctttagtacctgttagtttatgttcaggtgacttaacagggtaaaaacactgcataattgccatcacagcaccatgacaagacagtggaatttaattcaccacaataatactttctaagtgttgtcaccagcttaagaagtataaccaaatatcatggatattaaacttttaacatatatcacagaattcataacctgccatttgattttattttgacttttaggacctttttgcactgttttaagcctaaggagtatgtggatgcttaaagaagtgatttccaaactttgtcatgccatctatccctccttctacattcctcatgtcaaagaaaagctagagaattttgtcatttaaaaaggcgacgctgtagttgtaatgtttcctctgttaaggagaagaaaagctaagcactttgttgggcaagtggaaaatgcaatagtgggcaaagtgctcagaacctaggtaatcagtaaacttgattgtagttggctacgtggagaggttaatagggtagaaaataattattagtggttttcaaacttagctgtccattagaatcctgggtgtctttaaaaaaagaccattgtctttgctccaccccaggccagttgaaggccaaatactaagtgagggtcctaggagtggacagttaaaataataaataaataaataaataaataaataaaatctcacaggtgattctaatgtgtagccaagattgaaaactattccaggttatagggagggactatctatcatcaataaacagtatgcctttctacattgtgagttaaatctctgattttcctcagcaacttccttcttctcccatttatcttggttctaggctctgggttaaaatctatctcagctacttcctggataaattgtttattcatgacctttagttgagatggggatagttatagtcgataccttttaagattattaaggattaaatgagatagtacatgaaaagaatttattgcactgtgtggtactatgttcaatagatactagtttt

SEQ ID NO: 111504 - DNA, 1023 bp, Homo sapiens
gctgccgatggcctggcctcgcgtcttggtcgggaaggacttgctggcctggcaggctgtgcgttgtgcatccctcccgcagccagagcgccggtcccgcacttcgctccccgaattgtgctaagacctcaggatgtgcgcaaggagtgcctggaagaacttgccactcactccatcttcctgggtgggaggcaagcatggatggggcccatatcaggtccctaccgccccgcgtccgaaaagccgcgggctgggcggtgtgggaaatggctttttggctccgaggccaaattgctcaatgttttggaccgactcgcctcgccgcggtcgctcctgacaagaactagacagatttttggagcagggagcatccagggcaaacgcacgacagtcctccgcagtgcatctcaccggacaaacatccccggagccacaggaggggaggaaggggctctccgggcgtgcgcacctccccagccgccgcgctgtcccatccccgacccctaatctggtcaacctggaccccggcactgctgaattgcatcccctcttctccctttctcctcggcctcctcctttccacaaccctcaagatgaggaggccctgcctcgactccccgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcc

SEQ ID NO: 111505 - DNA, 2348 bp, Homo sapiens
gagtacaaggaggcatctgcatcatgaaggatcctttgggtccagaattctcctccaatgttctgagtgtagactcagcactctttttaactattcccctggcccctgtctgcctctttgaaattcctctgcctctcctgctcacagggaagtcatagagtatgggtgcatctgaccggtctgcccctgactgaagcaaggagctgtggcttatgcttactgcccttcaattcccatatattcctctgcattgccctttgagggcccccgccccccaagtattacagctcctgtgcctaacaggatgaacctgctaggaatagtgaatcataccttccccgtttcgttcctgcaggtgtgaggctggagtcattctcagcagctggacacaaggcactctaaattattatcctgctggaaataagagaccccagataattcatttatccctattctgttttttcccccactcattcccattttttttctcatgactctgtaaatcatgtaatgctatgcatttatagcatgctttctaatgggccttaagtttcgtatgacatgtgtggtgtacatagttgttgctcttcagttggaaactgtgtgccaggccttttgcttggggctttacctatttctagtagtctcaatgagcctaggaagtagtactattattacccctaacattttacagctggagaaactggctaaggataagccctaaatcatcagtggtgaagcctgatgagattggctgcatgtgcccagctctatagccattcacatgattcaccagaatctgttgtaagactcattcaaaaatatttaatgagtttttactatgtgccagggattgttggaagttctgggaatacaggatggccaatgtcactaccttcccaattttggtgaaaaatatttagaattgcgtgtcttatgaaagcggattatttgtggagggaggattaattaaattttagcttggaggaagggctgtaggcatttgaccctgtggtatgttggcttagttgttagctatctcattccagttagcgtccctcagaaatgaaggtaagctgtttctaaaaggatgatgcaagccagttaaaaatccatctcccactccaaaacataaaaatggtcttgtgcataggtgtgaaagagaacacccccaataatggctgatgtcattggctatttaccctggatagcatggtgagaaataatgacaatctaccatccaaagccattttttctcccaaaagaaattctcatcagaaatgtgccaagtattctgcgggcttcccttggagaacatttatgtacagatgttgtggtggtgatgaattttgctgctgttgttgacagcccttcgaagttacccttagggttttgactcatttcctcaagtctcttccagctgattaaagaaggacacgaggaaatgaacctcggtgtctctagcggaattctcagagctggcctgcagtgtggggaccccttcaaggtagtggtcaaggctgtggcagctttttcttcagaatgaatgtagtttaagagttggcaggctaggatgtgggaaatgctttcttttgctgcattaatgtgcggtaacttttaaaagttgagattgaatgacatttgcaggaatccaaatatgcaaatttcatgtgcagttttggtaacttgaatagatattgccacagctataagtccggattgaagaaggcctggggaagagttagaggaggtaaaagtttgcctggagggcaaatccagtgtaaatctttgttgtacttagagaggaattgagttgagtcatagagaggaattgagttgagtcggcttggcccagcagctctgatttctgacattttttggatgtgatcatacagctcatcttttgacctaagactcttaataagtaaagagcagttgtaatctgatagcccgaggagacatgttttctttggcctacatgatgctttttagaaaacattgaggcgatattaaacaatctagagattttttttaaatcaagatctctatttctgtctcctctttaagaattgaaggtcatggcccctgtagatgaggcctgtgctcttcaggttgcattaggctctagggctttatcctgccatcccttaggcattccccactgggccctggtgagtgcaggaatccaaatatgcccctgggaccaggcagatgacaagtgggaggagacaggccggcctaccttgtgttggtctgatggcttcatgactgacagcttgatggccttagagcaaattgtttaacctttttgagctttcattgtccatcctagttttgccacttattag

SEQ ID NO: 111506 - DNA, 1202 bp, Homo sapiens
cttctctcattcggcgtatttatgggcaccttctgtgtgtcaggcactgatgagattgaggggaaggagaactggaattatcatgggtgtaggtaactgggagtattgttgatactatggaattagtggaaataaagccaagaggaggggtggcctatttgagggagagaatatgatgttggactctgctgggtttattcattgattatttgtgagctgcattttcttgaaactcaatttcacagacatggagggaagacgtcaatgaaatcttagggtcaggtccctgtaagaaataaaactaaaccccaaagtcacaaaacatggctctataatattacggtagcattggggattataaagaatggtatgttaactgtgaaccagtcttatggtgaaaagtaagttttcatgaaaaggagtgtatactaggaagagaatcctgtattcttctctgcattaggccatgtttaaggtatgttttttgtttttctcagaataaaatggccatactgggtatagaggaggacatagaattgacgaaagctttgggaaataggtcctttgaaagcaacttaaagaaattggatttattaagcctggagaagataaggtgagggaaggtttagtgaatgacagtcttcaaatatttttagtgtgtgagtgaaaagtagaacaaaatgagagtcatttaaattgccccagaaggaaattgaaaatttttttgtttttgttttttgttttttttgttttgttttgttttgagacagagtctcactctgtcgccaggctggagtgcagtggtgtgatctccgctcactgcagcctccacctcccgggttcaagtgattctcctgcctcagcctcccgagtagctgggactacaggcgcacgccaccatgcccagctaatttttgtatttttagtagagacggggtttcaccatgttggccaggatggtcttgatctcttgacctcgtgatccacacacctcggcctcccaaagtgctgggattacaggcgtgagccactgcacccggcaatttttttttttaagggaaaattctttcattagaagggttggcagagactttattcagttatagggcctttgctggagctgtgaagaaaaccaagtaattgtcattttgaaatggttcttaggtcctccccaactcagttggtttgatggccctttaagg

SEQ ID NO: 111507 - DNA, 1953 bp, Homo sapiens
caaagtccttttctcttgattactcaggggtggattggttacccaccactctgactaccctttccatctgtcctttccctctggtcattttgtggtcatggctcagtggcacgtttgagatcagcccatggtccagtggggaaggtggtagaaatgacattgcaattcagcagctactgcttgataacattttattaatacctgtcactttgaaattgatgagtcttaagatgggatccttgcctttaaggatcctaggacctataggaagatggtcctgggtaggcgccaatgttacaggatttgtaataagatttaagttaacaattccagtcctattcattaccattggtttggaggacataggcatcacttcttgaatggccaattgaaaggaagataggggcctgaattaaatcttaaaagagtggggtggaatttggtcaagatgtgaagaggaaaagcaaaggttagagttagccggaaggctctgctcccgccgacagaacgtctgtagagagtagcggaagatgagatgggataatttttagggcacctggatttttattcttcaataattgaagtctttcctgcagtgctatatgtgatgagatttttgtaaatgtaatctggctaagtagttgcctattcagagaaataacttttaaaaatggaaaagtatggatatcacttttgcatgtattacctgtgttgtatgttcgatgcacatccagtatggatatgtattttgagttgtttttaagtccaaggctaattctgctcccttctccctaccgaccttccccactcctagccaagattagagattttgtgggctcaacttctgattgtggcagtagatgacctttcatttgcttattaacatattttaaatatttagcaaaataatacaccttgtttatgtcagtttattcattgaagcaaagatagcaacaaacaagcctgcaaaccttgataaggagcctgtgtggtttggaacatcttgagattcttccctggatccccccgagtcctgttttagaaacctattaggggcacactggtggctgccctccccaacccagggagtcttcggagggaggaggaggtggctgtttgtggtgggcagaactctgtcacttaaggaagaggcgtgtctgatagcacttgccagtagtgaatgcctcattcttgaccaagtagaaaaaagataagagggaaaatgaaaaaggtgaaacggttctcctttaccttgtattttaaattgcttagtgaggcaaaatatccaccttcatttgggtttaccccaggtaactcatttcacagggtgttagaacatttcagagggtgttagaaaattccaaacaatggccgggactcccagtaatttaaatataatggcctatgcgggttcttaagcagaggaattagttaacagagttagaacaaaggagagcattatcacaaagagctctggaagttaatgtgtctctttttattggaaaagaagtatttctagaacaggattcaattggcttctggggaaaatatttactggagattttagaagtgtgaaaggtggcaggagacgttggctgtctgttattctacttggctagtgcacacttaaaaataaaacaagactatgttaaaaagatcttgagaattctacttggaaagactgaagtaaagatagtacaggtacttttcaaaggatataaattttggcttataaagtattttaaatgcaattccatcccaactttcacaatgcagacttcctttttagtggctgatgttgaaagaaggtaccttagaaagattttccatttaagaaatggttgatattgatatttatttggctgataaaacaccacaaggactggtttttagaattttttgtcattgttaaatcaagccaggattcttaacctaaaatatgttaggatagct

SEQ ID NO: 111508 - DNA, 1043 bp, Homo sapiens
cttcttcctggaagaccctcattcccgaggggtcctgccccatccccaggggaaggggaattgtacagagcgggcttgctgggtttcaccactctgtccatcactgttaggccagatcctttgtgtccaatcacttttctgcatggctgttcattcatcaaacctaaatataaaaataaaggttttccctggggaaaaaaatatgacagacttcagttttaataataactgttgtaataactgtcggtctgtttgacacggtaccatttagccaccatcagccctactgcatgtcaagtttcaatgctcctgttactgtagctggcctgggtgaggtgccagcagagaggtgacagggtgacttcatccggctttttgcgttttcactttagagtggcctttcacagttccatgaaatgataagctctccagtttcaaatgaaggacgcctcaaattgagaactgacaccattgcattcctcaggatgggaaagttccttctccatcaattcttgggcactggagtaggactcttgctgcagatggtattgttctggttctcgagaaggaatccaagataaaggctgtctggggataaaagtggtaccctcttggaatatgggcaggaaggcatccctagtgaccatagccttggttgaaggtattaaggaggaatcttgaggtgcttgtctgggtgtcagttgacaatttcaatgaaattagcagcattaggtctataggtggctgcttaactaattatgaactcagctgcttaaatatatttgctccaggtttcacaattccttttatttacagtaattatcactggttagcacctattgttttgggtgagaatttcagggtctacatttaagtaaaccctatttaaatttattagttgactagggaagggttaaaaaagcagtaaggagtctatgccttctagagtattccctggcttgtttgaaaatgtgttagcagccatttttcaatatgaaagaactgaactttaaaaaaaagtatatttttatttatggcaacat

SEQ ID NO: 111509 - DNA, 1054 bp, Homo sapiens
taaccatctagcttcaacacttaccaatacggcctctacccactttatcttcccattattgggaagcatgtctcaagcatcatagaatttcatctataaatattttcagtatgtagtcctaaactacaaagaccttcttttctgaacataatgatgatgccaatgtcaaacccttccaaataaatataattacataatgtcattgaatagtattcacattttcctattgaagatacataaaaatataaacaaatgtatgcacatttaaaagaaagcaaacaagatctacacattgtaattggttgatatgtcctttaagtcatttcttctctgtaggtgttagccccgttttggttaaggaaactgcagttgtcctgtgcagcttttcattctgattgcattccttggtcttcacctgtaccattttgaatatttcctgtaaattggtgacttagacgtttgatcatactcagtttgattttttttttaatgagggtactgtgtaagtggtgtgttctcttgttctgctttctctttttggtgtacctttgggtatttgtgaagattcatattttttgctagatttgtatttttggttttaatggttgccttcagactgatacctttctataatacccttgtctgctgtttttgtgggggctattttccattgttgctaccataatatttaaattagccagcgtttgttctttgctctctctttactctcctgagctggggattggaagtaatattcttttacttccagttaatatctaaaaggcaatcagcaagcatattctacttttcggaacttcacctattccccatttttctgatggctatactcatttttcagagcatacagcaattatatactctgctgtctcccttgttaccatcatttagtcttagctctacaggtaaatatctgtttaatgctggcggccagtctttatatcatggctttcctggcattttggttttctgaaacgcaccctctaatagatgccttatgggaagtagttcctgaattatatgtccacaacggcga

SEQ ID NO: 111510 - DNA, 1109 bp, Homo sapiens
attcttcaattctcttaatgtcagaacgtcagaccagggtgcaattctcagttctccttgtgtcagactaagaaagatagatatgagtttcggttagtccagacaggaaaacagacaactggagtaccatgggacagtgctgcagtagaggcttcgagaaacctgcatgggtggagggagcaggggaagagtggtattttcagaggacaaatacgattgtgtcctaccctgattaaaacctgtcagagactgcccagtgctcttggaataaagtctgtctccgtagatccctttcaagcctccagtatctccttttgatctccattttgcacacagcacttgcctcattgttggctgtggagtgcacgctgcacccccaaaggtgtccagctcctatccacccatctgtggcctctgcaggagctgcccttctgtccactgccaggggcctcatgcttctccctggcctcctagtgcacttcacagcccagctcccacccgtcctttgcaatcttctctgacctcccagggtaggtcagatcagccctcattgtacagcgtgcttgttcgaacttatcacattgtaattacctaattgtataattattggtttattgctgatgtggagttaaatataaactctatgggtgaggggtggggaattcttgccctcttgactgtcccaagggcccagcacacagcaagctttattattggatgaatgaatggtggagcagtcctcatctttgttgttaggacacatgggctggttaatatattacattttgattgaggtgtcacctgagctttagacccctccatccctcccgcccccatccccactctcatccccaccctcgtcccaggagcatttgccaccaccatctcattctactatgggaaaggcaggtccctggcactgtggcagcgaaatttcataacttggttctaacttggggtctgccctgtgggacactagagagaagttcttgagtatcagtatttcagggatatggggaaggaagaactcctttgcttttgcagacattcataatacatgggtcagaagccagcagcctggagtaaaggtggccccggaaggttttcag

SEQ ID NO: 111511 - DNA, 1150 bp, Homo sapiens
cagataggcatatgtgtatgtataaatgttaatcagcctctcacttatctgtgtttcatttgatatcattcaaattagatgccataagttagaactagagtttagggttgtcacacttttttatgtcttgaagttttcattcgtccttttttttttttttttttttaatgagaaggagttttgctcttgttgcccaggctagaatgcagtggcatgatctctgctcactgcaacctccgcctccccagttcaagcgattctcctgcctcagcctgccgagtagctgggactacaggcgcccgccaccacgcccggctaattttttatattttaggtagagatgaggtttcacggtgttgggcaggctggtctcgaactcttgacctcaggtgatccacatgccccggcctcccaaagtgctgggattacaggtatgagccaccgtgccggccttatttgtcttcctcaaaactccatttcccctcctgagcctgcagggaattgacattttgcagaagcttgagtttcctgataggaggaaatttggtgattagtgaatattggagcgcctagctcacactcgcccacacccacacctgtccaggacagtgctaacatgaaggcagtttgcacttgtcaggtcctcctgcaggatcttgttgcaagaatctggtgatgcccatctgtttgtggagtgtgcagccaggaggatctgctcggaggtgagactgcaccagggctcccttttgtatgtcctaggtcttgggggggtgaagtctttgactagtgtggctgacctttgccatgctcttttgacctgtttctttttactttgttctgaattgttctttaagtgaaggaagaaaatgttcaaagaagggacgagctcgctaccccgaccccaaacttcacagatggtgagggccttgttctggtgtttattggattccaatccttagtgcttttctggttcatgtttcaatatgtgctttccagaaatcaaaacacagaaatctacatatttacggcagcggggatggggtggggggtgcggggaaacgggggactgtgctgggctgttgggaagaacccactggaaatgagaaagttcctcctttctgctcagggatggatcccagtatattttgct

SEQ ID NO: 111512 - DNA, 1210 bp, Homo sapiens
caagatagctgaggcaggttttaggtttagccgggccttaaagaattgttgagtttttaaaacattaattgcagtaaaatacatgtaacttaggatgtactatttttaagtgtcccaattctgtgtggcaccaagtatcttcacaatgttgtgtaaccatcactactaaccatttccagaacttcttcatatcccaaacagaaactctacttattaaataataactgtccatcccccactgtactccctccccacaccttaataacctgttctactttctgtctctgtgaattagcctatcctatgtacgtcatataactggtatcacacaatatgcctttctgtctggcacatttgacctagcatactgtttgcaaggttcattcatgtgtggcatgtatagaatgttactttttttttgtggggggggggggctgtgtaatgttccattgtatgtatataccacattttatccaagttattggaccacattgggttttataagttattggaccacatttgggttgtttacaccttttggctatggtgaataatactgctgggaacattggtgtacaagtatgggtttgagtttctgctttcaattatataggttgaattttatactgctagtgatgagggagacatagcaagtacctgaagaggttataagccagaggcatttcttttattttgagctatcactgaaatcttgcattgttgactcttcgtaagtgtccgcttcctcctctatgctgtttgagagcgaaggccattttctaggttcagcacttaccaagtagctgggataagtatttactgaataaatagttcccggagttcctagcttaaagccgtcattccttatagtgctagttggtctccagagtgttgggttttgccacctatcctttttttgggttaattaattaacatgtgttcagggaacagaaaacaactcttaatattagccttagccaaacataatttgggaagtacatttgctaatgcaaaaagtcctggtgtaaataaaacacaattcaacaaacatttgttaagaacttgctgtctaccacgcacatttcaaaatttggaatttcagagcaatttcaaagctaagttggaatacctttttgaaaggcgttctcttaatacgaacctctactcttttaaaaaaaactttgtttttcaaaaattgtgagactactat

SEQ ID NO: 111513 - DNA, 1010 bp, Homo sapiens
ttccaggtgtggaaacttggacacagagttagggtgatatgcctatgtcacacagctagacttagctgcattggcctggtgtgtctcaggaagtcaaggatgtttatttgactggattgtaattatctatatccatcagatcaacccatgagaaaatggaattgattgaaatagattgcagtataaattctttaagaaatattgggtcaaatttgctatcaatatcatgcacattcattgggaactgttcttttttaaaaggaataaataatataaataatagcatctctattgctgcctctgtttttattatttagtgctctgtacaactctgaaaataatcctggccactgcgtgcccatattcttgctgccacatttagatgctgcacctagcggactcaacgtctcactctgtagcctttatgacgttgttgctgcctaataatatttaatgcttataattggacttattgtcttttgatctggggtgtactttgcttgacataatggggctacagttgatgccaccacaggcaatatttggctaataaacaggaattgagactggtcatctatacacacacctgcaggaaacaatttccaccctcctgtaaagcaccttcagtctgtccctacccacaagtgctcttctttctatctcgcatgtgagggggtctcctgttttctttacctttaagcctggtttggctacagatctctatttctgtcttgtactgccagaactacccaagggagaggtctgcatttgcagcttgtagccctggagcaaacaacacttcccactcaattgaaattgtactttagaatttccagcagtctctttgtaaccagattaggggtcttttgttcattccctgccatcttactgtggcatctgcccttagagccaccaccctctctttgaaactttgtactgcattgccttctttgccacttagcctctctcccttttcttcctggtggttctttttcttaaatctctcatga

SEQ ID NO: 111514 - DNA, 1045 bp, Homo sapiens
ttctcttctcgttgatccaccttagtgtagtcaatcagggagctagctgttcatagttcccccagcttcaaaaaatgtcatctgcttttgaatttgtttatttcatggtcctgaccccgtgtggcagttccatgactgcctctcatagaggtgaatgtatctgccatagattggcatttagactggactgacttaagtcagcccaaagtttcataattgcatcaagtactcgttctaagggaaacccattgggtagcttgaattatgttggttgaaaagattagcatgcagatgattcattctttgatttactattgacatatgaattgactttcccttcagctgatcaattgcaatgcatcctcaaactgtttgagatctgagaaggaaaattccagttgactgtggaacttgttatggttgtgccgttatgtagaatatttcgttagctggaagataatctaggttttaaatctcagagatcatctaattcaacaccagttggcattcagctattgagtacagtttttattaaggcttttgaaaaagtatacttattgaaattagggaaaatttgattatttaaaacctgggatttccagaggtgagcagggtaggatttgcatgagaaagacgcctgtttgcttaaaagaatataagtagttgttggtcacatcctcctgacaccatcaaggttgtctgaaataaagattaaagcagcttctctatgctagggcttctacttggtttggaaaaagtgttttccagaagtattataatctcacagtgggcatttctgtctttttcactcaatttacttgaaggatgcttgatttaattgctggtaccttcagatatgcaagtagtacagataggttagcaccatgctttgtattttatttaaaagatgacaaagtaagctgtacacatttgaggagaaatggtaaatcaaaatttcatgctataatacaaattatttgaggggccacatttcttttcattctagccttcaaagctgtgcctgttgtgtctgtgtccaaagcaa

SEQ ID NO: 111515 - DNA, 2181 bp, Homo sapiens
ggggaagaattcacagtgacgtgcacaataaaagatgtgtctagttctgtgtactcaacgtggaaaagagaaaacagtcaggtgagtgaatcgcttcattcttctcatgttctgtctctgtgggagatgataagttttctctttcagaagagtctgtcctgaaactgcctcgactagtgcgtctgtcagaggtggattgtctgggagagtgttgggattgcatatttccccctttcatacctccacatggagatatatacatttattattagtaacaaataaatttcattttatacatttattttgagaaacttgagagaacttcagattcatgttattacttcatgctgtttctttgaaaaactgttagggacttaaaaaacatggttaactgcatgaatactttgatttaaagctattgttgataccgtttaggccagactatttaaaatattgaaaagagttgccacttccatacttaaaaagaatagagagtctcaattattcaccagaaaacccttccctcgcccacaaattggcctatccatttgaagatgggtttctttttgtaaggatctgatttcctcctttgaggctggttacctgagattaagttgctaatggttttctatttgttttagtcactattaataaaactgttatccttaatctgaaacatctgggcatgcttacgttcccattcatttaacaaatgcatattcaatgccattatacctcagatactgggttaggcatatcttaaataaattttagctagttactgaaattttatccctactaaaagagcagagtttttacactgtcttaatttccaaatactttgctttaaacttcccattgaccaagttttcagtaatttttgtttgaataatcttggccatctagttaattagctatcacagtggtttttattcattacccatgcaagcattatattggaaaaaagaaatattatattttctttctcctcctcttcctcctcctgccccatgttcaacattggcaattttatgcctgtttaaaaaactctttgctaaacaaataaccatggtgattgccataatgcaaagacagtgtgatgatattcatgtagacctgtgatggatgatatcttgctaaatgaagcctgccattgactggtagaatggattgtaccatagacttattctttcaaaccaatgactcagagaaacattttagtttttgtatcatataatgtaatacaaaaatagcttatgtatggatttttggctaaccttacagaatacaatctcatattaattggctttctataatccttgatttcagatgagagaacaatttagaccgggtgtgcatttgagcctctgtataacttgaacattatccttttttgagatgagaaattaaattgccccaggcagttttgttctgaaccatttttcccaggagccctgcatgccagtcccaattaatccactggtgctggtagataagccttcagtgttaggagctctttggggaaatcccagtgtgcacctccaagggttaaggaaaaccaaatcacgtgcaaacaatatgtaatgtgtgacttgcagatggggctcatggctgtctgccaaggttcatccatgaatcttttattgatatcttttggcttaatttagaatactattagcactatcaaattattaaaaaatccataatattttattctgaccctttggaataagtttaactcacaatgtaatttagggtaaaatgactttttagcattgttgccattgtttaagcgcaagggagtcttggagtttgttcaatactgttaatcttagttggttagctttcttaatgcctctaaaccctcacatttttacttgcttgtaatcagaatctttgacagtatcctaacttatgggctttgggtttggatgttcatgctgcatctcttatgactgcactattcctttcagcgctgacaagttcagagttcctgtttgagttctgttgtggactcttgggctcttgaaagaactagaaggaagataccttaaattgagactttgatatgttatctgtccattgtcactctgcctttgtggagaagtctgtgaaactatgaactgggaaaagccagtttgaaaatgttgcttcaccttgctcttacatcttcttgacaat

SEQ ID NO: 111516 - DNA, 1752 bp, Homo sapiens
cgtcatagatagcaatgctgtgtaatagaaatacatgaaccttatatgtaattttaaattttctagtaggtacattacaaaaaataaaaaaggtaaaattgattttaataatatattttatttgactcagtgtgtctaaaatattatttcataatgtaattaacataaaaattactaattaggtgttttacatttttttaaatataagtcttcaaaatccaggacatattttatatttacaacacaacttactttggactaccagatttcaaatgcttagtagtcccaagtgtctagtccttataaatgctatatagtctgcattttttcatattttttctcttttcccctatgcatatgtattatcagataattgcaattttaaggtacattcaatttgtgctttttaagtaggtaaacacctctcttatagtcataatgctatacttgatatacatttaggtcgtttctgagtttttaccacaaccaacatattgaagcttttattttctgttgagcaatttccttgagttaaatttgctgcagttgatcagagggtatgaacatcctggtaagctcctttccagaaggatttttctgatttataatactgtcagatgctttaactctattaggtttaccaaagcctcgccaaggaatcacccttgatctcattccatgtcactattagctccttttactttaattggttgtttttttccccattgtaataggagtgtgtgtacattacagaaaatttggaagatgcagaaagctatattagactttctttaatcttttcagaaagctgctgtagcttatgttatggtttccccatgactttttaaatacaagaaatctctccatgtcttgtctgcagacaaaaaatgagtgagatggtgatatcacaagggtaaattcacaaccttttcttttcagctcatgcttaaataatttgggccttgttcttagatgtctcttataccttggaactcccttcagtagtttacaagattctgctgggtgagaactgcaggatgagtttccaagctagttgttgacattgtgattctgttttcattcttgcaaataataaattttaataaaatagaacattattgttattagcaatgtgttcgctctcagtcattgggacatagaagagaaaaagacatgacaaaaatatgctgactcatattacaaaatatcagtatcccataatatttcagagatagcaacttttaaaatttagcgttgtatagaatttggaattatacatactagggttaagaaatgaattttcgtttttttcccaatcgttaataatgactgtctttcaacataatcctgtaatatgaagtgttccaatgacagacttgtcatgatgctttattattcttacttaagtagtgtataatgaaagttaatatggagaagttaattgctgctatttttaatttatctaggaaagattctgaatataaattatatggtaatcttcatttttttttctccttttctgaaaccagcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtaggtaaatacctctatgggaatgtttaaattactggcagtagtgaaagaagaa

SEQ ID NO: 111517 - DNA, 1034 bp, Homo sapiens
ttactgagaataataataattttaaaattactttgtttacaatttttttgtcttttgagtattgtttgaatttaatccatttttctgtctttttagtacaaccatattcctagtgttagactttcattaaatacttctaaggtggcaaaattcttgatcaagaacaataataaagtgatgcggtatttgttttcatctctttccccgcctcaccaaatttcttcaataatttatgtagcagtattaaagctttgtgattatcccacaataatctcgtaaaattttggcgtttctgcccatgttataatggaaagtttctccccagactgaacatggaaaagatactttacttgcaattatagtcagcacacagaaagtgtactactttgttcctaaacatgattgtgaaccatttattaatttgaatagaaggctatgcttttaaaatattaaactccataagcactaatttgctaagttgattagggagcatgttgatatatcagcttcagctccagaaagcaattagtaaggatgttttgagaacattgttgtatgtaatcggatttttaaaatccattcatcaatttccaagaattatcactgtatgactggaaggacttgtggctgtgaaacctgaatctggttttgtattgttttgagaatgggttgaggtggaacaggaacaggaggagacaaacagaaaagtaattttttagtggctgggaggagggtttggatccatgatggagtgatgaagagaacagggctttggtatcactctttttttaagaaattacttttttattgtatatttttaagatatacaacatgatgttatggggtacatatagatagtaagaatattactatagtgaagcaaattaatgtattcatcatctcacaaagttaccctttctttgttttttgttttgtgataagagctgttaacattttacctggttttgaattggaggctctgcctgtaatcccagcactttgggaggctgaggcgggcagatctcttaagccca

SEQ ID NO: 111518 - DNA, 1017 bp, Homo sapiens
tactaaagaacattctttgaacatttttattaaacattagggctcccttgttttcccttaatttatgacaccttatcacatatataattatatattgggtctgtgtatgaactcactatttattccaaattcttttaacctaataaacatcaagactagtagatttagaagacttttaagatggtgatagatctttaagagaattgcttaagaggcagagatgggagaatcagtatttcaaatgtgtgtcctttctcacttgtgacagtgattctacaagagcaaaataaaatgaaaaacagctagttaaaattctcttattgccaattaatactggaaatcaaccaattgtttttgtaattccaagatgaggttctgtttttttgtccagtagttgtagataatggtttctttctgtcttatttcattctaattagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcaggtaagaaatggaccttgccctgggggattacacattacccccttttccagtgggcttatcagatcttatttctgtaacccgtaaatccacgagaagatacctggtaaagaagaaagtctggggctgcctcctatgtcctcatcctagtattccattttgttgtgtgtttagagcatgcacactcttgcacacgcatgcacacacacacctgtgtgcctcagttttctcacttgtaaaatggaggacagttttctagagatctgagcttagctcaaagcagtaactttcatgtactcgggatacagcaagtctcttcagagaaaaagggaagttagtacctataattgtttcttaaagctgtaagaaaactaagagccaaataacttcgct

SEQ ID NO: 111519 - DNA, 1085 bp, Homo sapiens
cctgcaagaagtcagaagcttgagtggcaaatactgccaggagcactgagaagtctccggggtggaggaaaaccaggagatgggggtgttgcaagaaggaaggtgagcagtgtggacctcgctgagggcccagagtgtctgtgtgagggcagtgagcatgtgcatgcagggcaggtgagttcaggacactgtggagagcaggctcctgcagcaccatgggcaggggaggaagtggtatgcggacagcccagggtggtggggggagggcggaggcgggaggcggtgggccagtggagaggctgcagcctctgtcaggttgcctttgtgcttaacctttccccactctgtggtctctcacaacaggcgttggtcccagatggaatatgtgtgtgcgtgtttatgtatttgttaatgtggattttgctaatacttactgaattaaatgagttatatttttcctcaaacaggcatagatttccaggtagaaactgaaaaagacatgccttccaaggcatgctatccacaggtgattgactagttgtcttttctttgtagatacgtaagtgaacttcatctaacgagattaaaaggcaccgaaggaggcacttacacattcctagtgtccaattctgacgtcaatgctgccatagcatttaatgtttatgtgaatagtaagtaacatgaagggctccttttaattttttattcttttaaagttgtggctcgtgtttgtaacagctgcaaggactcaacttgtgtactatgtaaataacgtttcatgataatcttgaccttcacagagacttcgtggtttggtggttagagtgtgtcaaaaaaccagttccttgtcctacatttcactgatcacatgaccttgtagaagttgctcaaattctgcgtgctgcctttgaagtaaacagaggagccaaacaagttgaacatacagttgtttgagggaaaatgtattattattgattgttggaatggggggctagtggttgaataggagctgaattactgcgttaggtagggaagagatgctatcgagccctgacgtgatttctttgttcagtgctgtctctttt

SEQ ID NO: 111520 - DNA, 1050 bp, Homo sapiens
accaagtagctgggagtacaggcatgcaccaccacgcacagctaatttttaaatgttttttagagatgggggtcttgctttgttgcctagactggtcttgaattcctggactaaagcgatccttctgccttgtcctcccaaagcactgggattacaggagtgagccacaacactcaacctgtgtgaagtgattttacataattgtcttatttgatgctacagctcaggaaagatggtagggtgggtggtgtaagccaatgaaaagaaatagctggacagattttttattgctaatccagagtcttttgactatgaacatttcaaaaattgtgttttctgaataagacattcatatgagtttagatgaagaaggtcacattcgtgtaattaaacacatatctttattactggccttcccagaatcctaatatgctaatgtgactttgccagagggggccatgggataggatgtatatatcccaaactcgtttgatcacacagttctcccttttcaagggaaacattaattattatctgagttccagcaaacagttttgattacatagcatttctctggtcctcaattcaagtatctctagattaatttcaatgtgaatcagaaagtaatagtatatagaggctggacgcggtggctcacgcctgtaatcccagcactttgggaggccgaagcaggtggataacctgaggttgggagttcgagaccagcctggccaacatggtgaaaccccttctctactaaaaatagaaaaattcagctggttgcgatgatgagtgcgtgtaatcccagctagttgggaggctgaggcaggagaatcacttgaacctcaacctgggagacagaggttgcagtgagctgagatctcactgttgcactccagcctgggcgactgaacgagagtccgtctcaaaaaaaaaaaaaaaaaagataatagtatatagagcttagtgtattacccatggacaaaattacctgcttctgaaaagtcttaatgttcatctcatttaagagatgaccgtaggtaaatcggt

SEQ ID NO: 111521 - DNA, 1113 bp, Homo sapiens
tacttttactctgtgacactaatgcgtaattgcttaatagattcatctgcaagaaatgctattgaaaatccttgatttggcatggttaaatatttggcggttgaaaaatctatttgttttgaaaattccacatgtaaatttcagtatagtgaatgtggggaaggggcatgttttaattgcttatatggtagacttttaaaaaatattgtgctctgacaatttgtgttaagaaaacacgtatataacatgttaagcttgaaaatgttctaatactgtttctaacctctctaatcaagccatgatttacatgggcctattaaactgactcagtgacatttaaggtggtttataatggccaagagccattataacatggttgccatctttgagtagaacttctagtggaaactgataggaattttcattaaaaaacaaagcaaaaccaaaaattagtgattatatctgcattgaatttgcattactctaattaacttttggaattgcttatccaagatgtgtatggacatcaaattcttagatctgaaatgtttgatatccttcagcgaaaatggtgatttgtttttcttggaaatgaaaatcaggaaaaaagtagagttttgaaaccttacctcaaagtgctttcttaatagacattaacctttccaaaactcttggaaatattagaaaaaaatgacattgccaagatgctatgggtagcttatgctacttatttaggaactgatggcctctttggttatattaaatgtcacacaatgaggtttttttttgccagatccaggacaaataaaaggccaaatatgcactttaatcctaatatatccatttggcttttttccccactccatctagtatttcttgaataaataacaaactttatagtggacttaaaggataatcagtaaagtaaatattttgtaggtttattttggcttcaattttaaatacccatgtgaatcctgaaataatttacataattgtagaaataaattatggttgatatgataaaccagttgtttttcaaacctttggaataattttaagaagatcctgtaaccttaaagtggatagttcaaaacatgatctggtagcatt

SEQ ID NO: 111522 - DNA, 1359 bp, Homo sapiens
agcaaaaataaaaatcaagttttatttttactttttatgtttatttactttttataggttaccattactaatattctttattatacattcctccagaccattaatttttttttaaataaaaatgaagtcatattgctttataacctggatttttggtgctgcacaacaaaagcattgtgaatatctttctataacatcattttggcatctcagtgtatggatcttttataatttctctagcccatgcctgatgcaattttgagacatccaggagcgaggcgggactctgaaatgatgtgactgaattttaaaagaaacctgtcagatgattatttaaagtttataattatcgtgtttaatgtctaatgagtgaccttgcttaagtggctggaagttaataaggttatcatctgttgttatctttcatgctctgtgtcttcaacatacgatatggcagatatactgtgctggctttcaggacagttctaaattaaggaataattttcagatcttcttagtgtggtagctaatctatgtaaaaatcgttgcttgtcttttcacattaatctttttatagataatatgtgttcatttgagatatctgacagtgtttgaactctgtttgtattttctgttcctgaacttgaaatgagtttttgttctcaaattgcttgggaattatgaatgttgtttttgatgtgacactctaatatctctttctccttataaagagaatgtctgtggaggcaagaattgttatagatgtttaaattggaaaaaaaaagatataatggcaacctacttttaaagtagaacttgattctcttctgttctgaaaaaatttagcagatgtagctctgaactaagctaaacatctttccctcctcaaaggctggcatcattactcttcctccctatctcataagaaagttggtctggtggatgtgttgctaatttaggggccttgatgtaaacactgaacctgtaagagaaccaggtaaactctctggatccatagcccttggttgcccccgtttgtgtggtttggccatttttttatgttgatggtggaaaagcaggagaaacaggtttaggtatgtagccatgtaaacttctgctggaattgactctaaacttgggtacatagacttcgctaaaagcagtgagtggtcccttttatattgtggaacttccactctgtggagattttcttttcagttgagccacttgtttttacatcaaattagcttccttcatttacagatatatgcaaggtcacctgtaatgtagtgaaatttaaattaatccaagaatagggacataatgtttccatgggcattctgtcaatacccttctcct

SEQ ID NO: 111523 - DNA, 1045 bp, Homo sapiens
tctggatatctttaagaatgtataagacacagtatatgtccaaaatatctatcctgggaattttttaaaaagtataatattccttttataagtaaggttatttttctactccaattttagctgacttaaatttctttattataatggtattatggcacaagtgtaggttttacacagaccaaaaccgggatagtgaaaaattccggaaaagcattgcttcattgcctttaaacaccagcaaacctcgaattttaaaaacagaaattcattcttatgatccctcttcatttagtcttttattatttggagacttaagtgtttgcgttttttgtcctgctgattataaaatatgggcaaatgtgcatttatagcggaagttggttaaagtggctgggtgagagaactctaatcaaaaaatgcctccctgcatttagatgaagaaaggaagaccccttctaccattggcttgtgtattgcctttcagccaccagccctcagctttgttatctgtactatgttcttaaaattcattttgttcttgctttccacatggactggatggtgatgaaaaggaatattttccaagatcacaaatctgtggggtaaatcactggatgtgtaggatttttaattgcatgagcaataaattctcagcagagttacaagcatctgaaatctgcctacaagctgatcggtgttgttggcgatatcagaatgactcaggtccatgatgtttttaaaggcaaaaaggctatttttttttatctccacaggaaatgcataacttatacacctcttaggcttatctaaacctccaacttgggaggaattagagaatgtgtcatttgctatactgcttattgcagaatatctaagaagccacagctcagatttaacctggagaactgcagagttatgtatctttaaaggcaagatgtatatttaatgccaaacacggtgcattgaggcacttataaaatgcagatgagcccagattttcatttttaggaattagatttccacctggctcattctttatgcatta

SEQ ID NO: 111524 - DNA, 2992 bp, Homo sapiens
tggtgttatctttctggatttatcatgcaatttctagcctgcaggtagataaagcaattttgcaggacagagtaattagatttccattctatacacaggaggtaatgtgtgtgggaaatgtgactgtagttatcatgaaaaaattacctcagtagttaattgccaagttaccaaaaagtaatgatcgcacaattacaacatacatatggcatttgcaagcgaccgcttttaaaaagggtttcttcttgataatgtgcccagcccctgaacagagaacatctggcactgtgctgcttgcccctcaccatccacacttaagccttaaattgcccttttgcattacctgaagacgaaaatggggtcaccacagctgtttttatccatcaattgctattttatgctcaggctttaaaagcccaggttaacatcacaattgaatagttagtatggtcgcagaaattttatttttcatggaataagcctctttatcacaacaagttggaaggggttacatcggattgctgttttcagctggggtttaggagagtgttttcttttggggaatactaagtagggttcaaggcccctgggaggaatggccacagcagaagcaagccctgtagttacaggcattcattcagtagatacacagggagtggcaagtgtgtaccagacactattctaatggacagaacacacccaagtctttttgcctttatgagtttatgttctagtgcaggggtgttcagtcttttagcttccctgggctacactggaagaagacgactgtcttaggccacacataaaatatagtaacactaacgatagctgatgagctaaaaaaaaaaaaaattgcaaaaaaatctcataatgttttaagcttcatgaatttgtgttgggtcgcattcaaagccgtcctgggccacatgtgggctgcaggttggataagcttgttctagtgggtagaaacacataatagatggaataaacaatgaatgtatgtaggtgttaagaaaggaaacagggaatagctaggtgtttagaatagggaagtcggggtctggctcatgaaaaggatcccttgcagtggtggtctcagccacctgcagtataactaggccttcctgcttagaactcaaacttcagtcctcactttgactattttctggtctacatccttgattttgttgttgttgttgttgttgagaccgagtctcactctcttgcccaggctggagtgcaatggagtgatcttggctcactgcaacctctgcctccagggttcaagtgattctcctgcctcagcctcccgagtagctgggattacaggcgcctgccaccacgcccagctaatttttgtatttttagtagagacgaggtttcaccatgttggccagtctggtcttgaactcctgacctcaggtgatctgcccacctcggcctcctaaagtgctgagattacaggtgtgagctactgcgcccggccccttgaagattttttatgctttcctcctctatgctatttcttttcaaccattcgtgtacccttttgaagcttgtttattttagggatctactgtgtaccagcatatatgcctgccattttattgaattcctttccaatcctttcagtaaccctctgcaatgggtattactatccctgttttacagtcgtagaaactcagtgttggtgggggttaaaaactcatcaggattcaaacccgcatctgactccgaagcctcctctgccttctcttccccagtgcttttttcactcactaggtcaccaaagtgcttattcttagacacttgtaaaaggacattttctgttgattatgaacctctaactttgttttaaaagtatgccacatcccaagtgttttatgtatttatttattttcctagagtaagccagggcttttgttttcttccctttagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaaggtatatttctttttaatccaatttaaggggatgtttaggctctgtctaccatatcagtcatgattttaagttcattccaacattgaccatgtcatttctggtaatacatgcatcacaccatactgtcatcaaactcactaagtttcattttgtactagcttgttaagtatatgcttttaccagagcaattttaaccatgctactttatatattttatatgtatgtgtgtctctattagttgtatatttacaattgtctccattaaaaagagctagagaaagcaaatgggggaatatatttaccttacacccaaacagaattagaacaatctaaaatttaaattcaattaaaaatttcagttatttaaaatgaattattttaacactttgccagacactgtatccaaaagttaacactgcctttatgaagtcatgttagcaagttatttctttaaaatatttaaaatttgattcatgtgtgactaactctcttaacaagttaaaagatcttttgggcaaactgatgaattggtacaaagtgggaagacaaagaaactgggcacttactttttaggccttcttggggttttgtttgtttgtttgttgttttcgttttttgagtcggcaaagactagtgccaaaaagtggcgtgttttctcaggttttgagtagtgaggggaagaatcttccatgtttttcagacagggcaacgaaaagaataccttaaaaatgttttttttttttttggttgtgaaagacattcatgctcagtgtagaaaatttggaaaatacaggaaagcttaaagaagaaaatataaaccgtccataaaggaagcttcttttttttaaagttgtacaagg

SEQ ID NO: 111525 - DNA, 1111 bp, Homo sapiens
acaacttccttatgatcacaaatgggagtttcccagaaacaggctgagttttggtcagtatgaaacaggggctttccatgtcacctttttgggtacacataacagtgactttaaggaactccagtggcttcctttgttttgttccacctgaaacaatgagttttctgtgaaattgcgccccttttgataggtttgccatagagaacatcgtaggaaaatgtctctggacaacattgtttttaattcctttattgattttgaaactgcacaaatggtccttcaattccaccaccagcaccatcaccacttaccttgttgtcttccttcctacagggaaaaccctgggtgctggagctttcgggaaggttgttgaggcaactgcttatggcttaattaagtcagatgcggccatgactgtcgctgtaaagatgctcaagcgtaagttcctgtatggtactgcatgcgcttgacatcagtttgccagttgtgctttttgctaaaatgcatgtttccaattttagcgagtgcccatttgacagaacgggaagccctcatgtctgaactcaaagtcctgagttaccttggtaatcacatgaatattgtgaatctacttggagcctgcaccattggaggtaaagccgtgtccaagctgccttttattgtctgtcaggttatcaaaacatgacattttaatatgattttggcaatgctagattataaactgcttggaagatttttttacccagactgttgttctctcttgctagattttgttttcctcattgttcttaagaatgcagattttaattttatcattatggggtagaacagcccaggacataccctagttattgtcgtatttgtaacatcaacgacatcagcctcttgaatatctcatcccgaccagaaggcttctgttatcttgtaagctttatacatttcttgatcatatgtagccactgaaagggttaatattaatttgcatactacaatttaaaacaggcgcctaagcctactggttctcaaatatacaccaaatgaggcaaacatttcacttctctaaaaataagtttccaatttgaagccttagttgaagttcccatcaaggatg

SEQ ID NO: 111526 - DNA, 1777 bp, Homo sapiens
actcactttccagtcttgtcccagctggctgctccttgtggctgattttcccactatgccacagtttgtgccttcattatttccataataacgttacagagagtgtgtgaagccctgctgtaaacagaagtgaaccagaggattcacgtaggaagcttgataatagtagaatctttgaaagcagtaacttctctctgtaaaaccagcagtcatgcttggctccaaatactaatgtcacttagaaattcaggttaaaagaggcttgcttgttttatgttactccacataaggctgcttttttgataagcagtgttaatatatgggattgtattgggactaagtagtctgatccactgaagctgaatattaatggccatgaccacccttgggtatttttatgggaggcagaattaatctatatatctcaccttctttctaaccttttcttatgtgcttttagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctggtaagactgatttacataaatagttagctgttgacaggcagttcatggggtcataagggtttgcaatcaaggctgattctttaaaaaatgaactgaggtactctgaggtatgaaatcaaaattattaaatcatttaaatgtgattaacagtttagaaagttaaattgtgtttttaaagattcaaacctagatttttgctgattttttaaaaatgtattttcagttttcttctacactttagttccatgcaactgaatgcattctatatctgtttctcttacggttctgtcctgcatgtatttccatttatactattgagcttggtactacatgcatgtttccagtgagatactgtttatagggaaaatgctaaagcctctcaagttgccacagtaaagtccctttaaaacctttagcagaatgacaaagagctctgaacatatctccacatgtaggcttcttgccatcgacctctggattattcctgtataccttgcctcttgccctttttatttcatcatgctattaaaagacataactactccagcacattttttaaaaattctggacattattctcatctctttcatcattgatgccattctgaatttgaatcatgtataaagagctttgagtttgacttacaaccagaaaagaattcttctcatatcttgcctattctttctttggaaatgctcttaagggccaccatttgagaagacttcctagatgtacccagtccaacagaagtcatggttattttgcccagtcccctatactgtatattgctgcagttgtgtggtagatttctcctatccttttcatgcactttatatccactgcatcttgcaatggcaagacattgcctcctgaactcttaacaccaggtcctcaaggagacctcagtaaatattattgatgggcaattaccccttaaagccattttctgtacctctggctaaagtttaaaaccccaggtgaaactttttatttttttttaatcctataaacttgagtagtttaaagtggtagtagaaactgtacaaaaccactttttgttagtttctcctgggcatgtgctcattatatgaagaaatgagccattttgcttctttccgaaaccttggccctatatatatcctttaactttctgatataatggccta

SEQ ID NO: 111527 - DNA, 1072 bp, Homo sapiens
ttattggtgtttatctgaaccaacttgatttttttttaaaccttcctccatcagtcactatatgttaacgatctctgcctcctgcataacacgtcttggaagctcttctttgtctttctttcatcttgtctcctggggctcatttagagagtttgaggtaatacgggataccatatttggctctctgtctcccattaaattcattgtgtcaagagacgggaaatttctaacctgagtcctctatatgattatacacaaaaaggacacctagtttctgggcatggaccccaatatcgattattaaaaactcatttcttacagaacaggattttcaaactctttattcaaactttacatgactttcctcaaattggtccagtctattatgtagcaaaggggatgaggaggtagagcatgacccatgagtgcccttctacatgtcccacttgattcagtcatgacttgtttcatctctcccagcagcgatagtactaatgagtacatggacatgaaacctggagtttcttatgttgtcccaaccaaggccgacaaaaggagatctgtgagaataggtgagtacctacctatcaagcaaccaagagtaactttacagagagtatgtatatcatgctaatgtggaatataacatcattcccagtagcaatgatgcagaccagttctgctttatggtagcagtgccaatggtcaatggcagttagggttgcaagtgggtgtttggggtcagagcatatgtttttgtgcctgagtatctttctatagatatgggatctttgctttaattcgccatccctctcctctatggattttgtaacccagcctaggattgttaaatattaactttgtgattcagcatctacctttcctggacaccagggaagtgatctgcctgcaagttcacattagttcattcattaccagcctttggtatgtcattgccactgtcttttcctttcctgacctttatggttgtaattgctaagaaaaatcctctcttcctcacaggctcatacatagaaagagatgtgactcccgccatcatggaggatgacga

SEQ ID NO: 111528 - DNA, 1870 bp, Homo sapiens
taagaaaggatataagatggctgaaataaagaccttcttccgtgtgtccttgggagatgtcagattgaatttgcaaaggcatattaggaactctgtgaaaggacattcaaagagatgcatgcaaaatgaattttcagtttaaacaatatgatatgactatttcttatgtatttccctatgaatgaaagcagtcctgagaagaaaacagcatttattagaattgcttttaaaagagattataataattagactcttgattatgtgaacatcattcaaggcgtacttttgatttttatttttggtgtactgaatactttaaaacaaaagtattggattttttataatataagcaacactatagtattaaaaagttagttttcactctttacaagttaaaatgaatttaaatggttttcttttctcctccaacctaatagtgtattcacagagacttggcagccagaaatatcctccttactcatggtcggatcacaaagatttgtgattttggtctagccagagacatcaagaatgattctaattatgtggttaaaggaaacgtgagtacccattctctgcttgacagtcctgcaaaggatttttagtttcaactttcgataaaaattgtttcctgtgattttcataatgtaaatcctgtctagggatatcacacattttagcagtcaaattaagtatacttcagcaaaatttgcatggtatgctgaacattactacaactaacattcaataatagaagtcctaattctaattgtgtaattttggggcatgtgaaggaaacagaaatagccttaattttcattatagcctgagaatagcaatgaacttgattttgctcaagtgtaacaaatgtaggtcattgaaggtcacagcaggagaaattttggggggattggcatgccgtgtgaaaaatattaaaatctaagatcatattcagagttagccatatagaatgttggatcctagaatacacggagagctattaaataggttcataagtaataatgggtttgtagaacatagcaaatgtttttcaaagtgctgtatttccttgccaatttttattgaatcctcagaacaaacccttgtcctataattgcagcaccttcctattttaaaagttggagaaactaaggcatggcatattttagtgctttttatctgaggtgacacaggacaatagaggctgaaactagagcctgtgatttccagagtggcatcccatcgccatggaaaaccatattgccctttataatattctctgcctgtcttcctgggcccatttctgcagtccagatttattcctggaggtggatttttgtgccccttatgataatgtaatgttttccccccatcactgtggcgtctctattggtagcctgtactcgatttggttttgtaagagtgtttctgtgtttatctcctggccaaagcatgaatttctgaaaaggctgccctgaagctagatattatcatcaggagtgataataaaaacaacttctcttcatcctggtgcaattttggaaggaagaatgataagtcgttaattatccagtcctctgaatattgaccaaagggaggaggaagaaggtggccgcctccaggcccagtcttgatgaattctgcaatctgtctccattatttcatgcctgtgtaattttgtcaagagttgtccaatacctctgaatctttgtttttctccccttgggaataatagtgattcctgactcagaaagttatgagttaatatatgtaaagtgcttatgacagtgccagacatattgttactattctttatagatgtcttatttacgatctaaataatcgtgacggtggttacatactgtcttgt

SEQ ID NO: 111529 - DNA, 2438 bp, Homo sapiens
ataggaactttagcacaacatctaggaagggaagggatattggaagttttttgttttgtttttgtaagctgactaaaataactttaacaccaaaaaaaaaaaagaaaaaaaaaaaaagctttcccagttttcaatcctaaatggattaagagaaggattgatttagctttttatggcagattaagattgggaatccagaatgcatctaaaaggactagttacagaaagtttagctcaactttaatggagagagttctccaaagagtcaggatcacaagccactactgtttatcaagtacttgcctttcttctaggcaatttttcagatagcactgagtcaggcggtgctaagcatttttacccattttatcttatttaacccacaagacaattcataaaattaaaagtattcattttgttttacagaagaagatactgaggcttaattacaaatattttagtgactttcccagtgtattagagaaagttttgggttttgacagaaaacccaaaataaaagaagtctaggagtagactttataccaggattggtataaaggttccatggagtacccgggcaagtctttcctttccatgcttagccattcctgagtgtaacccccatgtccatggtccaagatgaccaccaggtggatagccagccatcatatccagaaggcagggggcccttgcactagagaagagagggcagagggcacgtgccagctatattgtaaggaggttttcctgaagctgctatacagcacttacaacttagtggccaaaaccgagtcacctaactacagctagctagctgcaaaggaggctgggaaatgtagtcctaattgtgagaggccgtgtttctgtttttaaggaaggagagggacatattcagtggaaactaacaaatctctgcattacctaaggcccatggtggagccagggctaaaatgtctggctgtctctgacgtttgtgctcttaatctccatgccgtactgacatagtgctcacatcttaaaatggggataatgcacttgtgagccatgtatttcagaggtgattgggatcatctgagttcatataggtaaaaggtttttgtgagatggtactcaagttatcactccacatttcagcaacagcagcatctataagaatatcttctgttcaattttgttgagcttctgaattaacattattgactctgttgtgcttctattacaggctcgactacctgtgaagtggatggcacctgaaagcattttcaactgtgtatacacgtttgaaagtgacgtctggtcctatgggatttttctttgggagctgttctctttaggtaaaatgatccttgccaaagacaacttcattagactcagagcatcttcttgaagtttcattggtgtcctgcttccttgtgattaacactgctttgcaaactgtgtctcaggaagcagcccctatcctggaatgccggtcgattctaagttctacaagatgatcaaggaaggcttccggatgctcagccctgaacacgcacctgctgaaatgtaagagccaaaaaatttttcctttaggtcacgttttcccttttatttttctttttagagacagaaacccagatgttgagggttttcataacacagtttgaaatgtcacttggattctttatgacacactggtcaaatgtcatttctgtagtttattttcataatctcttgtcaccaaaaatacagaaagtttcagtaatatttcatacatgcagtgttttatgttatctatatgtcagtccatatgtccagttgcatagccctggaattattactgaagttgctggatgcccatacatttgaaaacaagctgagggcattgaggagggatagtaaatggcccttgtcttgcaggtatgacataatgaagacttgctgggatgcagatcccctaaaaagaccaacattcaagcaaattgttcagctaattgagaagcagatttcagagagcaccaatcatgtgagtataccctggccaggcatagaatcccccttctcccagttccaggtgtgtcctcctcctcaggctttcagggtgaggactaacctcccaaccccttctctcctaatcttaggttgcaaattgggcttcaggtaggggaagtaaagcaatggaaactagttctttctgcccagccctcctgttctgagccaaagaaggatgtgagattgagggggaagggtggagagttttgtactcactggaagtagaagtttccataaggatttgccatgtttcctccctcatctcaaatgctggtcacggggtcagtattttctccctctcacatgtcagggccatgcatcctttggagggttggggtgatgtgaactagaataaaagcatagaaaagacagcttgttactgcagtgaaataagccttctgatcaaa

SEQ ID NO: 111530 - DNA, 3900 bp, Homo sapiens
tctttcctaatagcacaccactgataatttttgggttaaagcttgttcttctgggtgtcaaaacatgtttcaaattgaacagcattttccacccagttgctttgattcttgacaagagacccctggaagggccgtgggtttcccagcaaattacattggttattgggttgtagttgctggagagatttacaagccttttaaataggtaagatagtgcttggtgcctggtgtgcccttttagaagagctaagcttgtgcatgttttgtccccacttcttgtataaagttatttccttggaaaaatgaagggggaaaacaaagcttatatttgttttgtcagtatgacttgggttttggccacaaagttcttggaaaccacttctctcttaagagtttccatcagttagttgtgatcttgacactgtaagtatgccttttgttgctatgttcgttgtagggactgctgtattgactatgggcttgttttctccagatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaagtggagtcatttgattgttgagattcgttgagattaaactttaaagcattaaagtgcaatcatcctgacaaagttttgtacgcagttttcataaaatatgtgcagggctatcagatcacgctaggatttacatgcttcgagattcaacagatattaagaattttcatacgtgtgatattttctcattttagtcttacaacctgaggtctctatttaaattgaaaaatagatacagagaaggtgcttagtatgtatgagctgggtgctgtcatgtgggtgaaacattatgcatgcccaattggtaccgtccagaccactggaacccaaacagaggctgagagttcttcagcttgaaacaaaaggaagcaccctgaatcacataatcttattaagaatgaggcacccacacaccctcagtcatgactgtctttattgacgtgacatctacacctgcagaaatgtctcctgaaaggaaagggaaggggtgaaaagtgacctgtaatgaaaaggaatccttttaaaatccagagggaattgtgtggcaaggaatgcgtcaataatcagtgaaaaacagacccacatttcagtcaggcaattcccattattttattgcagacaggaatgaatgctaattgaccacaaaacaaagaagtcttttctttccaaatgttttcactgtcatttagcctttgtcatgtgtgagaaatttgcgttagaagcagttgacagtcccctgtgttaagagtctagctaattttcctcaccagcctagcttttcattggaaaggaataccaggtcttggtgcccaggctcaaacttggttcgaatctcagtgccacccctgtgtctaccacttaaccactgtgtgacattaggcagattagctcttgaaatctcagctcatgggagtagtgtctaccttgatgtattaatgtgaggctgtcaagaccagctcgttcatatgcctaataagtttttccacggccaattcaccttattaagcagggagggcggtgttcctgtactgacataacccatgtaaaattatacagtcaaaagcttgattctaattttctttctcttaggtgcaaacagtattgtacaagtgtgttgcacaac

SEQ ID NO: 111531 - DNA, 1611 bp, Homo sapiens
ctggtcttgaactcctgacctcagatgatccacccacctcggcctcccaaagcgccaggaccacaggcatgagccaccgtgtctggcctggcctaacatttttatgagacaaaatatcaatttcaaaacagcatcaaaaagtgagcagggcaagcacagtggctcacacctgcaatcccagcaccgtgggaggctgaggcatatttttctgtactaaaaatacgtaaaatacaaaaaatacaaaaaaaaaaattagctggccactcgggaggctgaggcaggacaatcgccagaacctgtgaggcagaggctgcagtgagccgagactgtgccactgcactccagcctgggcaacaacagcgaaacttcatctcaaaaaaaaaaaggggtgagcatatttaaccatcctcagctcataatagagcaaataggtcaacagaataataattcatgctcttgcatgtgtaatgaactggcagcaagagaaagctggttgaagaaaggcagaggaactgtgtcttatgagaattagaatcaaggggctccataatcatctggcattcattcaatgttgtatctatggttagaaatgtacatgacaggaactccaggaatcttagggattcttcttttaaggtcctggtcaactgtggccacaatataaaacttatgctgaattactctctgtactaagagtcatctgcttaggttcctttgtgtgtacatggtaatccttcaaatcttggatccttggtgatccttagagccactccatacttctgctccaatttctcaatttcaggcattacacaatcagttatacaaggaatacacttggtatacagacagtccatcattgactgcactaagtctggtttggcttttatggaaaagttgataaaggttggtatcaatgaggatgtggtaaggtgggcccagctgtgtattatattggaaaaataagcaggtagggtgttggggaatttctctttcctttaacacgctgggatccttcttttctttctttttaggttttaatttatccttttctgtaagcctctgatccctgagactaagcattcacttcatggtcgcatacttccttgttttcttttgcttccccatggtcacaccacactcctgtgcttgtataatattttcagaagggctgtagccttcacgaaactgccgaaggggtccatgatggagaaatggtgagaacccctgctctagactgtaaacatttcatgagtttatatttgtcttgtttgctaccatatccctagcttaacacctgactggtaataaggacctcggtcagtgtgttttgaatgaatgagaaaaagtggtttgaggtttaatttgtttgttgattaactggatgcctactctgagagtaactttggaagagatgcttaccttctctcattcatttatttaaccagtgtttatagatacctactgtgtgccaggaatcattctaggctccttagagcttatcttctaggaaggcagacagtaacatgtcaataaatattgtaaaaccagccagataatttcagatgactgtaagtgctttagaggaaatccagcagggttatttgatcatga

SEQ ID NO: 111532 - DNA, 1567 bp, Homo sapiens
gtcactcacgcccacttcagtcttgctcatgatcaaataaccctgctggatttcctctaaagcacttacagtcatctgaaattatctggctggttttacaatatttattgacatgttactgtctgccttcctagaagataagctctaaggagcctagaatgattcctggcacacagtaggtatctataaacactggttaaataaatgaatgagagaaggtaagcatctcttccaaagttactctcagagtaggcatccagttaatcaacaaacaaattaaacctcaaaccactttttctcattcattcaaaacacactgaccgaggtccttattaccagtcaggtgttaagctagggatatggtagcaaacaagacaaatataaactcatgaaatgtttacagtctagagcaggggttctcaccatttctccatcatggaccccttcggcagtttcgtgaaggctacagcccttctgaaaatattatacaagcacaggagtgtggtgtgaccatggggaagcaaaagaaaacaaggaagtatgcgaccatgaagtgaatgcttagtctcagggatcagaggcttacagaaaaggataaattaaaacctaaaaagaaagaaaagaaggatcccagcgtgttaaaggaaagagaaattccccaacaccctacctgcttatttttccaatataatacacagctgggcccaccttaccacatcctcattgataccaacctttatcaacttttccataaaagccaaaccagacttagtgcagtcaatgatggactgtctgtataccaagtgtattccttgtataactgattgtgtaatgcctgaaattgagaaattggagcagaagtatggagtggctctaaggatcaccaaggatccaagatttgaaggattaccatgtacacacaaaggaacctaagcagatgactcttagtacagagagtaattcagcataagttttatattgtggccacagttgaccaggaccttaaaagaagaatccctaagattcctggagttcctgtcatgtacatttctaaccatagatacaacattgaatgaatgccagatgattatggagccccttgattctaattctcataagacacagttcctctgcctttcttcaaccagctttctcttgctgccagttcattacacatgcaagagcatgaattattattctgttgacctatttgctctattatgagctgaggatggttaaatatgctcacccctttttttttttgagatgaagtttcgctgttgttgcccaggctggagtgcagtggcacagtctcggctcactgcagcctctgcctcacaggttctggcgattgtcctgcctcagcctcccgagtggccagctaatttttttttttgtattttttgtattttacgtatttttagtacagaaaaatatgcctcagcctcccacggtgctgggattgcaggtgtgagccactgtgcttgccctgctcactttttgatgctgttttgaaattgatattttgtctcataaaaatgttaggccaggccagacacggtggctc

SEQ ID NO: 111533 - DNA, 1026 bp, Homo sapiens
gccgggtgcggtggctcacgcctgtaatcccagcactttgggaggccgaggcgggtggatcatgaggttaggagatcgagaccatcctggctaacacggtgaaaccccgtctctactaaaaatacaaaaaattagctgggcgtggtggcgggcgcctatagttccagctactcggggggctgaggcaggagaatggcgtgaacccaggaggaagagtttgcaatgaaccaagatcgtgccactgcactccagcctgggcaacagagcgagactccgtctgaaaaaaaaaaaaaagaatagaaaatgtatagagggaaatcaggcaagcaaaacaaaatgtgggaatgaaaagcaacacaatgtgcctgtgaatgaaagacaccatgacacaagtagagcgcagcacggtgtagcttagcaacttacacaaaacccacttgagtgatatgcttgactttaggcttgatataaattggtacgtgtaacataaggctggaaaagcaagttcaggcacgcctaggttgcatgaaagcacaatagtatgattttaacttcacagtcagcagggctgtcacttactgtgtgacattgaataagtaacttaacctctctgagtcttgggtttctcatctgccacacaaagataaccacataagcttcataagattgttatgaagatgaactaaataatcttaacttttgccatgctctacctggcaccccttacccgcacaactagactgttctctacctcgttaccagagggatattttttcacttaaataataatgaaatatatgaccaatgctttcttttgcctccattttttttttttttttttttttttttgatgcaaagtcttgctcagtcttcgaggctggagtgcagtggtgcaatcttggctcactacaacctctgcctcctgggtttaagctattctcctatctcagcctcccaagtagctaggattacaggcgtgtgccagcatgcctggctaatttttgtatttttagtagaaacagggtt

SEQ ID NO: 111534 - DNA, 1053 bp, Homo sapiens
ggctcagaccataacctggggtcagttgtgggaagtgtgtcttaaggaagaccctgtggtataaccaaagatcagtagccacaggtggcgattggccttgatgcatgaacttctgtgaaaagtaggctcttgaagcctggagaagatcccaattgggaatcacaggatggctctcttcaaatagtttaagagatgttgtgtggaattaaaattcttgttctgtgtggccagagatggcaaatccagtgatagaattttatttatttatttatttgttaagacacagggtcttgctctattgcccaggctggagttgcagaggcagaatcatagctcactataacctcaaactcctggcctcaagggatcctctcaccttggcctcccaaagccctgggattacaggcatgcatcaccatgcctggccagtgatagaatttgctaacagtaattggcagagtggagtgggttgccatggaatgatcaggttggatcagagtttatcagactgagtttgtaggcatgatctcaggggctgtgcattctcttacaagcacattctggatcatctggaggagcccctgcgattatgtttaatcctcttttggctctaggttgtcttttattgtcacagactaatgagaaaaagaaaagaaggagtgggatttaatatatgcacgatgcattgaagaccagggaaagccagatgaccgccaggcactcaatagagtcagaaaggtttcagactgaatagaaaaaaatagaaaagtatacataaacagacctcaaaagaacctatgaggggctggacatggtggctcacacctgtaatctcagcactttgggaagccaaggtgggagggatctcttgagcccaggagtttgagaccagcctgggcagcatagggagatcacatctctataaaaagtttaagaattagccaggcatggtggactactacaagcctgtggtcccagctacttggaaagctgcggtgcgaggatcacttgagcctgggaggtcaatgttgcagtgagtggtgatcacaacac

SEQ ID NO: 111535 - DNA, 1108 bp, Homo sapiens
ttcctttttcctttcctttctcccttcctttcctttttcctttttctttgttgagacagggtctcgctctgtcgcccaggctggagtgcagtggccccgtcttggctcactgcaacctctaattgatcctcccacctcagcctcctgagtggctgggactgcatgcgtgtgctgacacgcccggctaatttttgtttattttttttttttttgagagaggaggtctcactatgttgccgagtctagtctcaaactcctgggctcaagcgcttctccggccttggcctcccaagtgctggtgagctctcacaccggtgcattgttttcgtgtttcatgttttcgttacatgttactttcttaggcttttccaattttctgttgtttttctgtgtaagaccgtaggatagaactttctgagagactgatcttggtttcactaagcaagaacatttgtaagaatcagtgctgtcccagatgtagtaatcgctattgagaaataatgaagttccccttactggaagtactcaggaagaagttgaataactaactgcctatgaggagattctgatatgggagggaatctgggagataaagttactgggaagtgaagattctgggagccgatttaatcctcacaacagcacgttaaacaggtagaggaggtttgtaaggaatagtggtttaatatcacagagctagaagctagtttcagcagaaccagaattagaatctggacttctgtgccttactaagttttattagcattcattgtgtcttactcttttgacttatttaattcactaatggattttaatggtttattggattgtatgctggtgcagttctttgatcttgagcctagctttctctttctccttttttgggaactttattgtgtatgttgtggcatgtttacacacacatcttgctgccttgggttcttgcaagttgtgtgcgtgttttatctgcccctactagcttttaggtgtcttgagagcatgactctggcttactcatctgtctattccagaagaccttgtctgttcttggcatttattaactaattttctaagactgggttgaagtagttgcatgtcaagtttatat

SEQ ID NO: 111536 - DNA, 1144 bp, Homo sapiens
gagtatgtgcttttctctataattaggctaaaaaaaggttggtaagtaatatgaacttaaaatcaagattaacccccaatttacaaacccatgataaaaagtgttgttgattacttggatcctatcttttctgcagtttatgtttctagtgacttactcaatagttttttcttactctttccctggacagaatatgtaatataagaaacataagtcctttgagttgagggagatcagatagatttaataaaagtcatttagactttattgcatattctggaagtccaaagaagaatgactctggttgcatagcacttctaataaagccacaaaatcattacctgactcagtgcctgttcttgttatcatatttttactttatgttttggtatttcatttatttattacgtttcagctgtgagagtaccttctacaaaacattttaaacttttttctattttcattaagttgcagtcccactccacccagtccagcctcctaattctagcctttatacagctaagattgaggcaatcagttataaggacgcctgctcataattaccttctcagaaggtaattatattaatactgaatttatttagtggtatgctgtcatcaaaaaaattcattaaaaataaaatcaatgaaggccgggcgcagtggctcacgcttgtaatccctccactttgggaggccgaggtgggtggatcacctgaggtcaagagttctagaccagcctggccaacatgatgaaaccccatctctactgaaaatacaaaaaattagctgggcgtggtggcacacacctgtaatcccagctactcaggaggctgaggcaggagaatcgcttgagcccgggaggtggaggttgcagtgaaccaagatcgtgccactgccctccagcctgggcaacaagagcaaaactctgtctccaaaaaaaaaaaagaaactaaacacatttaataaatttcaagtgcataaatacattacaaaacaacattcataaaaataaacattcattaaaacaaaaaataattttattacaaaatattacatataaattctaatataaattaacaagtaacaataaagtatttaaaaatagtgaaaccattcacaaaaatacgtaatgaaaattaaaa

SEQ ID NO: 111537 - DNA, 1036 bp, Homo sapiens
tcagtttttttcttggtagcaagctgtagattttgtttcaaggaaagcatcttcatcttctctagtttcatcatgtatagatggagattccgatgcaggtatctgtatcaatttcaatacagtcacatttgtgtttatttgaactctagaactagaaaaggaattacttttttctttgattttctttttcttccttctcttgaggatcatgaaagtataaaagaatactttctaaatgagggtgcctttttctttttcttttttttttttttacaatttttacatttggaattaaaattttaactagaaaagagtttttattaagcaagtttttttaaaaaaatcttaagttgttaatcctgctctcaagatgtaagtaaggtgtgtttcagacattattaaaatactgaaatagtggtatttgtaccaaaacactagtatctcattacttaccatgatatataacactgtataactgaatagtggaataccaaaattgaaattgcacactgcatctaatcctgtatgcatccaagtatattcttctgtgcctgtactgtctgcctttttcatgttttggacaaaactgtcatcctttgtgtacctcctctctgtgtccacgttcctattctcctccctcagtgcctttattctctcccttcccattgcttcctttgtatctgcttacacatgttcatatgtttctcttattttggaaaagaaagaaaaaggtcattcatttaatcttaacttgactattagtttcgttttctttccttccttccttccttccttctttctttcctttttttttttttttttgacagtgtcttgctctgttgcccagcctggagtgcagtgggcacaatcttggcacactgcaacctcagccttccgagtggctaggactacaggtgtgcgccaccacgcctggctattttttttttttgtacttttagtagagatggggtttcatcatgtttgccaggcagctcttgaattcctgacctcagatctgtccacctcggcctcccaa

SEQ ID NO: 111538 - DNA, 1680 bp, Homo sapiens
gcccaggctggagtgcagtgatgtcatctctgctcactgcaacttgtacctcctgggctcaagcgatcctctcacctcacagcctcccaaatagctggaaactacaggtgtgtgccaccacacccagctacttttgtattttttgtagagacagggtctcactttgttgcccaggctggtcttgaactcctgggctcaagggctccacccatctcccaaagtgctgggattacaggcatgagccactgagcccagccgacatttagttattttgtctctttattacaaatgatagcattacatttatacatatttgtaatccgaaaaggtcaattccttgagtgtttctgtcttgaacttttttctgtaataggcctcccatactcattgcccacagtttgcattcagttttattgtagtgggtcaggatcattaagagctggagttgctgggataggcctttctcaagaggttctacttgagttggaccttgaggaatctggatgaagagggggataacgaaaaggaggtgggaagggaaaaaggactgtgtggctgaaggcttgtggttagcaaaagcctgtcatgctttcgagctgcactgcccagcactgtaaccatgagccatgagtatgtgtggctgtgagcacttgatatgtggctaatccagagttgaggtgtgcggtgagtaaatacctaccagggtctgaagatttaatatgaaaaaaagaatgttaaaatatctcagtagttttaaaaatattgcttataatttaaatagtagcattttggatatattgggttaagtaaaatgttattaaaatttttacctggttttacttttaaatatatggctaccagaaaatgtaaaattgtattatgtggcctacctttgtggctgcatgattttttgttagactctgctctggctcatccttcaggatggagaagcaggttcatttggggaacctggtatgtgcttcagtgagaactgttggatagttaccagaatcaagtatttggtatgaaaagaccattacgtttcttaaaacagtgaagtaacatgaaattagtttcaggaagattcaactgttcatattttgtggcactacaaaaactaattgagcacttactgtgtactgagcactgtcctaaagggctttattcatttaatcctcacagcaaccctttgagacataggtagcccttatgttacagatgaacttgagtcacaggggggtgtacctattggcccaaggtcacgccgtaactgataatgccttggctatgaactggcagtctgattccagagcctatacacttaaccactacactgtgtccctgtgaaggtgaattagacaaagaagatgatccttgcacatagcagtgaaggaatggtaatggatcactttttaatcctgttaatattttaattaaaaaagatcttctatcttcacggtaccccgatacttttcgttttaagttcttgtcaccatgattggttgtatgattttggccacccaggaccagcttagtatgtaacaagctttatgtttatttttcttgtgttttgtgtgtaggaaggttttaagaatatgtagcatcgcttaatgatggggatgtgttctgagaaactcattatcaggcaatttcattgtgcagacgtcctagagtgtactc

SEQ ID NO: 111539 - DNA, 1089 bp, Homo sapiens
ggagaattatatgtaaatctgcattatacatgtttagtatcctcaatctaaaatccacagtgctccaaaatctgaaacttgagcactgacatacatgaaatgctcaatggaacattttggatttctggattaggggtactcagctatgatataaatattccaaaatctaaaaaaatccaaaattccaactacttctggtcccatacatttcaggtaagggatactcaaattgtagcaaccatcgtcagaggttaccgtcgttactgatggctttcagagtgattagacagtaaataagtgtaatgaccatgacaagaaaattttcaaaaaaactaaatcttatttacgtgcaaaataaaataattttgaataatgattttaagaagtaactgattttttttttccagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcaggtgagtgtgcttttccctctcatgagttcgctgaattaaagggaaagcgtgttgtgtgacatggagtcactgagtcattaacctagtcttatgggaatttggcttacaccttatttgtggtcttccaaccttttccttgtgtatcctttccttgtgtatcctctaaaataattttgtaccccctctcgcatagttgtctgaaatttttcatcttcaatttaaggaattgcaaagatctaatttctgttatattgtgtaaagtaagacagttagggctgggcacagtcactcacgcctgtaatcccagcactttgggaggccgaagtggacagatcacgaggtcaggagttccgagatcagcctgaccaatgtggtgaaaccgcatctctactgaaaatacaaaaattagctgggcatggtaatgtgcacctgtaatcccagcaactcaggaggctg

SEQ ID NO: 111540 - DNA, 1113 bp, Homo sapiens
gggaggtttgggggtcacataaatgtagtttttttggagcatatttcatagaatttaaacacttagaaaagtcaagtgatttgtgtgctattttgatttgcttcctgtgcttactttcatttgtttattatttattttagtttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggtgagtgatatttgagaggagactgtttaaaatgaaacgtaattattattactttgttccagaaaacactggacacactgaagtgggccacagcattccttcatatgcaagactgttttacatctgataattcagctgctctctaaaattggccttctcccagttcctgctacctgcaggtgaaattcttgtaaccaagctcagttgggctctttttactcatccttttccctttggttttgccaaaatgatgccgtggtacttgtcatcttagcttggttttcttatcatagaactttcttttttatagttgttgagaatataaatcagtataatattattgaaggccattttggtgtttaatacctaaagccttaaaaatgtgtagctagccgggcttggtggtatgcacctgtagtcccagctactcaggagggttgaggtgggaggattgcttgagcctgggaggttgaggctccagtgagctgtgttcgcgccactgcactccagccttggtgacagggagacccagtctgaaaaaaaaaaaaaagtgtatagcttttcgttcatgtgttacactaaagaaattgactgttgcacagactacttataattattgtaacttagtaaaaatttagaaacagcctaataatccagcagaaaattggttcagctgtttacaaatctctgtgtagctcttagaatattcactcttcaacatcatttcagtgacatggaaaaattttaaaaggaggtttacttttaaaatataaaaagaaggccgggtgcc

SEQ ID NO: 111541 - DNA, 2429 bp, Homo sapiens
ctggcactgaggcagggtttctgttcccaggaagcagaggcatactattctgtgaaggattgactgagtttctcctaataccaagcagtatctgagggaacagatgtctagcttaaaatcctccctagcacttgtcatagcagtgctacgtattgcctgtgaaggaagtttaataactgctgaaaggttcgattagctttatttcatcaggatttgtttgactttacaaattgatttgggttatttcaacttttaggtctagtcttaagtataactggtacatattccttcaagcagccattacacctctcataaatttattatacacctgcatttttataactattatgctttttaattgttggccaccatttttagtgcttctgaattgttatggttctcaagcagcagttgtcaccttggttttgaattaatgctgtgacgcttgcttccaggacccctatggtgtagccgtgggtggaactgtggggcactgcctgtgcacgggattggcagtaattggaggaagaatgatagcacagaaaatctctgtcagaactggtaagtcttgaaaattacaaatcagataacattttagaatcactgagagattaaagggtgttagctttgattatttaaatttctgctgctgaagtatacttggtttttctaattacctaccatctcttatagaggtattaatcctggtattgcaaatacggacttttttcacctgtgtagaagttagcaaaatacaaagtcatttttatcgaattcatagtagcttcttgttaacatattatcttagtaaaacaattgtcatttggaagtatgagaagtttttggctctaaaaatgtgtcttacaagactggaatcatgtggagaccatatgtactgattctgctgaatatgtcctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgaccagtgcttgtttttccttgtgtgtcatataaaattatcagtattgataggccaatttctaaagctgatgtaaaaacactaacatattaaatatttgagatatgcctaaagtagctaaacaggagccaggcattgttcgaaagcattgtcacccttacagttctgtgaggtagtaggtactaatataaggttaaaaaagaaaaaaactaactcacccaaggttacatggtagagtcacaccaggcggtttaattccagagcctaatgtcattcattatgctaagactacctcattttttcatggcaacttcagtcgtcaccctcgtttgagtatattttgat

SEQ ID NO: 111542 - DNA, 1048 bp, Homo sapiens
ggaatgtagtgttatgacatagggggaaaaaactatgcaaaacagtcacatggaaagaaagtattttaatttttaaaatccaagtttgcttaatttcttgtgaactgttcaacactgttttaaatatcctgaataactgtgccaacaaaattcatccccagtgtttccacaggagacattaaaattaaagaccaaattatactatttttttcctttaaccaaagtattctttttctcagtcctttttgtgcaaaaatattacaagagcaattcaaatggaaatgctgaaatgacatgccaacatttcagggcacatttaaaacactcagaataattcttgaaattattatattctaaaatgttactagcaatcacttttagattagttctgtacatctactcacacggatgcaattttcctagacctctgaaaaataaacaggctcattggtctcttttggtgtccacacaataggcaagataggtttacaatagtgtttaaatcaaactaggcatctacaatctcttgactccaccacattcaaaacaaaaatcaaagttcatttggctatcttgaaatcactcccataaaccaactacggttcactggacctaaacatttctcagaaatgtgtcattttatataatttcacctaagtaagtgatgatttggggatcctttagaaatggttaacgcctaagaataaactttatcaaaatgagtaattgcaataaagtgcttgttacatttcaaaatgatgcttttagactgtggtatgttgttttaaaagtgtgtgctattccttccgtaaaggatccccaggcatgagagttgggtcttctcacctgtctcataaagcagcagcactatcttttggtaggctgacaataggcacattacccatgcggatgaggctatactagtgctatggcaaaaggggaagtaaattagaaaagtgggaggcatgtagagggttcctattatagttatatacaaatatattaaatatactataaaaatagtcgattctattcctttgcaattact

SEQ ID NO: 111543 - DNA, 1085 bp, Homo sapiens
atagccaaagctgttagttaaaatcccaaatctatagcatttaaagataccaaatagaaacaccttccagctttaaaaaaaaaaaaaaaaaagtcttccctctgctttattctcactttcttaaaaacacttattctgggtggtactttttaggtaagaaactactgagtttcaggaaaaatgctagctactctgcagttaccgtgctttggacttgcagttatcatagttttgggagagtcagtattgtttaacaaatgcaagtgagaactagaagggttaataaagttgctccttagagtggtgtcaaaccagaaccgagacacttaaaaagtacttcattttttgaatggaaaatattggagaaaagtatgggagatgcaggtagcatgtgagtaaatactacggtctagccttcgagcatcccaaattccgggggtaacttgacagtgctgtgctctcctttgtcatttatatctggcttaggaatggaatagtaataacaagatgccagtgatttggaatagtttgttatagaacattcagtgcaaaatagtgaaaatgtttggtcttcagaagtgctgtagttgttggtcattgccttaaagcagtctgcttgacgctaggagcactgaagcagtccagctccatcaagagcactgttgaagggagaagaacccttgttcaggaagccttagaaagggatccttaaaatagtactctacgcagacaagtgaaaattcttttaaactggatattactcaacatgttttcagatgtttccactacattgaggcaaactttttaaaagtggaatgcaaatagcattttactttagtatttctgcttttttctttctgtttctttggtaattgaaagtttgttgatgaatatttgtgtaaaacgcattcaagtctataacctttccaattacctgtggcccttagtcccacaggagtccctgttggaagggggtaaacactggatattaatgttgctgagtgagtctttctagccaggacaagctgattggaatttttgaatggtagagaagaaacagcacaaaggcacttgccattttaagt

SEQ ID NO: 111544 - DNA, 1172 bp, Homo sapiens
ccggtttccgtagcagttttgaaaccttagtacctttttaacagcatgtgggtgtcagtgtcattattagtctcctaataagttcctctgaagactgctatcagtctcttggactggaggtacaaataatttagaaataaaagatgataacctaacactatcatagttattaatgtgatcctaaaattgtttcctaaatcagcatttttctttagtcatttaagaatttaccagaaatatttgctcaatatgatcttgatattcctacaaagaaaaaagaaggggtagggatttggctatgccttcactacaacattagaatattgtaactcacatgccttctaaacgtgaactaagatttcctttggcaatatcatattctaaaagtaataaattccaatacaagttacatacatttaaaaaacattttacagattttatggtactaatgaaatttacagtgatagaacaaaagaggattagtagaaaatacattattagaatataaaaaatgttattactgaggaaagggaggagaggacaagtgtaataaatcaaaattgacctcaaaagaaaatgtgtaacagagttgaggttgttaaaacagaaaaggttctgaataatgaagattaacctaatgcagaattgctaggtaaagaggtcaggggaatgctaagccagttcttaagacttctctgtcctctgctttgctgttatccttaaggcatatactttgtctttctgcagaaaattctacctggctacaattactttgaacattaatgttgaaaaagaaaacaaccaaagaaaattggtacttacccttctacaaaagaagtgtgactagatatcaatcagtaattaacatatcaaggagctcttctagctaaatgaccatccagtagagatttcccacattcccatgaatatcaagaatagttgtcagaatatgtatgtacctgagcatatgtacacagacaagggggatgttgtggaatatggcaatagcattgttcttctcccctttcaaattgcctttcttgaccttatgccattccatatatatctgagttgtgcctcatttatttattggcaatacctagtgatacggatttagctaacaaaagatatgaagaactattatattgaggcctgtcctctacataccacac

SEQ ID NO: 111545 - DNA, 1849 bp, Homo sapiens
cttcatatttatgatgcttttaaataatattaatatttaatctttattaagaacccaatgtggtaggcactgttattcctattttctaaagaaagaaactgaggcccagagaagtaaacagcttgaccaagtcacacatgtggtaagtagggcagcccaagtttgaaccattcagtctacctcagggcccaccacgctcctggccacttaactgtgccgctctaaccagctgagcgaacctgtgtgcagaaggcattgtctgtctggcctcagagtatttgtttttcatatagtcataactatgctcaaattttgtaatttaaaatatgggtctttaggacataaagtgaaagaacgtgtgtgatttggctcaagatatagattgctttctataccataaaatctgtagctcagattcctttaaaaaatgaaactctctcatactttcagaaagagggaaggcctcataagcattttccaaattagaatttttaaaccagagagtgaaagtgatatgcattatgtagaattttaaggattttgtccctatggacaggggagagtgtgagtaactattatgtgggtgccataaagggagtaaagcaatgctgcataatccatttgttttttagacttctaggttgctccatgggaatccctcaactcaactcattctctctgctgcatttcctctacaacagagcaccttccctcagtcacatcaccagcaacatcagtctcagcaacagcagcaactcagccggcacaggactgacagcttgcccgacccttccaaggttcaaccacagtagcacacgtgcttcctctcttgacatcaagggaggaaggggatggcccattaagagttactcagatgacctgaggaaaggagggaaagttccagcagtttcatgagatgcagtattgagtgttctagttcctggaattagttggcagagaaaatgctgcctagtgctacagatgtacattaaataccagccagcaggaggtgatcataggggcatagccagttctgacagtgttttaggtgcctggatattttttgatggaaaaagaatatattgccaaatattaagaagctcagctatgaaatgacctccagggaatcagaaaggcactaatgatgttagtaacttttagtggttctgtgcctcttatcaagtgttacagaggacataccactgccatgtcaggggtttgcttacagtgatgccatgaagacagtccagtagacttggtagcgaccccctcccccaacccctctcccttttcagataatgatggaacagtaattactttcagaatgttgtgtgggttcaaattctctatgtacagatgatgtaaaaatatgtatatgtctagataaaaggagagaaagcaaaacattttgtatgctgcatgaaagcgttatctcttccttacaggtgtgagcacctttcctgaaattctgacaccatgtgcaaactgatccatcctgtttttccttttgtttacaacacagtagtgttctgttcacttttccggggcacaagtttttttgttcatactttggctgtgatgtcacagtttgttcagtgaggtatgatgtgctgctgggaatggattttttttttcaggttaaattattgatacaacaggattttcaagttattcagaaatatccctcatttcattatttttcaattatgtttgaaaataggatttgcactgctttattttaggtggctgggagttttgattgcatattttgttatagttcatagttggaaatatttgcgtaaatggttttcaacaagcctgaaagtaatttcaagaatgtttcagttat

SEQ ID NO: 111546 - DNA, 1108 bp, Homo sapiens
agttcccttcctcatcaccttaactagctatagatcccttggctaattactgaaaactcacttttttcttatctgggaaataaaaggaggccctcacatacattttcttttaataaatgactatttgagataatatattttgagcatttaacaaacttaaaaaaggtaagctaccctaaccactgttactacatggaaattctctagcatctatattgaaaagacaaaagcttcacagtgacacagagcctgtcataaaccttttctaacagtgtgctgcagaatttgtattctataatattttgtagcatatttttggacaagaaaaaaaatttgttgttaccctttaattatgaagtctttaaacaatgaatacattcagtgtttttatttcaaatttaagaacattggctgcagtgagcatctcattaaaatcacattaaaaaatttgattaagaaatcaaattattgttttctaatcaatcggtttacaattttaaaaataacaaatgaaatatgacaactaccttatctgcctgtcctgagtgaatgtagttactgcagcactctgggtgctgttttgtggcatactagatggaatctggaccatgcttccggctgcaggctgagaaatcaccatagtgttatacagtggggctgtaagagtgctctgtgtctgactgggtagagatgtttgctgactgtgcccactcagtacattttgttgactctgttaaaaataaagagattttatagacagattaactgaaaataattatttgggaagtatgctagaattcatcattctaacaatatgacaatatgacagagaaagaagtggcaggatatattactctgggggaaatataaccacaaaggaatgactcgtggtaactgagaatgaattagtcttgaatatcttgctggaaggcaagctatgactttagaaaggagtgtgattgtaatagagatgatataaaatatactcaaagaatttctgttaaatgcccaaagtgaatgactaattagtgggcatttttctatttttcatttaaatccttgggatttacagtcacagatctacagtaattaccaacattttctggaa

SEQ ID NO: 111547 - DNA, 1040 bp, Homo sapiens
ctttgcctcttaggtctgtggttttacttcctgttatcctaccttctgtgtttgttactattttcttttgtacttgatagaaatcctttaagtgctatattgctatcaatataatgcttgtccaaaggtacaaataactttagttataataaaataacatttgtatgacataaatgtaactttttaatttttttttgagacgacgcctcaccctgtcacccaggctggagtgcagtggcgcaatctcggcttactgcaacctctgcttcctgagctcaggcgatcccgcctcagtctcccgagtagctgggactacaggcacatgccaccacacccggctagtttttatatttttagtagagacagggttttgccatgttgcccaggctggtctcaaactcctggactcaagcattctgcccacctcggcctcccaaagtcctgggattacagctgtgagccaccatgcccggccataattataacattttgactaatatttaaaaaaaaacaaaaaaaaaaacttgagggagttgaggtactaaatttttaatattttctcaaccacgtttaacatatgatatggtctggttattgttaatttctgaaatcaaagttgtgtgccctgaaatgtaatttagtatcccaaatacaaactattgaagatagagttaaaaagctttggatggggaggacatttctcacttttacatacagttcactgtaagaggctactttaagacagatttccttccaataaagtgaaactctttctgctcttatactgtatcatatactgaaaattcatgggaataattaaagagcctgtatagacttaagagatgaatcaccaaatgtgggtaaattataagcagaagaaaataggagctgctcatgactcaagtaaaacagagaaataagattgaaaatataattttattttcattcatgtatgcgtttattcattcatacttgcctagtctttaaaagcccatgttctatacttatctgaggatagtttccattgaagataaaagtga

SEQ ID NO: 111548 - DNA, 1680 bp, Homo sapiens
tgtttaatatctgttaaaacgcttcagaacttaaaatccacagcacatgttttggcagttactgcactcagttacttcagactcagttactttgattttggttagttaaggtttaaaattaaatgcttcaaagattctgtgcctgccagagtagttaggagaaaaaactcaggggtgattatttattgttattaccctctgtatatctaggcaggaggaagtcagcagtgtgaattcttaagtattaattgtgtatggaaagattgtaagatcagcagtgactagctgtgaattgggcactgtagatctgataattgcttgggaccttaaactagctctaaagaataacattttcatattgacatatatgttatcaaaaggccagaaaaataatagtatgtgtaaacttaaatgtaaatgatagcttttggttaaaaaacaatctttatataatatgaattaaagaaaaaatatttctctattttccttttagtaatgcaatatgggaaaggcaaatcatgttattataggttcctgactaaggggcaacagtggatttggcttcagactcattattatatcacttaccatcagtggaattcaaggccagagtttattgtttgtactcacactgtagtaaggtaataattcttttagagaatttctgaattactgtaacatcctatgatgattttggcattgtaacttttatgcgtaagttgttaaagagctacaaagtgctcttttctcaattgctgatagatcctttcaatatattattaaatttacttataggcattatatataaatataggaatgatatagatatataagtcttgatataaattttgtgctttacagcagaagttgttactgtcatttatgtagtaatgtcagtcatgtaaaaggaaaactgtaggtagataagcatacacttcctttatttatttttcttaatttaagtattgtgtggttatggatcgtttacagcagtgtatgaaactttaagatacctagaaaaatgcaagttaaattaagacattataggtatattttaggtttgtgtagcacatagcaaatagtctagatgaacagatgagacacgtaacaacactgaatagttacagctgtgcagtattttaaacgaatgaccagacactaaaatttgattattttttccatttgtagttatgcagaagttagggctgaaagacgacgagaacttggcattgaagagtctcttcctgagacagctgctgacaaagtatgtttcttataattaaaaaaaattatttttaatttctccccaataaaagatgaaactcaataattaataggaaaactatttttcaaaaatactttatttcctcacttataacggggatgtgattatactttactacttatttttaatttaatattttagagtctcacctgcctctaaaaagaaaattggatgagagatgtgtctgatctcaaaactaccatttattcccagtgatgtactagtctctggctaggttatttatatgaattatgaaatataatttacacatcagatatttttatcgggtaggtaatatccccactttgaaaatactgaaattggggtttcaagaggggaaaaaaaaatcttccctaaagacactggctgggaaattatagtcagaattggaactc

SEQ ID NO: 111549 - DNA, 1973 bp, Homo sapiens
atagatttttactgattaggttagatgataaagccatctatgatgataataaccgaagaatataagcttgaagtagtgagcaaagaaaggtgttactagtccttgagtgcggaaataataccatgaaagtaattacaagtctaagagtaatagacaagactgaatcagagtggcagaatgtggaggcataatgaatacatatttcggttacctagatgcaaggtaatttgcaactgcactaaattggcaggcttccttggtgaaataagtagcaggtcttcatgacagattaggtttgggacttgtgatgggaagagaagagaccaaattgttaacggtttctaacttgggaaataagcatacatagacgaagggagcttgaaagaaagataaattcactttcaagtattttgaatttaagttactaatgggacaatcaagttcgaatgtcctgaaagcaaatgataggtaactttgtctcacgtaaaatgctagagttggagagagagatttaggatcagaagaacctttgtgaaaacccctagtatgaaaatggattagcagaagagataggaatagtcagtaaggtgggaaggtaagtttatgctgtgggaatgacaaaggatgacttttaagaagtggaaatgaaaaatcattgaagttaacgatacaaatgttagtaatcttgagaagaataattgctgtagaggtgtaagtcacagtgtgtgaagttaagggaaatgaatatatggaagatggagcccataatgaaaaggaaggagatctataataccaaataattagtgaaactcctttatttcagatggaagacgtgagcaaatttaaaagtagatagtaaggacccttggccaggtgcagtggctctcgcctataatccctccactttgaggcaggaggattgcttgagcctagaagcttgcaaccagcctgggcaacatagtgagaccccatttctataaaaaattaaaaattagccaggcatggtggctcacacctgtagtcttgcgtacttgggaggctgaggcagggggctcacttgagcccaggagttcaatgccacagtgagcagtgatcatgccactgcactccagcctgggtgacaaatcaagaccctgtctcaaaaaaaagaagaaagtaaggacccaaaggtgtagatgctaaaggaataaggaacagtgatgtggcccgggtcctagagaaaataggaaagactataaatggtagagatggaaggattagctttagaatgtgaagcaaaactttcctttgaaagtgagtaaagaatgaaaaggatgagtagctaaaaatagggaaacattaagttgtttgcaccagaaaatctattttttctattaaagacaaagtgagatcctctcctgaaggtgctctacttttatgaactaaatgtcattgacgacttctgttggggaaaataatggttgtaaacttacacaacttttatgatcttactttatgtggtatatcaatcattgttttatatcagaaatatgtgatttttaaaatctcttttatttcagcaaaaaatcagttagaattctgttgtcacatgctgcgaggaacaatagacccaaaggagccatctacctatgaatatgtaaaatttataggaaatttcaaatctttaaacagtggtgagttaaaatgcttctctcacaatgtgttttaacttgttatttttctgtgctcttaaagacatagatgtttgaatatcagtgacaattaggttttgctggcataactgatgatacatatttccctattgttttagtatcctcttcagcacacaatggttttgaaggaactatacaacgcacacataggccatcttatgaagatagagtttgttttgtagctactgtcaggttagctacacctcagttcatcaaggtatgtttttaattttatttcccaaaggggatttcagttcatat

SEQ ID NO: 111550 - DNA, 1073 bp, Homo sapiens
agttttcagtttttaatatgtaatgatgttattgaagatggagctcatggtataaatattctaaagttacttataaactactcttataatgcctctctctgggtgcagtggctcacacctttaatgctaatgctttcagaggctgtggtgggaggattgcttgaggccaggaattcaagaccagcctgggcagcacagtgaagcatcctgtctctacaaaaaaattaaaaaaatagcttatctctataacagggtaaagtaattctgcttgtaagtgtctctttcaagagatactgaaaagtggtatttctctccctctgattactctgatacttcataccttataaagagaatcaatggattttagcacttaaaagtccaggctctcaagggggcattttttaaagttgaaagccatgcagtacataatttgctaatttctttggttcatacagaaaataactttgactttactgctcttctggggctttattttctagtaagctcaaatagtaggataagcccaacatttaaaaacatgtttgagagtaaaacatgagatattagcaatgcataagtaaactagcataggcagaaaaaaggacagactgattaactgagttttctggacaacttaaaaaaatttgttttcatagcaagaaaacccagggaaagaatcccattataggattaagataatgtctaagtaatttaaaataagtataattgtatgcttttaaaccatatataactgtattaggttttgtcatgtttacagaaactatataatctagtcatagagcatcatttgcaatgtgttcacactttctcaaagcctgcttcttggcacttgcttgaattccattcaaaattcgatgcccttcatctctgttctactgttaccttgtatgtactactgtcatgatacagagaattataattttctgtttatttggatagttatggtagttgtagcttcttaaaggcaggaactttatctctgcatccagaggagctagctagttccttggagcgtcactcagtgattatttgttgaatgtatgaaaatgagt

SEQ ID NO: 111551 - DNA, 1082 bp, Homo sapiens
tataccgcatcttcttctgcatctgtacagcactggaaatttttatccctcctcccttggcttcccttatattgtactttctcctccccttttctaactgaaactaacttctttcctctctttctaccctctaaatgtgacattcctaagtcttatccttgttctcttgctttctgtacactctttctcttgcttatctcattccatagcttcagctattgtgtctctattaacctaccagatttctatttttagatgcaaacattttagccatgtatttccagataacttctagatctttcttttgcatgtcctcaaactcagtgcatctaaaattgaatttattttcattttgtcaagttacctctttctcttaacttgccttttttcatttttataccaccatccttttagtcacctaagacttaaacctgaaaaaattttaggattttttttcagcttccttagcaccatatcacagttgccaaattctgttgattctttcgtaaatgtgtcaatatttattgccaccactattattacattttacctctacagatagtatctcactaacctcagtgcctattgttaaatggcacactcattgaaaccagtccaaagatactaggagttcaataaatggttgttgaatgaaatgaaatgcatatatttccccgtcaatagaggatgaattgtggcattaggtaattttttttttcaaaatcagatacataattctcacaaaaatagtatttctgttaaggtaaaaggattttatatatgtatcatcctaaaataggcctatgtttaatgaaacttgattggatttgtttgtggatttaaatccttttcccaaatgtatataattgatgtgaatttgaaaaacacaactgtattccgcacatttagtagctctacttcttagttactcttcatattccactacaggcatttctaatatgctaacttttgatgagggacagtatgctgtatttctctatctgatgataaaatcagaatttagtttatacttcttactacaaattagagtatattttgtagaatatagtctatgacataga

SEQ ID NO: 111552 - DNA, 1042 bp, Homo sapiens
ttaacatttttatagttacagttttttaatacttttatcttttaacttctgtaccagaattaagtgattgttttagtttattcatgttttaagttattttgttttcttttagaaacaatttatagaatttaaaattggttatatacatttttgtgacagttctaaattttatttttaaaaattattttaaaacccttttaatgataaacttctatgtaagttgaataaatctaacattttttcttgtttaaacagaattctgagacttatggttggtcatatagaagagtaccttgaacctatagtttcctgaagaatcagtttaaaagatccaaggagtacaaaaggtaaagaaaggtgcatcttagaatgcatcgtaaaatgatatttttccagaaaaataaaagaattcatcaactattttgacacactaatttaaggaaagtttaatttaaaaaaatttttgtgtgttaatttaccaccaaacgtagtaccagctatgttccgataattactttagatactggggattcagtgatgaacaagacagaagctgtccctgctgtcatgagaaccgccttctagaagaagaataatacacaagtgagaaacacaaataatacacaagtgagaaatttgtggtttgtactgtgcagagaattaaaatggataaatggatagtgtaaggctgggcactgtaaggcttgtgcctgtaatcctagcagtttgggaggctgaggtgggaggattgtgtaagcctagaagtttgataccagcctgggcaacatagtgagaccccatctccaccaaaaatttagaaattagctgggcatgatgacgtatgcctgtgatcccagctacttgggaggctgaggcaggaggacttgagcctaggaggttgacgctacagtgagctgtgattgtgtcactgcattccagcctgggagacagagtgagaccttgtcttacgtgtacaaaaaaaaggataatgtggtagagactggtgactgctttcattaggcagtcagagatagcctaattg

SEQ ID NO: 111553 - DNA, 1135 bp, Homo sapiens
cccaattaaaaaatagcacatccctaatgtgggaaacagtaagaaagcatagattacattttaggcagggcacagtggctcacacctgtaatcccagcactttcggaggctgaggtgggtggatcacttgaggtcaggagtttgagaccagcctggccaacatggtgaaaccctgtctctactaaaagtacaaaaattagccgggcatggtggcgggtgcctgtaatcccagctacttgggaggctaaggcaggagaattgcttgaacccaggaggcagaggttgcagtgagcagagatcacgccattgcactccagcctgtgcgacagatcaagactcagtctcaaaaaaaaaaaaaaaaaattaatatcattggagatcataccaccgaaagtgctgttgttaatcttcttgattatctatctgcttcctgcattttgttgagccattacataagtatatgtatacttatatgatgttatgggctcctaatgtagtccactgcagtgcaagctgttcagttaacagtgaatcatcaacatattttcatgtcagtatttttctgctatgtgattatttttagtaggtatgtaacattctcatctctgtgtaataatttacttatcaatcttctgttggacattgaagttgttttcaatttttaggataataatactgtcacttccctatatcatgcattttgatactggcctacctagtatcagtgattttttctatttttgtttctctgaaaatatctcaatttcaccttttttttttttttttttttttttttttgagacaaggtctcactctggcacccaggctggagtgtagtggtgtgaacatggctcactgtagcctcaaccttttgggctcaggcaatccttcacctcagcctcctcagtagctggaaccacaggcacatgccaccatgcccagctaatttttaaattttttgtataggcggggtcttgtcatgttgccccggctgttcttgaactcctgggcttaagagatccccccaccttggcctcccaaagtgctgggtataggtgtgagccaccatgcacggcagtttcaccttttttgaagtggtttttggtgttttttttgttgttgttgttgttgtttt

SEQ ID NO: 111554 - DNA, 1086 bp, Homo sapiens
aggattgctagaaaaattaggaaattaaatcctatcagttaactgttgtctaccatcaaatatgtcagccagtgttaatattaaaagaaaattgtttcctcttatctcaatcttgaagcatatatattatgtcacctcttccacacatttttacttctagtgctgtgtcaaataaagcatttatttactgtgactattttaataaaacaatattgtgggggaaaagtcaaagttctgcactgtagctaaaccttttgatgtttatctgtttccttatagttttttacagatgcataaagtaaaatattttttaagttccttgtaggcattacaccaatggctgttgcattttctccttttctggatcaaaaattctagatggagttgtatgaattatttatagaacactcaagtgtcagagcaatataattgttactaattgactataattacataatggcatttatatttacaggttgctttacaaccatttattaaaagccctattaggtgtaacttctgtgaaacaggtggataccgagattcctgtttttttccatttttttgattatgcaaatgttgaattatttaaacttactcttatagcctcaactctgagttattactttagttggatatttcacagagatgtaattctgttaattttaagtcttagaagtctacagaaatcacttgtgaaaaatgaaattttatgaattactttgtcttttaaagtatgctgtttcggatataatttgcttttcatttttcagaaacattttcattttttacattaataatgacgacgattaagtttctttttcaaagaggtcacattcaggtacttaacatttttaattctcatcccaaatagtggaaaattgaatgtgagggctatctggctgtgacatgttaccccattgatccccagggttgattcagctcatctggctggctcggcaggtgtccccttcctccctctccactccacgtgcgtccctcctgaagctgaagctgcgtgcttggttgaagaggacaaccatcccaaatagaggaggactggtcttgggtcaagggtatacgagc

SEQ ID NO: 111555 - DNA, 1211 bp, Homo sapiens
tggcgctctggcccctggagtgtaatttcctacacgcagcgccgcagagtttatattctttgaaagtgtttgtagctttgtagaggtcctcttgttgatggtaggtgagcctaattctgcaagataaaagcctagtctctgacctggcagatgaaagatcaaatcagattgtggtttcctgctattagaatgccgtgctattagactttaaggctttttagccttctttaaaaaataaaaaaatttttacagtggaagaaaagcacaagaagtaaacttttacagtcgttgatttgactataacgctgatccccccaaatcaaaggtaatttcactttgaagattgcgttctgatttgtagctttaagcgattagagaaaattgtgcaatattcccctctacctgtttgaaaataaacattcttaaaaggatgtaatttagataatgaattgctttctctgaaacttatcccttgggacacctcaaatctgattggttttcaaagcttgggggaaggaaattaattcctgtgataagtggttggctgaacagaatgtcttgaaaggttagcctgtagcattaggagaaatacctaatgtaaacgacgagttaatgggtgcagcacaccagcgtggcacatttatacatatgtgacaaacctgcacgttgtgcacatgtaccctagaacttaaagtataataataaaaaaagtaaaaaaaaaaaaagttagcctgaagaaagcagactgaaaatgttctaaagctaggcgtaatcagttatgaaaaaagaataaggaagctttctacgtactaacatgcaaagattgcaaaaatttgctatgaagtgaaaaaagcaaggtgtagcggtactttgtgaatagtgtgttacatcttaagggcgaggtgtaataatacaagtttatgtttgctctttatataaagaaattatgggaggatttagaaaactaacaatagaggagagggagaaatagtctgagggaatggtgggaaatgagatgtattatgtgtatgtcttcatgttttcaaatttttgtgtgtattatggactcataaactggattaaacaaaaatcctcctcccccaaataatttgtgtgatttttgttgcctaatttatggtgatttgagtcattttcaatatgattgcttttcatattttttaggaaaatcaactaaaaaggaagtttgggat

SEQ ID NO: 111556 - DNA, 1061 bp, Homo sapiens
gaaccttcctttggagggcaaagttttcccttggcccctaaaaccttgcattttttagtagagacagggtttcaccatgttggccaggctggtctcgaactcctgacctcaaatgatctgtctatcttggcctcccaaagtgccgggattataggcttgagccactgcacccggctcaaattgaatatgtttatgtaaaatggagaaagagtctttggagaaggaaagatgagaaaacaggaaaagagggaagcagaataaccaacaaagatcccaagggaggtggaaggaatgtggaataaagtagaggtgaagggattcacttgaaagttggataaactgggagaaaagggactaatcgatcaaggagtgtgatgagaattaagtgataaagcaggaagagctgaggttgtggtcacacttccaatcaatattaaatttctggtaaggaatagttctggataatgggccaccaggatgtggcatggagtgggattccaaagactggaagaagtttgttggagtcaggaaagacagttctggatatggtaaactcattacatggaaagaagctcatgatggcagcaagggttgggatccttttgtttcaactcagaactgcaaaggatttcctagaagtgtcctgttttttttttttttttctacaaactgggtacctgcttgaaccaaactgatgctcagttgaatgtagtttccctaagttaagcatcagcttgccatggtagctagcttcattcccgggttataatggtgcttgcaataaaaaccagaggactctacatacagttcttcattgctaaaggtaacaatagaggatgataataatgtgcttttatattaatctaagatatatttttgccatggcgatattttacttatttcattagactgagatgagtagcccatttattaaagattgtgtgtactgtttctctttttagcatcccaatgtgtttgttggttaaccagcatcttagtcttctagcaagaaagtttccagaaactaaatttgttaaagccatcgtgaatagctgtattca

SEQ ID NO: 111557 - DNA, 1013 bp, Homo sapiens
aagtaacaaaagtaacaaaagaaaaatttcacctgggaaaaaaaggaaagcaaattgtttttgtgtgtactgaattcatagtcattgttttgttagagcaacagccacatcaggtacgaaaaaatgtttaggtttgttcccacctgtttttgtattttgtttttacattttagcttaattgtattttgggaaactgtggtgaaagcctgttttaacatttgtaagttagtgcattagactgcatgctttttatttattttttagaactttatttcattaacatattaaattatttataaaaataaagtttgattttttcatatcatttgaatcattctatcctctttttcagctgctaaatgtgacctgtgcttataactatacctacctatatgtattatgttatagtcttttctacttttttgactattttactttgaatttttacctctttaagaatctgttccaagtggagaaaatcagagtgtgacaggaggtgatgaagaagtagtagatgaataccaagagttaaatgcaagagaagaacaggatatcgaaataatgatggaaggctgtgaatatgcaatctcgaatgcggaagcctttgcagaaaaattgtccagagagctgcaggtgctagatggggtaagactttcctgaattctatgaataagtgatgtatagtggattgagaaggctaatgatgttcatattatactacctcagcacttaagcctttatagtgtgttattgccatctttatctataagcacattaccagctgccatcagtcttttactgttcttgttcaaaagatgaactattcctgttaagccaatgaagacagttggctgagattctggatttggggaggttcttgatatgaagtgactggagtaaaaactaggccagagaacatcttgggagttgattcgctcagcctctgaaacatgtctgaatagttcagtgccaaagaatagcatttgtgtgtatgtgtgtggtttgaaaaaaat

SEQ ID NO: 111558 - DNA, 1066 bp, Homo sapiens
gatatcacataggtgattatgcttttatttagggtttcacataggtgttaagaaaatttctagctggtagaattggaggaaatgttagagataacatggcctaatgcctcctaaatgtatagaaatgagaatgtgccattaccagtgatactttctggcaccttacttgtgcattctggaaccttacttgtgcagtctgtggaaatataaaatcctaaggcatggtccctaacattgatttagaggcaagtgtacctgcatgaaatactgtgtaaaacatggaagaacataaagtgataaactgaagtagatgtgtaggtatatatcaatttttgttatgctactttcaaggaaatttagcaacatttcacctttattcttttacacatctaaataacaagtatgttttttgtttgtttgtttgtttgtttgtttgttttggtctttaactttgtaggctaacatccagtcaatcatggcatctgaaaaacaagtcaacatcctgatgaaattgctagatgaggctctaaaggaggtagatcagattgaattgaaactgagcagttatgaggaaatgctccaaagtgtaaaagaacaaatggatcagatctctgaaagcaaccacctaattcatcttagtaacactaataatgtaaaactcctatctgagatagagttccttgtggtaagtatgatcataaattaccaacaaaaaaaaactagtgatgatatataaaacccatttgtaaacattttttaatttccttgtgagaacaggatttaaaataattccaaagacctaatgataggactgaatagcatcttgcctgtaaatttcccaaaattacacatgcaaatggtgtgtttgcatatattctagaaccacatggacttggccaaaggtcatataaaggcccttcaggaaggagatcttgcttcttccagaggcattgaggcctgcaccaatgctgctgatgcccttctgcagtgcatgaatgtagctcttcgaccaggtatgttcattagaaatgacaaaaatgtgaccaagaatgtgagactaagcctg

SEQ ID NO: 111559 - DNA, 1046 bp, Homo sapiens
tccacatttctaacagttcccaggcgatggtgaggcaagaccacactttgagaactactgtgaaatcccatttttctcctgcttaacttttatcatgtaaatgaatacacccataaaacttttgggttcttcaaaacgttagatacgtttaatgttccattaaacatcaaggaaatctttttacccattaaactggtcacaaaatgtcgttctgtgtcaggccatgacttgcttctggcagtcaaacagcaacagcagcgattcagtgatttgcgagagctttttgcccggagactggccagtcacctcaacaatgtttttgttcaacaggtaattttattttattattaaaacgagcatgttcctatagcttatttatgtattaaccttacatttccacaaaaatgttaatatgtttaattggggttgcagtcaattccttcacatatttgattttaagattttgaaataggagcctctttgctcatagatgtactttgggcctcagctgcctcttttggtagacagtctagttcctttcagctgatgctctctgattctagaaatcaaataactatgcatatgaattgcatatactacttagatatttttatttataaagtaagtccaaacttgttagatatttactattggacctgttttatttttcagtattttgaggtgagactcaggacttgattcagtgttttaaatgttttgtaagttctatgtacttagtacatagtataattgttaagaaaatgactagctcaactgcaaatttcagttgatctaatcttcatataaatgctttacctatatttttatatggaaaaggatgttataattaagagtgtggtaataatattgttattaataatattaagagtacctttgagggatttgaataaaagccattttaatatctaatacaataaattaggtttcttattttttcatctcttttaaaagtcccttttattttattagagttatagaatgaaaaaaaattgggggaatatctcgttcatcaagaaatactgcct

SEQ ID NO: 111560 - DNA, 1021 bp, Homo sapiens
ctctatttgtgtttcttaattcaagctatatcaagaaggtcatttgcttggtaaattgtgaaatatggtatgagagagacaagcttcattaaaacgttccatcttcattcctttaaaagacggaatgggtagttgatttatcagagtgccattcttgcgtatttatgattatcttatggtggtaatgttcatttgatatacacaggatataaaagttgtgtaagtatttggtttttatttttctgtgttctattcttaattatttttctatgtcttattggtttggcttggccacattttggtcattgtttagactttttattgtaacgtttctttgtactgttgattacatttatttacttattttactcactttagggtcatgatcagagttcgactcttgcccaacactctgttgaactgactttacccaatcatcatccatttcatagagatttgctccgatatgccaagctgatggagtggctaaagagtacagattatggaaaatatgaaggactaacaaaggtatggatttgacgtcatttactcactgagaatagagcattatcttttagaattaagaggtcatgtgttcagttccccaagtttaaaatactgtagtacattcttagcaaagcagaaaatgagtcagtgctctttaccagtgataacattcattttattaacttggataaaggagagctaaattttaaacttcagtatggaaaaatattaagccatactgtagcctaaagcatcaatttagttaaatgctatgcttatttcctgagtttctttatgtacagtatagaaacaaggaagtatgagcattgcaagtgaggtatttgccctctgtggatttataatctgttctgttaaggaaatataaagtgcctctttattaagcaagcattccactattccaggcacctggggcctacctaataagcatctactctaatgcgctttagatctgactgggaagaatcatacataaaacaatcagcaaaaaattaaa

SEQ ID NO: 111561 - DNA, 1435 bp, Homo sapiens
tgatatgttttgtctctgtggaatgagaatattggaattgctaatataaaagcaacttctatctggtatcttagagtcatgcttcagaagaaagcagaagggttaggtagagatttatgaaaagtgtgatagtaagaaggaggcaaattatgtattcctatccatgcatttgtgtttacgtatttgacagtaggacatttttatgtatcagttttcatgtattttctctttgaagtgcctttgcccatttaaagtaaaatctggctcttggacttctaaactgagataataagaaaagggatataaaccttagtaaaataaataatatttttaaattataattttaaaaatgcttttcaaaaaaaaaaatctcctgaggtgcttatatacttcttgtctggctagctattttaggtgagattattttagttcctcagaattagtatattaagcattatacacctccactgttgtgttatattttcttttgtcttgttttcattcaacagaattcagatttggagatatcttaaggaaaaaatttacattactggaattctttgccttttgaagttttaggaggattaatattctgaataattaaacataaattatatttccttaagagttttgtgccaacaagtgctttgtcccctagtgaatattcaaataagtaatcaataagctttttgcctaattgtgttcccagtgagtattattgccctatctttatatataatgcagtattcatgaatgtaatttaaagtgaagaaacaagattagagccaacctagtaatgatttatggaatcattctctgctcagagtatatttttgattgacaatattaatgagctttttaaatgaaattgactttttcccaggaatgttgcgtcatcctgtgatttgagcttttcacagattatgtatttttacctcatcatctaatttggttgctgaagagttgtcaaaaacaggaattttaaggaagaagaaaggaatgaagaaaaaagaaggaaacagaccaatcagtgtttctttagtaagaaatcataattcagaaagctatttgcacttggttaggtttacacagctcacactttttggcaggaacaggaaaaacttgttcaaaattctttgggaataagaatcactagccactgcctctagctgtactgaggctgaatctaagcaaagccccattttttggtatacagaaaatagttgtagcttggactgcccagattccctcctcccgggactgctaccttcgtctgcaactctgggtcatacatgtagggtagttagtagagatggtccatccatgcttgggtaggaaaggagttttcctctcctaatagcctcctgagattggcagtctgacttgaagatgactcacatgtcttctctccacctcagttttacatttgtagaat

SEQ ID NO: 111562 - DNA, 5032 bp, Homo sapiens
gaaattgaagcttagattttatgataaacttaaaagaataggtacaacttttctgctttatttaaattttattttctggtttatttaaatttagtcaaattctgtttgtggcatttaacttcatacttggaaaaatatacagtctcccactgttgaggaactcttctggagagtatatttttatgtgataataagtagagatgatgaagaaatgatttttgtatgccaaaggatacaaaaatgtttttatttaagcgagaattaatcaaatctgttttaagaaaattaattacttgattttgaaaactgtaagatatactaatgaagttcttatggaaaataacctattttggagtaatatcccaagctggcagaggctcagtgaaactaaatattcttaagtgccattgacactatttattattggtctgtttttaaagcaacatgacaatatagaggaagagcaattaagattcccatacactttgaccctgttattccatccttaagaaattatttcaaagaaatagttcattagagatgaaaagcttattgtaacattgtctatcatagcaaaacatggaaaccacttcattgtcctgtgttaggggattggtttacttaatggtgctacaccaacaaaactgaatactgtgctgtcattaaaatgtgagactggagaaatgtatttgttctgatttagatattctgtatagtgtgattacagtgatatttaaaatatgcaaaaggtaatatagaaaaatgaaaatataaatatggttatgtttgacttcatatttttgtaaattgttaatgttatgatgcctattcaattgttttttaagacagaaagtaacctatttttatatcctgtgaaatacatcaaagttttggactatgaaatttaaaacaagcatgaaggacttggggaattgaaaaattgaaattgttatatgtgttttattaataagaagtacatgttacttttattttaagaattacatggattatttatcccgactatatgaaagagaaatcaaagatttctttgaagttgcaaagatcaagatgactggcacaactaaagaaagcaagaagtttggtaagcttaggcatgtcagttcattatcttcctattaaaaatggctttatttataacaaataattctaagacttcttaagcaaggtggaggtagatccagcagaatttatgaaaaaagaggtctaaaacgttggcttgatttatagccgtttcatagaacaaatatgtatatctgtaaattttctttaattaaaattctgcagtatgtgactgtgacagcgattgtgtattcatgctgtaatcaaatatatatattcataagaacagcagttggtgagaaaatgaagtgcagtcaagtagagaaagtactagactgagagacagatgttgggagttcagtttaactgattccctaaaagactttttataacagttgggggcaagtcactaatctcttaagtcattgctctccacatagaaatgaaactggttcctggcttcttacttctcactggctattttgaatcaaaaagaaagtttaaatattttctcccctgccaaagggctataaaactgtcaccaaacattctcatgttattttaccttatttttctaaagagatgctttgatgcatgttaatttttgttgtttataagtattttaaatggacaaaaacattatttgaaagaatagccagtgacagtatcaagttatgaggaaggtgatttgccgaggccacattctgctcttgcatgtatccatctctggagttccttttggatggagttttgtgcctattcaagtcaaaacctggccttaaatggccacattgtgtactcctcagtgtgtctgcatagctcccctttagaataatgagtttagcatttgcctgttgaaaggagcctatgccctaagcaacttcagtaatcaagaaacatgattcaaaactgatagtacatgtttccattcttttctgtaggacagagaagactgtcattaatgggtaattattctgtaactcactgtttttaaaaaaatgcaacactaatatattgattatactagtccagacatttgaaatggtttgaatttgtctgtaaatatgctacactttacagatactgataagaatcttgggacagtaggctttcggaaacagaaatgctaactcatcctaaaggttaattgttcttaaacagcagtgtgtttatatccctgttaatgtttcactgtggatatgttatgcttttttttttgagtaaacagcatattattaatgcagttacatgtttaatgttttcattaagtatatttgtcaccacttgttagtgaaccattttattttgagagaactccttcagtatatgaaaactggaggtaagagagaaatatttctaaaattatctcctgagtaggtcattaatcccagtatcataatagtttatcgagtctaagattcacattaagataaatgaaataataagaatataactgaagtacaatagtatcttaatgttatcattgcattaacctgaaacctaaattttttcctccttgagaaattcttaaattatcttgttaaaaacatttttaactaacataatacaggttaaaaggtagttttgtagttttataagtgttaagatcacatatcttctattaaatgtgtctattaaatagcaaggaataggagagttatttgtgacaattgagtgcatagaaaattgtgctcactttagcagcacatatactaaaattggaacaatacagagaagatgagcattgtccctgtgcaaggatgacacactaatttgtgaaatgttctataaaacaaatgaaaattacagtatcaattattttgatatcagctacaggagaagaaaaactaaacaatttggagaataaaaattggttcatgtttgaaaatccaacttttagctagtattttaaaattaatttcaagttaaatgcaaatgacttgagaagttctaaataagatatagtgtacatttttttcaaagatatcttttcagtgattcaaattgtgtttgaatgaatttttcatactgtagactgtcctggcttataattgttcaacttaggatttttttattttacagtagtttgaaagcagtctgcagtcagtacgaaccatacttcaagtacccatagccattctgttttttactttcagtatggtattcagtaaattacatgaaatattcaatactttattataaaacaggctttgtgttaaatgattttgcccaactctaggctaatgtgttttcaccatgtttaaggtaggctaggcctctggtgttcagtaagttgagtgtgttcaatgcattttctctttataatattttcaacgtgtaatgggtttatcaaaatgtaactccagcctggcgcagtggctcacacctataaacccagcactttgggaggctgagccgggaggatgacttgagccctggaggtcgagacaagccttggtaacatggcaaaaccccatatatacaaaaaaatcaaaaattagccaggcatggtgacatgcacctgtggtcccatctactcaggaggctgaggggcacggatcacttgagcctgagaggtcaaggctgcagtgagccatgattgtgccactacactccagcctggacaacagagcaagaccctgtctcaaaaaacaaaaaaacaaaaaaacaaaaaaaaaaaaaacaagaaatgtaaccccatcgtaagtcaaggagcatctgtaattataattaaaatagaaatctcattttagaatgatgacttttcaatgaatgaaaattaagtaattataaatgaaatttaaattaattttgctttttgcttgcttgtttgctctgaaaattctgggtcacaaatgctagtaagaataaatgctggtaagaatagtcagaatgaatgcatcttacaaaaagaaactatatagtcaatatagtgatagagaatcaggggaatagagaatcctttctttttcagccactcttgagtcaagtctttaacatctacttagctgaaataattcaaaattatgctaacgtaccagggaagtagcttttctttgtgataagacctttgtgtaggttactgcctttttaaatagatttattttgatattttcaaaggcatggaattttttcccacaggattgatgtttcagtgtatttttttcctttgtattctacaaatttaatgaaatgacagggaaaggaaatttagtaatttttttttagtcaccatttttactttctactgttgagatatatatatcacctctcattagtcccttaatacatacatttacataatcattgccctccttccaatttaatattccaaatctttaaaatagccaagattattctattattgtttctccgctaaactaggaaaccttgttgattccaaagagtcgtgaatacaatgctgaattcagggatggctggaagattaactcaataaatatttataaattacctattatctaataactcactgttataagtactgggaatgcagcagtaaacaaagaccctacctttatgaagtttacattctagtggggattatataaagatatttaacattttacctgagtgttatcacttgctgataagggatataggctgttttatgaacctcaaattataattaataggcactactactaagtctgtattccttattgactactaaagaaagaaaactagtcaggcatggtgatccacatctataatctcagctatatgggaggctgaggtaggaggatcacttgagcccaggagttcaggtccagccttgtcaacctaatgagatcctgcctcaaaaaaaaaaaaaaaaggaaaccatataaagaattagattttgctctggcactgctgaacatagcatagtgacaccttaaggcaccagaaagtactgttcagattggctagctagtagctccagcgtgatccc

SEQ ID NO: 111563 - DNA, 1711 bp, Homo sapiens
tgtctttgtctttgatgcttgcaacctaatccatcacagctacactgcctcgaaaagaaagtgctgtcaaacaggaaacagagagtgagtatgcttagtgtattagtaggtattctcaatgcatgtttgtttaatgtctagaaattagttgtcttgaaaaaaggtaacaccaaaaattttgattgctctgaattgccaggtattggtgaaagaaagccaacatgatggtagtgatatggctgtatccaagaaatatatgatatagttaaaattacttgacgagtagtagaacattgtgtcagaaatttgtgaaaagacttaaccattatacttctattttcaggctgtttagaaactataaaaaatcttatatagatatggtcggattttacataatgaagccaaagtttatctttaattgtacctgttctgtcttcatttgtcttttctgaccattagcaaatagtacaagttaactgagagatattcaggaaggatgtttttaaaatatattagttattgtttatgtttaattctgaataaaaatatcacattttcttctaaaaatcaaatcctttaattccttggtgtatgtgagctattgccagctatatgttctcatttttcctcatggctatgacggataccaaaattttacctaaacacagatgtcccatattaatatgattagtgatgtatgtattacatttcggctgtattttaaatataacgagttttcagggtgttttttctgttcattttatttagtttttaaaggactataatcagttcacttactggaaaagcagtttcagagtttggaacatactaagttgaatcatatgtaattgactttttttggtagggcaaaatgatcaagtatgggcagtttcatgtggttcaacctaatatattgatttattgtggaggtaacattgagatgcagcagttttcttctgaagtataacaaagtcatgctggctaatatgctaacgtggtcctcattgaccttcatccatattcctgtccttttgaatggaaaagaaaccctcatctactttagtctagcgatatcaccaggcgactttatgaaatgggcaggttatagacaatatgctccttaaggtccctttcagtcccgttctatggatctgtgtagtttcgcttcttttttcaatatgctcagaattaggacaccaatgttaatggaagataaggaaactataccacctatcccttatagaagatttgtgcactaactaatatgagccctggaagatcaagccagtagaagatagaagatctatccctgctttatactttggatcatttatttgtgaagatcacaactttcaaagttttattatttcttaggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataaggtaaactaaaataacaagtacttcttaaacattaacattagttttctaacagcagtttgtggttgctctaagtgtgttcaaagatttgggttcttctggctctcttaagcattaaccatgtctttccaactgaatcgaatctgggaaaaaaaaaaaaaaaaactagtcaaagg

SEQ ID NO: 111564 - DNA, 1030 bp, Homo sapiens
ttatcaatgaaatggcataaaagctttattaaaatttgttataaatcataaaatgcttatatctcaaatctaagttgtttgggcacctaaaaagtaagaggaaataaaagcttttgtgatgctggcctttctctgtactaaattaaataagtttttttgtttgtttgtttttgaaatggagtcttgctctgtcacccaggctggaatgcagtggcacagtctcagctcactgcaacctccaccttctgggttcaagcagttcttctgcctccctcccaggtagctgggattacaggtgcctgccaccacacccagctaatttttgtatttttagtggagatggggtttcaccatgctggccaggctggtttcgaactcctgagctcaagtgatctgcccgctttggcctcccaaagtgctgggattacaggcatgagacatcatgcctggccataaataagttttaaaagttgatctttgtgctcctctttccagatgtgaagtgaataactgtgagttttattttaggtttattttgtggccttgttataccttgctaataccattgtcctgtagatcttggaagagtttgtttttgggattccattgagattataaattcatagattagtgagattatggatccatggtctgtgcagaaaagaaaattaaatgtggagtgttattttaagcatttggtgcagttctttcgttataggatcactttggttttcttcagatctttgaacaggtactaagtgaactggagcccctatgtctggcagaacaggacttcataagtaaatttttcaaactacagcaacatcaaagtatgcctggaactatggtatggctcacagtgtattttggatagtatttatgatctgtaatataattagcttaattaatatgtggtcacaattttatgatcagaagagaaaaggaaagaatttatcatgtaaggatttttttatgatgtaaggatttaggatgtaaggaatttttgtaataccacaagatgataaaaaca

SEQ ID NO: 111565 - DNA, 1820 bp, Homo sapiens
atttagacatttttatttgttttttgttgttgttgttttctgagatggagtctccctctgctgcccaggctggaatgcaatggcgccatctcagctcactgcaactgcacttcacctcccgggttcaagcgattctcctgactcagcctcccaagtagctgggattacagacatgcaccaccacgtctggctaatttttgtacttttggtagagacagggttttaccatgttggccaagctggtcttgaactcctgacctcaggtgacctgcacaccttggcctctcaaagtgctgggattacaggcgtgagccaccacgcctggctatttagacatttttaattgaaatttaattatggtatttttgtccttttgtatatacccagtggattaaagttaacggtgaattcacctgaagcttgttataactttatacttcttgtctgttttctgaacaggaaagatatgatccgccaaatgatgattaaaatatttcgctgcattgagccagagctgaacaacctaattgcattaggagacaaaattgatagctttaactctctttatatgttagtcaaaatgagtcatcatgtgtggactgcacaaaatgtggaccctgcttctttcctaagtactacattgggaaatgttttggtgactgtcaaaaggaactttgacaaatgcattgtaagttttcttttttaaaaaaataccttagcatcctagtcattgcaaaatataggtaaatgtatttaaaatcgagggatttccagctttctgttggggaatctgttgtttatgtccctcgaagcagggcatggcaacaatctacatgaacagagttagttgggtggcactatgccagctagtttccattccacactgtgaatcttggcaagttctggaggaagtggcacagtggcaccagttgcttaagagatccactggaggccagacgcagtgactcacacctgtaatgccagcactttttaaggccgaggtgggcagatcacctgaggtcaggagttcgagaccagcctggagaacatggcgaaaccccatctctaccaaaaatacaaaaattagccgggcgtggtagcacatgcctataattccaactactcgggaggctgaggcaggagaattgcttgaacctgtgaagtggaggttgcagtgagccaagattgcaccagtgctctccagcctgggtgacaagagtgaagactgtgtcaaaaaaaaaaaaaaaaaaatctaccgaatcactgacatctcagtttattagtcaatgaccattgatttaatgaaacaattgaaacaatcatttgggtttattgttattgttcttcttttaatacattctagtaagaaaactaatttgattattttaattatttaatttattttaatagtttagtagctttaataattgtattttattttaggaataaattgttataactgagcaattatcattttcctcctaatagaaaaaaatttgacaactttcttactatctgttactttttttttttttttttttttttttgagatggagtctcgttcttgttgcccaggctggagtgcaacagtgcaatctcggctcaccgcaacctccgcctcctgggttcaagtgattctcctgcctcagcctcccgagtagctgggattgcaggcatgcgccaccacgccctgctagttttgtatttttagtagagatggggtttctccatgttggtcatgctggtctcaaactcccaacctcaggtgatctgcccacctcagcctcccaaagtgctgagattacaagcaagagacaccg

SEQ ID NO: 111566 - DNA, 1110 bp, Homo sapiens
attttttgtagagacgaaaatggccaggctggtcttgaactcttggcctcaagcgatccacccaccttggcctcccaaagtgctgggattacaggcatgagccaccgtccccagcttatagatggttttaaataatctgtattattttgattttcttaaacttactgtaaaatggttttattatctatagaattagtttttcttagttatccttgttttgattcatcttcaattagtaagcatccaaagtgttctaggtaccacataatatcctgcctctatgatatctatgtatatatctatatctccatctatatattttgttatgattatatgtagttttaaagttgcttggttatttatctcccttgctctctgcctaactttagagtaaccaaataaggcaaatggaagaagtaaagatctcaaaaaagagtaaagttggaattcttccatttgttgctgaatttgaagaatttgctggacttgcagaatcaatcttcaaaaatgctgagcgtcgtggagacctggataaagcatacaccaaacttatcagaggagtatttgttaatggtaagcttttgttatgttctaaagaattgttatagctattgtttttatttctggtaactaagaaatcgggagcagataggttcattattttgtatatcttataatcttttttaggttttctaacattaaagatttcttgaatttggaaaataaaacctatttgtattcattatgaaccacttacattttagggtttatgtgggcttatgactatgcaaaattgaaaatcttttttttttttttttaagatgggcctcactctgtcgcccaggctggagtgcggtggcatgatcttggctcactgcaacctccacctcccaggctcaaaagatcctcctacctcaccctcccaagtagctgggactacaggtgcaccctaccatgccctgctaattttttgtagaaaatcattttttaaacacaaaaacatgaccttccagattacatttgcattttaacaagtggtcttctagagatgatgggctgtgatgtgtgtgtaaccttaagcaaatcaattcacttatttaggactcagtt

SEQ ID NO: 111567 - DNA, 2591 bp, Homo sapiens
agaccctgtcttaaaaataaataataaatgaatgaatgaattcattattcgttctttataaatctttataaactaaaacttataaaacttaagaacagacagatattcctttaattggataaaaaatctatctcaggcctaaaggttacatgatacttaactgcaacagtagagatattccctctgaaatgaatttaaagcagaagtattgttagatcctttattatttagcattgttattgaagtgctagccagtacaagacctgaaacataaataactatttatccccaaaaatcagcgaatagaattttcaaatcaagaagaaagtaaagatcatttttaatcttgttgtacagagataatgttaaatttttattcttccaaacttttaaattccctgtccctctcttctatatatgggcatattgtatgtgtgctttctttaatataaaagtgttgtcatacctgacacactatttttgaagctgctggactctatataatcttagtatctttcttagttagttaatatagataaacataatcatttttaatgattgcatagtcatccatatgtcattatccatttaccaaatcttctattaataaacatttaggatttttttagtttatctatctttgtatacttgtcaaataatttctttagggtaaattactagaaatggaattactgggtcaaaggatttatgtatctcaagtcttttcccaaattgtgatacagaaagcttatgtcagtttagtgctatgagcagttgcattacagctgtaccaatgctgggttttactaggtattaccaatctttttattctttgtcaacctgataggctataaattatctcactattttattttgcatttcattgattttgtatatggtgtctttactttacatgaattttcaaattttatctccaatttatttatctttccccttaacagtcttctaaattttgggccattcttagcaaggtcacactattgcaaaattattatttttctattagttatattttctttagtacttatgattgtattatttgtttgctttttacattttaaataatttagcaatttagaatttgactgcaagatgtaaagtaggaacttaaatttcatatattaaaatggtccagccggttgtcctaacacattttgaataattcatcatttctccattgatctgaaaagctacttttattatatactgaatttccatatacacatgggactgttttaggatgactttttattatgattaggtagatctgaagactcccattacaatatattgtattaagtccagaaatgtgcttaattcttaaacttacaaatgaaaaaaaattaatagtataaatgtttatagctaaatatggtcatactcagagatgttattttattttttctgttttggttttagtggagaaagtagcaaatgaaagccagaagacccccagggatgtggttatgatggaaaactttcaccatatttttgcaactctttctcgattgaaaatctcatgtctagaagcagaaaaaaaagaagccaaacaaaaatacacagatcaccttcagtcttatgtcatttactctttaggacaacctcttgaaaaactaaatgtaaatatattttcattcagtatttttcctacttttgaacctatacacataagtttgcatatgaataacctgcagacatttatcttaaattttctcatgtgttggtgcacaggggactcagttattgaagctgccagtgtgccagacactgctagatgctatatattttatttcttctttctgtacattatttttatacattatttatctactatattttaatgataattgtactagtattctattatgcattatttcttttaattcttataaacaatgatgtgtaagctaagataatattatccccatttcacaaatgaagaaactgaaagtaaaaaaacttgcccgacatcataatagcttataaattacaaagctgggggatgaacctagattaggctttgccgttactctttcccatttcttactttataaatgaccaagtttacaatgtctaggtggaaatttcaaaaatattattaagataaaagaaaaaccaaaaattgctttctacattgccttttacttttctttcccttctttttttttccttacttgagtcatttcccagagtaagtctgttaattaaagttaagaaatgatgattttagggaactttacaagatagtgaaagcttaaatgaaccttttaaactaactttgtctgcaatatagttatcttttataagctcttaacttgaagttagagtaaaatagcgcggtgactcacacctgtaatcccagcactttgggaggccaaggcaggcggatcacgaggtcagaagatcgagaccatcctagctaacaaggtgaaaccccgtctttactaaaaatgtaaaaaaaaattaactgggcgtggtggcacgctcctgtagtcctagctacttgggaggctgaggcaggagaatcacttgatcctaggaggtggtggttgcaatgagtggagatcaca

SEQ ID NO: 111568 - DNA, 1002 bp, Homo sapiens
gtaaacaaatctggtataaccttttattataataagttacttaaagcccatacatatggaatgcatatcatacatacacttaaaattatggaatggcaagcacatgcaggcgcactgagagagaaaaccaacaagaaaactgatatgtcaattataggcaacctcctccctaaaagttaagtaagagtagtaaggtggtataaaagaacaaaggctatgttaacccagggctgataccactcgcggatcagcccattcttctctctggaacattctttgcttaatacatcttgtggggtcattatttgtgtgtctcctccaattctttgtttgcaacaccaagaacctggaaatccaacttccaatctggtaacacttctactctaaaaatgtgcttactctttgtatagcatgtaactgctctattggttgtacccattcatatattaatgtttccactttttatgcctcctctgtttttctcatgccttaatgagctgttttatggaatttctaggaggcaatgagttgagttctatagatgacttttgtacatcttgcacatgtacaatttaacacttttttgtgaacaacagatatcttttttgaaaagaggtagtcatagattaatatcatagcaaaatggctgtgcaacggccatccagtcaagattactctttagcttccctttgccccaagcacataccaattagaaaatgtaaaaataaaacccaaaaaagaaatgcaaaaaggtgagtaggatgaaagccattagtgagctttgttccaagtgacatggaagaccagagtcaaggtcactgctgaacttcaaggcctgaggtcagggtccctggatgttttaggcagttctcacattgctataaagaaatacctgagactgggtaatttaaaaagaaaagaggttcaactgacttactagcaaactgaattcaacaacacatttaaaagatcattacgaccaaatgggatttaccccaggga

SEQ ID NO: 111569 - DNA, 1294 bp, Homo sapiens
ttacttattgtgttttagaaattccccaaaattttcactctgccagtggtttccttcctgtttcattgctgttatagatatattcttttctcttcgtgctttttatattttgtttgtatctttaatggtagtgaggagaaagaaattttacacccattctgactcttagaacctaaactgtacacatgacttataaagtttttttaaaaataaatctattttcttagttttcttccggaaatattattaaagagtgcctaagaaaaatatcattaacgtattaagatatatacctactgtttttttatttaaattatagcttgaaagcgaaaaatatgaattaaagtctaaagtgttaataatgaaagaaacaatagagtcgttagagaacaaattaaaagtccaagctcaaaaatttagccatgtggctggtgactcatctcatcagaaaacagaggtgaactcacttaggtaagtttattcaaaattttctaatttcatttctgggaatgtgtttgtggttatgtaaagtttataatcatggcattttggactgggcctttgtgcagtagttttagaagttggctttgcagtagactcacctgggagcttttgaaaagtatgaatttaaggggctgattttgggaggttctaattcactgagaatctactggggtaggttttgggtatctgtgttttttaaaagaaatttcacagattaatatgattgcaggcaaagtttttcaaccttcttttgaaatcctcttaaatacttcagatcatttgtatttcatagtgtaagatactgaaaattacagaattgtttactacctatgccattttctttctctttcttgcctctttcagtgaaacgtaaagtcaaagaatttacctccaatttttaaccctttctgacttagaaacagaagtttttaagtagggaggtaagacatatcaatagtgttccttttaggaagctaactttggtggaaatatggaacatggatttcaagtcttagagattgatggcaaaaaaaggagaccgaggatctggactgaagcagtggtaatgaacttagagaacagagaccaaatttaagaaacactttttatataaaatcaaaaggtttagatgactaatatggggctgagaaatacgataagtagaacatttaccttagcatattgggttgttggttagtcattaattaatttagaatacagaagactcaaggaaacaaaaggcaaacaaagctttttttctgatcagagtagctgcaataagtaacaagat

SEQ ID NO: 111570 - DNA, 1062 bp, Homo sapiens
tccctatattgcccaggctggtctcgaactcctgggctcaagctattcaactgtttttgttgttgttgttgttttttgttgttgagacggagtctcgctctgttgcccaggctggagtgcagtggggcgatctcggctcattgcaagctctgcctcccgggttcacgccattttcctgcctcagcctcccaagtagctggactacacgtgcccgccaccacacccggctatttttttttgtatttttagtagagacggggtttcaccgtgttagccaggatggtctctatctcctgacctcatgatctgcccgcctcggcctcccaaagttctgggattacaggcgtgagccaccgcgcccagcccccaagctattcaacttttaacacttgaaagttttctgtgtttacttgactgttggaataacatttttttttaacttcatttgcatgtaattattggtagagctctaaaatacctgttctacctaattaataggtctcttaatgcagcagttataatttcttataatcacagtatatttgtattctaagtatacttagactataagttttcttttaaatgaactacagtttttaaaagttttctttattagtttcacatcactcatttaacagccagctgaaagaaacattggttaatcgagatcgtgagataaacagcctccggcgccagcttgatgcagctcacaaagaactcgatgaagtaggaagatctagagaaatcgcttttaaggaaaacagaagactgcaagatgacctggctacaatggcaagagaaaatcaagtatgaacacaaggcataaattttgatagttttatactttccattgtttgctaaatattaaagctctaaatattttttctaaaatctgatgatataaaaataagtgacataaataattcattaaggacaatggtgtttatcagggtattaaaaaatggagcttaggccgggcgcagtggctcacacctgtaatcttagcactttcagaggctgaggtgggtggatcacttgaggtcaggagttcgagaccagcct

SEQ ID NO: 111571 - DNA, 1086 bp, Homo sapiens
aggctgaagcgtgagaatcacttgaacccaggaggtggaggttgcagtgagccgagattgcaccactgcactccatcctgggcgacagagcgagacgctgtcccaaaaccaaaatatttggcttatacatctgctgcttttggaaatttaggagactgactcgggagaaacatcgtgttgggaggtgcagacctgtatatcttcactacagaggttgtaccgtgggagtaatgagaagagaaaacgttaggaaagcgcctacagttgaggaatggacagaggagtcagtgaaggagaaagtgttctcgggagaagaagaggtggctgtgtcttatgctgtagattaggaaaaaggactctaaaaaggctatgagatttgacccacatacatgtattgattactttgggagagactgattatgtcatatttttagaatagaaggatttagacatatttgtaggaagagggaaagaaacccagagtagagtacacatggaagaatgagcttttgaaaggtattaaaaatattaatatttctctttccaaggcaagagtcaagaaagagccaatgaagacactttacatcttggtgttaccatttatgtctcgttcaaatttgtatccctagcattgctttagtgcttagcacataatagatgttcagtacatgtttcataaataaactaaatgaatgaaaaagaaaatgtgataaaagctctagaagtttagagaattcttgttgaaaggtcttgatcttctctttattaatttaaaaaacccacagcacctgactctacaaaacggaacgtttatttcttgattttttaatttgtttttaagaactagtcaaagccgggaaaacaccatgcttcgagctaaagtggcacagttacaaacagattatgatgctctgaaaaggcagatctcaactgaaagatacgaacggtaagacaaattttttttacatttgacaatgtttttatgtgttctctattgtacttcagaaagtatttaatatggctttacaaataacaaactttttaaaaagctaatacataaagtacatttctttggtaattcttcct

SEQ ID NO: 111572 - DNA, 1066 bp, Homo sapiens
ggtggcacacacctgtagtcccaggtaccagctgctggggaggtgggggaggatactgaggcagggggatggcttgagcccggaaggttgaggctgcagtgaactgtgattgcactattacagtccagtatgcatgacaaagcaagcagctatctccaaaaaaacaaagagttctcactatcttgcctgggctggcctcaaactcctgggctcaagcagtcctcccacctcagcctcttgagtagctgggactacaggctggtccatgcattttatcgtatataaattatacctgaatttaaaaagagaagacatctacagcataacgttaaatgacaatatgagctatcacaggatattatttgatgaagggctaaattcaggctacaaataataggtagtaaaaatgtagacaaagcatagaaacagtagtacacatggtacagtagtaacctggcaggaagggcaggctgtgggggaataatgagggagagaggtttggaaggtagagtgggatatatagagtattatattgaatgtgaagctaaattagagattgtggactttattctgtaagtcaaaaggaacgtgaacgtcagtcctcctgtgtataggatgggtacaagggaagggtcaagatgaaataactgtttctggtagattaatttcacaactgtgtttgaaccatattggaaaggataggaactagaggtagagagaccagtaagtggtatgaaatgagcagtataatagttcaggattagtataataacattgaaagctaggacataatttttaaagtaaaccatgaaatatatacagaaaggtaccatatcatagatacatagttcaatgaattttttcaatgaacaaattgaacacatccaggtaacctgcatgaaaatcaaaaaaaaaaaaaaataggccaggcacggtggctcacacctctgtaatcccagcactttgggaggccgaggcgggtggatcacttgaggtcaggagttcaagaccagcctggccaacatggtgaaaccccgtctctactaaaaacagaaaaattagctgg

SEQ ID NO: 111573 - DNA, 1427 bp, Homo sapiens
tttcttgttataatgcagtatcacacagactcactgaggaaacataaaatacagagatatataaataaggaaacaaaaatcacttttttaaacaaaagtataagccaggcagggtagctcacacctgtaatcccagcattttgggaggccaaagtgagaggatcacttgagttcaggagtctgagactagcctaaacaacatcgtaagacctcatctatactaaataccaaaaaaaatgagccaggcatggtgatgtgcacctgcctggaggctgaggcagaaggatcacttgagtatgggagatcaagactgcagtgagctatgatcacgccactgcactccagcctgggcaacacggcaagaccctatctctaaataaataaataaataaataaataaaataaagtacaatgaataaaacagtacttgaactttcagaagtagaacagtacttcttaaatataactggatgtggggcacagagttttattagattctataatttcatttataacattattgaatttcagttttttatgaatatgttgaataactttatcatttttctcttaacccacctttcaatttcctccctttcagaataatggctttcaatgagttcctatgtggatttttaaaagaacagaacagtaatgaaatatttgaagtacttgttgctgaaaatcatgaacatggacacaaattctacctctgtcaacttttatttaaatcagtgaatatgttaaaaagtttggtttaaaagaactatatctatatgtatattttcatatatatgacagaacaagaatatgtattaatagtgcctaatgtatctatatttttattattcatgaattaaattactaaaagtatgtttatactgtgaattaatataatgtattcacattattctttaataatctgtttattaataagccatgatatgtgtatgtaaatattcttacagtacttgtttttagttgtcatgcctatgtttagaccatatcttaatgtattcacaaagaattatcaactttgatgctatgctgtcatgcttaactttttcttcttaaaattattcatagatctactgtctgttgtcaaggggaatatattcaggtctagtcttcttataatagcagaggtcttggtaaaataactaccatatataacgtgttattgccatctagaagaactatgatgagaaagatacatttatatattatgtaaaatgttaactatcatcatatggactctatgtaacacaaattcaaaagcaaactaaaagctatatgcagagttttgtataaaacaatagaacagaaatttgggacatttttctaggaaataaaattcctcggtgtattaatctaaggtttcaaagtataaaagtatatggggtaggccgggtgcagtggctcacgcc

SEQ ID NO: 111574 - DNA, 1084 bp, Homo sapiens
tacaaaaattatctgggcttggtggcgggcacctgtaatcccagccacttgggaggctgaggcaggagaattgcttgaacccgggaggtggaggctgcggtgagccaagatcatgccattgcactccagcctgggtgacagagtaacactctgtctcagaaaaaaaaaaaaagaaaaatatatggggtaaatacagtaaaacgttttgttaaattccaatatacattcagtgataccactctttttcttctaagcctgtgtgttataatttaccagttccccaaaatgccatttttaacgccgaactgtgtaatatacatggaaaacagctttttacaattaattttcaaagttgtaattttaaagaatttgggtgtatacctatgttaatgaaacaacagaagtacaaaaaagaatatcagatacaaaaatcaatcgtgaagaaaatctgttcttaatatatttcattatgattgaaaaacataaaaactaacataggaaagtgaatgatcagttacttatgatatattttgtttcctcttgtggtttaataaagtgaagtgtgtgtgtgtgtgtgtgtgtgtatacctgggggtgggcagtgctctttttctaaaactaatatggcttatatatctgaattatgccctttttagtgtgtattaggatgtgggctggtttgcttttctaccacctttgtaattttatgtatcccatctcctttgtgtgaattcatatattatagcaaaatacaagagacatgggactgtttgcaataccatatggaaatcttttaataaatatatgtaaataaaataaaaaatatttgtctccaccttttccccaaaagcaacagcaagacatattttgttagatattttatttttaatgttttctataatttaaaaatgtatagcctgccaaatgttgttttcataaccatgatattgttttgaaaaaattttatcttaaaatactgaatgttctgaccttttatagatgtttttgattttgttttaaataattttaaattatggagcttgacctagatttgccaataaactttctagcctatttattttct

SEQ ID NO: 111575 - DNA, 1084 bp, Homo sapiens
tccttggcaggtgatttaatctaagcctcagtttcctcatctgtaaaatgggggaagtaatcctatttagaacatttttgtgaggatcaaataaaataatgtgggcatagcacaatgtttagtacaaactaagcactcagtgtcagctaatttttattttcattattttaatgtaaagcaatggcttttaaactttttaattttttattttatttttatttttttaaagaggtgaggtctcactgtgttgcccaggctggtctcaagcaatcctcctgccttggcctcccaaaatactaggattacaggcatgaaccactgcgcccagcctaaacttttatttttgcacagtaagagatgcattttactttgccacccagtatacagatacattgtaaatatctgtaattaaaaaattcatgaagtaatgcttagactttgaatgtgcaatgcattcttatattttttattctattttatttaaaaaatgttggttgagatcgctaaatgatttcacatcccattaatgggtcaggaactacgctttgaaaagcactaatgctaaggataatcaggttaagtgcatttaagaaagctgttgttgaatctttatttcttttcttcaaatggtttacaacatcaattggagtttgaatactaaattacatttaaaaataagttcttaaacatttcttgggaattaccatcatttattgaatatttctcatggtcacgttactgtgtgctaagtagtctatttatatatgttatctaatttagttctcacaacagccctgtaagtaggccttgtgtttacatttgataattgaaattaagactcagagagctttttattaacttgcccaaggtcctaaatttagagagggatgaagcaaagattcaaactgagttctctctgatcccaaagcctgtctgccctcttaacccccatggttttctgatgttccctcatagtgatttctgaagatgtttcatttcttccttaacataaatttgaatgtcgatattgagaatttacccattgtggtacatcttttgtagtttcctttgaaatgactcattt

SEQ ID NO: 111576 - DNA, 1049 bp, Homo sapiens
attctgaggcttgtggaaggaggaagatgctgacgtttaagcaaccagatttaaggcagttgttcaatgtatcaaatagctcttctaagttattttaatataaattaaaactaaatgggagctctgggacagccctgttttaattacaattggaatgcatcttaggagaccattctacctcttataatcataacagtgtcattatgatttttttaagaagaatcactaattagccaggtctatcctgaggtcttagagtttggtttatagatgattcttgttgaattaagtggaaggctgaggcatgtgaacattcatcttggccctaaacctttttccctggtgatacgaaatggttcagcagtaatcagcagcagaaaggtatgcttaaaaccggcttgttctttatgtgagataccaggttgagcaaactggatttacctttcattgaggattattcacatggaattttaaactgatttcctgcaaattctgtccacagtgttgggaagctagagtggtagactgtagtttctgagctaacataagatctgatctctgaccttctgctgacgtggaatccaggttatgttgccttgtttccttggatgggagttcacagccagtgaaactagccctgactgaattatttaattcatcttctccttgaagacggttgcaaggagtttttatagaaccgaatgccttacaaatttggggcttgcaaatgtatttctgttctttcttcattttcccttttgctgaagatagaaacacctcctgggtctttggttcagcctgctgttgtttacagtccctgctgtagattacctcactctgccagtccctgtcgtaatgtgatttatctttttaaaattaaattctcatcataattccctcaggcatctgtcttcctcagaatgtttagttatttcatatagaacttaagcaaggaaggaagaaaggaaaggaaggaagagaagaaggaaagaagaaaagaagttctgtttggatactgtgctaacaggtcatattgggcttgcttatta

SEQ ID NO: 111577 - DNA, 1403 bp, Homo sapiens
accatttggtcccttttttcctttctttttgagacagagtctcactctgtcacccaggctagagtgcagtggtgtgatcatagctcactgcagcctcaatctcttaggctcaagcaatcctcctgcctcagcctcctgaatagatggcactacaggcatgcgccaccatgcctgactgatttttttaaattctttatttttagtagagatggggtctcactctgttgcccaggctggtcttgaactcctgagcccaagcagtccttccgccttggtctcccaaagtgctagaagtacaggtgtaagccactgcaccgggcacctttattcataaacagactccaagtttcacttttcccttgagtctccattgaccagttctcatctgggagatcaggatatgcctggtgggggttacccttggctgaaatatatggataaagggtgtctcttagcctggttgagcagagagagttcaccctggaggcaagtagtggagtgtgttcaaccaagaaggctacacaaaagggtggctgggagggatctgggagagactggattatttatcagaccaaagttataatggagtaattcacatatggagctctcagagggcactgcaggtccagagaacggagcaagaagtgctgagcaagggatgttcaggaaacgaagtctgcagacacttggctggtggtggaaggtgccttttatgtggagtccagcgtgtcctgccagggaagaggaggccatttaaaggcaccatgctgtcccagacaccaggcttggacgttttcccaaaacaactttagaatgaggtcaaataggcttttcatttcactgtgtataccaaaggttatgactgactctgaagatatatatgtaaagatgtctcctttctgattttatttctggaaggaagatttcaaaaaaattttaattgcttcatgtttgaatcatcattctgtatttttttccctccaggggatgtttattttatcagagtcaaaaccaaacttatttctaacatcgtcctagtaattttttcttcttttctttttttttttttgagatggggttttgttctgtcatgcaggctgaagtgcagtggcatgatcttggctcactgtaagctctgcctcctgcgttcaaatcgttctcgtgtctcagcttcccgagtagctgggactacaggtatgtgccatcatgcccgtctaatttttgtattttagtagagatggggtttcaccatgttgaccaagctggtcttgaacttctgacttcaagtgatccacccacccaatctcagcctcccaaagtgccaaagtgcaggcatgagccactgtgcctggcgtagtcattttttcttttaatcttcttttttgtttttaaaattgtaaaaa

SEQ ID NO: 111578 - DNA, 1063 bp, Homo sapiens
tttaggatattaatgatgttgttaataatattgttacagttggggtcagtgccagccagcaccaagacagaacaaggccgtgggcactgagctatgtctgatgagatgatggggaatgtgttatgatttataaagacagataaattatcactgccctttcctagtaattgatattcaatatctgccacaagaggagttttttgtttgtttgttttaatgaatgatcattcaaagtagagagctaacatggagaatagtctggttagtgtgggaagttctgtactggggttattaccatttggattttccttggaagtttctaggtgagttttgattaggacatataacttcatcaaaggttaggtgatcggattgcatataaagctgctttaagtattaaaatagaggcattttgacttggattaccagtgaaaccattttgggcatagtcttaactgtatgtggtgtgattgagatgtctgtgggttgccatgtaactccacagtttgcttttatgtgtgtgattgtgagtgggaagggtggagtatgggcgtttggcatgaacagatcatacttcctgacatctcttctccacaagcattcttttccaggtgacagagactagaacacatttcaggagacactttaagagtgaaaggtgagaggaggaacggacagtggagaggtgtgtgctgcgcatgactaaatatttccttcccgtttgacattactctcccgggagtccttaaaacaatattagtagaatctttattttaaagtttatttatgtgggtcttaaggaagacctaaagtctccctttattttttttttaccttcaagtggaaattatttcacatctatgtttgatgtggtggtgggtaaagcaccctggacttagagccaagagaaacggattcttgtctgagctctgctgctgaatagctctgtaggctcaaaaacatctctgccttactgggcagcagagtcttcatctgtcttagaggttggcaaagttttcctgtaatgggccagatagcaaattaatttaggtttcccaggtta

SEQ ID NO: 111579 - DNA, 1032 bp, Homo sapiens
caacttctggaatggaagaccctctggaaacacagagctgtgtggttgcaggaaatgggctctttgcatgataactaactcatcttcctctctcccccaaccagatttcctgctgaggtaagtaatgtggagtgggttttttgttctttttcttcagccttctgttccttttgtgtatgtctggccttgtaaatatggtgaataaatgctataattataaccctttttgacagctctgtaatttaattgtaattcattctgagcatctatttaagacaatgatgtgtattgaagatacagctgttccaatctcatctgctaaactgacaggcatcggttggaatcatagtcccagtaactgtaggaacttccgatctattcaagaccaaatagagggatacactctctgtggggtgtgtgtgtgtgtgactgtgttccatatcctggtttggcaaaagtggtaatgtagtatttggagagaagcggcatttaaaatcggcctttgcaaaaatatgaaaattattctgaagtagaaaatgtcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaagaaaaaaaaaaaaaagaaaatgtctcaggtttactttttgcagaaagctaagctgaatatttttgattaacattcagaggggtccctctgtaaacctggaattgattcctggtagcactggctgggggtcattgctcatcagatgtccgagtttcctagggatgccctaacaaagtaccaaaaact

SEQ ID NO: 111580 - DNA, 1050 bp, Homo sapiens
ccaccatgcccagcctagaaattttcttcctatgactgcaaataatttcagtcccaaaggcttttagatgattgcaggaagaatctcacaagaattatttatttcataatgatattgttcttctcatttattttgggctataacatagagcaatacatttaccatctttcttgctatttggccaggtagttgcagagtagcctgttgtgccttttgaccttcaatgccctgaatatagcttacagaatgtgagatgttatgaaagaatctataatgggggacctcagaactttctaactggtagatgaattgaagatggactcatctaattgaagatgaataacttgcctcttccccaacccccagttctcttcttaccttacttttactccctgttgcaagagggagtttgaatataattcaagaagatgctcctagtaacaggaaattccttcatttgaggattctggtgggctagaccacagtaggttatgaagcaaatttgagaacagtaagattaaggaaatggaatggagataactcaatgtgatagaaataacagtgaaatgaatattaggttttgttcgtttgtttgtttgtttgtttttgagacagagtcttgctctttcgcccaggctggagtgcagtggtgtgatctcagctcactgcaacctctgcctcctggattgaagcgattcttgtgcctcagcctcccgagtagctggagattacaggtgcatgccaccacacccaactaacttttgtacttttagtagagatggggttttgctacgttggccaggctggtcttgaactcctggcctggagagaacagtcaaattgttatttcagcctcccaaagtgctgtgattacaggggtgaggtaccatgccctgctgaaatcaatattaggaaaacatcctggtcaaggttatgcaactcatgtgatcttggagaagtatattcaccttttgtttagtaagtgttcattgtgagcattgggtcactaggtgatttctcagataccttctagcttaaagtcccatgatt

SEQ ID NO: 111581 - DNA, 1017 bp, Homo sapiens
accaaaaaaaaaaaaaaaaaaaagaattccaggtgagggtgttactgttgttatgagggaagcagctagtgtgggttgcggagaaatcggagagaaggtcagacagatgaaggcaccagattgaggaggacctgaaaagccacactgaggttgtggagttttatcaagaggacagcagagaacatctgatgatactttatgtaggttagtgaaaagtatattgtgatagaagaatgatgggctaaaacccagaagttaaaggttcctgtttcaatcctgccatttattaactaggagaccttggagtcatcatataaaatccttgagcctatgtatttgacaaacgacaagtacatatcacagagatgtcatgaggataaagtgagaaaatagttgtgaaaaatgttttgaaagtcatacataaggttctccacaaatgtaagaaattgcaatgatattataacagtggtgatgcaggaagattatgcttgcaggcataaacaaaatgaattgtaatgggggaagttaaacagcagagacagctcgtttcagtagcacagtggggtggtttgaatgtatgtgtttctccaaaattcattatgttggaacctaatccccaaggtgatgatattagaaggtggggcctttcggaggtggctctgcccttatgaatgggattcatgccctttttgcctggagccccttttgcccttccatctcttccgctcttcgaggacaccatgtttgtcccttctttgcccttctgccatatgagaaggcagcaagaatgggtcatttgtgaggaacagggctttcgccagacactgaatattctggcaccttgatcttggacttcccagcctctaggaccataagaaataaatgtttattgtttataaattacaaaatctaaggtattttgttttagcagcctgaatggactaagatacgtgtgaatgaacggaaaagggcctctaccatgctatgtatggattaccaactgaggaataactcaag

SEQ ID NO: 111582 - DNA, 1006 bp, Homo sapiens
aaattgatagtaacatttcttccctcctgtccccttcttcccactgcccaaccacccagcaaaagtaaattttgtgttgtaaaagtctaaaatgccatcttaaatagtacagtgttggagaacactttgctaaattatacttctatatggcagttgttccggaatatttcccattagcattgcagacgtgctctgtttcactacattgttaaaattgcttctatcttttaggccccatctgtgtaccacaaaaacattcacatcagcagttgttatttatcaagaaaatagctgctactgatgaccatgtacttaatccagttgattctgtggagataaactgctaatactgccccagcatcataaactgaccataaaatagtttatctagtggttgctaatagacatatgctcaggttttcataatggtcatgcaacataggattgtaaagctttgagaacttgcttttttgacatgagagatcttatatttgagattatcaattggggaatcaaataagagtataactccttacctagtttataaaattttatttcctactaatgtcacttaagtttgccttcctgaatgtaggatgggctaaaatgtaatttctgagtcttttcaggaagtcaatgctagaaaattgatcaagtaccacagtcaataataaaataaccattaaatacacttttaaatttatttaagttttttttttttttgagacggagtctcgcactgtcgctcgggctggattgcagtggtgcgatctcggctcactacaacctctgcctcccgggttcaagcaattctcctgcctcagcctcccaagtagctggaattataggcaccagccaccacgcccagctaattttttttgtatttttagtagagacggtgtttcacgatgttggccaggctggtctcaaactcctgacctcgtgatccgcctgcctcagccccgcaaagtgccgggattacaggcgtgagccaccacgcctggcc

SEQ ID NO: 111583 - DNA, 1045 bp, Homo sapiens
cattttaccactgggacagaggtctagtatgatagtgctacttttcagaaaaagccattttgtctgtgtatagttaccattcaaatagcctatatctcttagatttgcattaagaacctcatagagctttaagggagaattggagcaattagatgaatgaattatatttatttttattacttgttataggtttggcagttctctaccagtggaccaatcttttcatccccgtgtacctcaccatcagagcaaaaaatattttttggttcccatgattgctttatctactgttgtaacatgaaaggtcacctgcagtggaaatttgaaactacttcaagggtctatgcaacaccgtttgctttccataactacaatggcagcaatgaaatgttgctggcagcagcatctactgatgggaaagtgtggatcttggaatctcagagtggacaattgcaaagtgtttatgaacttcctggagaagtcttctcttctcctgtggtcctggaatcaatgctcattattgggtgtagagataattatgtttattgtctggatttattgggtggcaatcaaaaataatcaaatacagtccttatttgtataacaaatgtgagatatttgaaaatattttaccattatacatcatgtggacttattttatattaaagaagattatattttggctaagaaacggaaacttgtctacacttgattagagaacaactatattttacttcccataggaacgacagaagcttttacaaggagttagagaacaaaacacatcaatataattagtagcacttttgtttaattaggtgtgatggttaactttatttatatgtcagcttgactggctaagggatgctcagatgattgatagctggtaaaacattatttctgggtttgtctgtgaggctgtttctggaaaagatgattagcatttgaatttgaatcagtagactgagtaaagaaggtcctccctcaccagtgtgccaatgtgggtggcatcgttcaatctgatgagggcctgaatagaatgaaa

SEQ ID NO: 111584 - DNA, 1034 bp, Homo sapiens
gagactctatctcaaaaaaaaaaaaaaaaaaagaaagaaaattcacctcattagtctaataccataagcatagaagcattaaatttcaatacttagaagaagagtgagtaactgtcaggtgtagttgagccttggaacaggtattaactatttcccaagcttgtgtggtctgggaagaataaagcattaattaagtcttaatatcttaagacctttttaacttcattaccaaatttaccacaaataagtgtgctactcagagttttggaattaaagaatttaggattatcatcttgacagtagaaaaaaatgacgaagatatcaataagatgttttaagacctgattacataaaaattaaaatgttatgtaagaattatgaaattaagctgggaaaatttttgaaataaatgtaaaaaaagtggaaattcatttatatttataagtattaatgaaaataaagatcaaatacaaattaataagacaaatgtagagcagatagaaaaataaacaagggacataaatacacaggaccccaaagaagagacggctagtaaatgtatataaatagttcatgaatttaataatcaaaggaatgaaaattaaaaactcttgagataaacaaatggtgttagattagaagacatattcatcataacattaaatgctgatgagagtggtaagaggttgtaactagtgaggcctctaatgaaaacgatttgaccataggtaacaatatcatatccttgatccaataaaattcgttttttagaaatcctggcaaaaataatcagaaacatagtcaaatatatgcattaagatgcctatttctaagttgtttataatacctagaaattccaaaaaacgttcaatgataaggtagagagagaaattatttatgttcatatgggatattatggattaaaattatatttaaatcattttacaaaatcagtgagcaaaatatgataccaagttatatattcagaatgatctcagctatattagatcgtgtgtgtgtatatacacatattc

SEQ ID NO: 111585 - DNA, 1693 bp, Homo sapiens
ttaatcaagaggaagccagtggaacatctttacatcagaaagccatcatgactttcacttgccacaatgagattaatgcttttgttgtactgagcagagggagtcaaattttgtctctgaattccactaggtttttaacaaagttaggacattgctcttcagcctgtccttctgactcagtttcacagaccaacattcaaaatttgaaaggcttaaattctccagttcttattgggaagtcaaaagatccatcctgtgttgcaaaagtttctgaagaggggaaacctgcgatagggactcagaaaatggagttacatgtgaggtggaggtcagacacaggcaaatgtgtagatgcttcaccgctggttgtaatacccacttttgataagtcatctacaactgtgtacattggttcccattctcatagaatgaaggcagttgacttttactctgggaaggtaaaatgggaacagattttgggagatcgaattgaatcctcagcatgtgtatctaagtgtggaaactttattgtggtgggtaagtttttgaatttgaggtttgtggagttaaattgaattaccatacaataatcttcataggcccaagttaaattttttaaaaatctaaatatgatgggtttggttgctgtccaaaaattatagttaaccctgtgctgattaatattgtgggccttggggtcaagagtccctggatttgaacctacctgtatagctattatgaactctgtgacctttggcaagttactgaacctcttagaatttcactttccttgtgggtaaaatgggaataataataaaatgtgttgctgtatcacaaataccccaaaactcaacaacctagaacaacacaaatttattgtctcatagtttctatgggtcagcaattcaggagcagcttagctggcagttctggctcagggctttcacgtggctatagccatctgaaagcttgacttgggttggaaaatctgccaaggtagctcatttacatcactattagcagaaagcctcagttctttgctgattctggcaggaagcttcaattcttgccacatacgcctctctctaggctgcttgactgcccttacaacatggcagctaacattcctcagagtgatccaggagacagcaagtaaagaggaacagagtaccttttatgacctagcgttccaagttccataccatcattttttgttttcttctgttaattagaagggcataactcagccaggcgcggtggctcacagctgtaatatcagcactttgagaggccaaggtggacagatcgcttgtgcccaggagttcgagaccagcctgggtaacatgcagaaactctgtcactacaaaaaatacaaacattagctaggcatggtagtacatgcctgtagtcccagctacttggatggctgagatgggaggatcactagagcccagtaggttgaggctgctgtgagtggtgattgtgccactgtactctggtctgagcaagcagagcaggactctgtctcaaaaaaaaaaaaagtgcataactcagttcaggccacattcaaggggaagagaattaggctccacctcttgaaaggaagtacatcaaagaattcatgtactttttttttttttcttttttttgagatggagtctggctctgtttcccaggctggagtgcagtggcg

SEQ ID NO: 111586 - DNA, 1020 bp, Homo sapiens
ttgaagaaggcgtgtgtgctgctaagcagcagcctcccttctgttcttcagctctcaagagaatatcccttgtctccttccctaacaggaaacatactagagaggaaattccggggacagtagttcaatcaaaccaagttgacacatcaaaagtcatcacagatgataaaatatgtctggtaaaacgtggatattgctttaaatagctgttaattcttttataaagaagatttcctgaattttgatagcaccattttggctaatttaagagagaagaataaaatctggccaacattcagaaacttgatcatcataaacacatgaacactcttttaggatatgtgcttactgaatgtttgacgtttctcataactgcattctgttttgccttagggtactttttgacatcacacaagaagatgttttgtttctggcttcacctctgaccttcgatccttctgttgtggaaatatttcttgctctatcaagtggtgcctctctgcttattgtaccaacttccgtcaagttgctcccatcaaaattagccagcgttctcttttcccatcatagagtgactgttttgcaggtacattttagtagcaatgaacgttttgtttatcatttttcaatattttaagtgttttagagaatattttgtattcctgtagttctttacaatggattaatataatctggttagattatcaagggccgtctcctcaggatgtgactttttttgttgtttatttgaaaatgaaaaaagataaatgaattctgcctagaaaattcttttattatgtattttgtgcatactataataattagaggaccttgactttgactcagatttgttggatttgagaaggataggctgcctcttctgtcttaaaatctatgtatgttgtgtttctcatgaaaaactagtataagtcaattaaattataatcgagttaggaatatagattttcttatttttacatcagtgtactttacattaacctacagaaacaagtatttttg

SEQ ID NO: 111587 - DNA, 1029 bp, Homo sapiens
attcagtttagcatctcttcatccaaactcacttctggattaattcttctccatccaccaaatcacctgggccagaaacccaacaattttcttagactcactctatatccagaaagtcaccatgtcttatttattctttgctcatagaccctttctaaccactcctcttgtaacagaatagtagttcaggaccatatagtatatccgaattactgcaaaagactcattaaatggttctcacttagcagaatctcatttattattctgtccttgatagagtctaatctatgctattgccaccttcaattggatcctgtcacttacaggttaagatctaaactccttagtgctgagtgtacacggttattaaggatttgcatctcatctcctatcaacaacgcacctcaccttttccctctcccccaccccgttctttaccttaattggaaggcttaatgttcacataccagctttcccaggtcagatcctcaatgttggctgtttgcctgaagtgcccatttttattatttggagaatagctacttataacaaatattacccatgaagcaatctctgaccttctaggcagagttcggcattctctgttcccattaacatttcaagcctgctttattatcatacgcattgcattataattgcttgtatatgtctggtgtttttgaaaataagttagtaaggacagcactttgctcttggagatttatttatctttttacccccgggtatacagcaagtacttccccccactccccaaaaacgtcatgttgaatgagtaaatgaatacagttggccctctgtatccagaggtttcctatccgaggattcatccaactgcagactgaaaatatttggggcccacgcctataatcccagcactttaggagactgaggcaggagatcatttgaggccaggagtttgagaccagattgggtaacatagtgagacatcgtctctgctaaaaataaaaagctagctgggtgttttggtgcacacctgtagttccagct

SEQ ID NO: 111588 - DNA, 1027 bp, Homo sapiens
atctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaatttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaatatgtgtgtccttttttttttttttttaaatagtgactttagttagtgctttatggtaaacagcatggagacaacttccaggctccattcttggcaccagctagtcatatcttatttctctgatccaggcatttcaataaataggccatctcttatgaaccaggcaaaactgctggttgactatgagggacaaattaagtaattagaaaagcagtactaagtaagcactacat

SEQ ID NO: 111589 - DNA, 1710 bp, Homo sapiens
ctatattatcataaaaactctacatttaggcaatgtttccaccatcttatatagatgaaaaaatagacttaggaaaactgagtgaacttgagcttaactttgagcctagatcttcctgactttaaattccattttttcaattaagaaaattactcccaaagccctctaattccattctagacttgaagcctcctctgctgttttaaattatgttatcccctagattccaattaaaatttttaaaaataaaggaactgagttttattgattttttttccttttttttttttttaaagaaaggctaaaggagaaatttatcctagcttaaattattctgtttgtaactattctctgttgacgcgtttcttcctttctaaaggaattcttattacatttttatttttccctctttctttaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagattttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtat

SEQ ID NO: 111590 - DNA, 1151 bp, Homo sapiens
atattcactaccttggatactttattaacttctaaaagaattaatatgcatacattttagaaaagattaccttgataaatgggttaattacttcctatccctaaaaagtatctcattggtctactggtttttatttatttattttaattcatttctttaaaaattatcattttgataatgaatttttctgacagtgatttaatctttgtcatgtcttcatatgcttactgttatctttcaaaacagaggaataatgtttaagacaaaaacattatgagtcctcacaaaatgaattggtttttccaccaagtatattttgtttagtggtttttctttttgccttttttccaaataataaaggaaaattattttgaaattttacttgaatattgtggcggcaacacaacctagagaaaatatttgcctattctgtatattactcctcattatcctttcatttcttctctatcagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtaagtaatattaaaacatatcctaaagcataagttaacaataagatactggcataaaattgcaattcagggtagtgaatcaaaatggatgttcaatataataaattaactttttttatcagtttggtttaggaataactgtgtagcaacttgaagaacatgtcacagccacacttacattaaatgtaatccttaatagattaaaaaagctcaatataaaagcttaaggctgggcgaggtagctcatgcctgtaatcccagtactttgggagcctgaggtaggaggttgcttgagcccaggagttcgagaacagcctgggcaatatagtgagaccctgtctctacaaaaataaaagataataataaaattaaattttaaaaaacctaaaatttttacaaaatttattcaaagactaactacacaaaataggctgggcacagtgactcatgcctataa

SEQ ID NO: 111591 - DNA, 1030 bp, Homo sapiens
atgaaaatagagacttattttagaaaggaagaacttcctcaatgagagatagttatgacagaaaaatgtaagccaggagaaaatgttttctttatactttattcttttaaaattcaatacaacttagggcccttaattttttaattctatactagaacttagtgtttacagagagattataaagaaatcattgcaggagacataccactttaaaaagtcacttctagattttatattgaatgaatcaattgtttctctaagggaaggtactctgtgtgctttataattaatattttcatcagccttaaggactagtttattaaaagtcttctttctttaacattgtttcccaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaaggtaagtagatttcttttctttgaacattcatataaatgttttagctatctccttgaaacatggcaattcttgcctcaaaggcttacctggctctttgaaggcatatagttatatgttgtggatataggactgagcccacaagtcataagatcactatttttcacttccttttgactcttggattttgttttttgttaggagtaaggattatgattttctagatctatatgaaggtcgattttttttttaaaaccacacagttgagttccccagtttgtgtattttcacattcatatttttgtatatattgcatttctttttatactcaatctgtagaattctagcactagttttttagaataacactgttatatcatgctaagtaaaaatactctctctccttttccaaacacaccagaccaaatggtttatacagtaagataccgttgtggccagcagctagcgattgaagcacctgtggatgcagatttggttagcactgttccagaatctgctacgcctgc

SEQ ID NO: 111592 - DNA, 1168 bp, Homo sapiens
gcaggaggtgagtggtaagtgaaacttcatctgtatttataggtgctccccatcgctcactattaccacctgagctctgtctcctgtccagatcagcagcagcattagattctcctaggagcatgaaccctgttgtgagctgtgcatgcaagggatccaggttgtgctctccttatgagaagctaatgtataatgcctgatgatctgttactgtctcccatcacccccagatgggactgtctagttgcaggaaaacaagctcagggctcccactgattctagattatggtgagttgtataattatttcattatatattacagtatagtaataatagaaataaagtgcacaataaatgtaattcgcttgaatcatccccaaatcatcccctgtccctggtccatggaaaaattgtcttccaccaaactggtccctggtgccaaaaaggttggggactgctgcattagtgggatgcaggatttttgtaactggacatccacagaatgccttattttcattatggttggctactgggtttggggtggggtggagcttcccctctgatgattaaacttctctttttttctatatagcttctgcgtcatggtattggtctgtctacaagttctgatagtgaaatgattacccagttactggcgtatacccctcctcaggaacaagatgacaccccagactgggtagccaggtaagcagagaactggactaaacttagagctctagtaaggagagttttgccttgcatatgtttataactgaagttattcattcaattatttaattaattccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaaggtaataaactttagaaggaatatcatttcatagtgtttttccattattgtcctactgctatcaagccctgaaatctttaggtatagaaagttgatgggtgggagggagctaggtaagaaaaataaaaataaatgtattcttcctttttaaagtacgtttctttgagtactcctgaggatgagtccccccccttttttttttttttttttttttt

SEQ ID NO: 111593 - DNA, 1043 bp, Homo sapiens
tcaattgtattctgatagtacctggaggtaaagtcaggttccagaagttaagggctcagtcccagaagttaagggctcagtcccacaagattgtcccgcacttcagatgccagttgcaagtccaggcctttggtacatctgacaaccagttataaattgggagttcctgcaacagccctagcactacctttggtttcaaacatcacaaaactcaagaaagtgctttgtatacatttaccagtttattataaaggatattacaaaggctacagaagaacagtctggtgaaaagatggaaaaggcagggtatgtgggaacgagtgtggagcttccatgccctttccaggggcaccaccctccaggcatctccaagtgttcagctatccagaagctctctgaacctagtcattgtggatttttatggaggcttcatgaagtaggcacgaatgattaaatcatcagccactggtgatcagctcaacctttagcctttgtccccttccctgggggtccagggatgaagctggaagctccaaccctctggttgattcccctggcaactagccctcatactgatgctgtgcaggagcccctagctaccagtcatctcaacagcatacaaaaggacacctatcattttggcaattctaagggttttaggagctgtgtaccaggaaagaccaggataaaaataacatatataaatcttcttacatatcacaaaagcataaaaataaaatggagtataaacttgaagatgacatgaaaaaatgaattggaaacaatgacaggaaactagaatatgggaaaagggacggagactgtttacttaaactcttggttcacagcatgttgtttggagctttctgtgctaatgatgtcaaatttgtgcctatgctttcattcatcatttcatctttctttttttttttttttaactgcctgtctttatattcattcctagtagcttccttttatccattcaggcattcattaattaatgttgagtttcttcagtttattagctcccaataaccttgact

SEQ ID NO: 111594 - DNA, 1023 bp, Homo sapiens
accaactcaaatagggggtcatttatttaaatgctttaagatgctttgatttttttaatgcaaattttagtttttatacttgacaaattttattgcttactacatctgttcttaaatgttttagtgaatagtatcttatgaaacacaagtgcttcaacattgtgaaggtattaaatgccactaaattgttctttttagaatggttaattttatggtatgtgacttttgcctcagtaaatttttttaagtaagtgcttcacagttcttacaattaggttatttgtttttgacttttttttagattagaattctgaaacacagagatattaaatgtacttctttgtcttatttggattggctgggcagagaagagaggcgtttattactagcagtactagtctgtttttttctaagttgcactttttgatttctcaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaaggtacgtttgtttgtttgttttccctaggcctttttaaatgattaggatgggttaatgaataaaagttaaggatctttgtaaagggcattttctaattgttgctacctgttacctaactgcaacaaacaattgcatcagaatgatctggagtacttgttacaattccagattgtaagctatcccctagagttcgagacaagggtgagaatatgcattttagactcactttttgaatgcactgctttagagatttgggagagttgatttatggatggaagcatagagaaattagagtttatggacttgctatctctttaactctgttgctatgttcaaagcttgtatgagataagaaaaatcaagccatttttcctattctc

SEQ ID NO: 111595 - DNA, 1055 bp, Homo sapiens
ctttatttctgttattattacgttgtaatatataatgaaataattaaacaactcaccataatctagaatcagtgggagcccggagcttgttttcctgcaactacatggtcccatctgggagtgatgggagacaatgacagatcatcaggcattagattctcataaggagcacacaacctagatcccttgcctgcacagttcacaacagtcttcgtgctccagtgttctaatctaatgtgagaatctaatgttgccgttgatctgacaggagtcgcggagctcaggtcataatgtgcatgatggggagtgtctgtaaatacagatgaagcttggctcgcccaccactcacctcctgctgtgcaacccagttcgtaacaggccacggaccagtaagggtccaggtgttggggacccctggtctagagaagacacttggttacttcaagcttccacagagccttacaactttgatttcctgaatcctggtctagaactcattcagtttatttcatgctatcatgtcttagtgtgtatgtactgtatctcaatcctttggtttaaatatactttaaagacatttatgatgggtctcagagaaatgtactacttctaagaaagtctcatgtattttatatttttctaagttcttcaatgccctttttctattttactcaattttaccacaattagtatgaaaatttactttaacttctgccatctggggttgcatatttgctttattaaaattgatctattttaaactttattctgggaatccagttttatttcctcctttttgtataactgtactgtttctattctggggaagatcaaatgtatactaaatctgtttcataataaattcagctagcttgtcaaatagcatgtaatgaaacctatttaacttacatatataatattcctcttatggtactgaacattctcaatacaggttgagcatccctaatatgaaatctgaaatgctacaaaatttgaaactttttgagcaccaacatgatgctacatgtggaaaattatacacttgacctcatgtg

SEQ ID NO: 111596 - DNA, 1394 bp, Homo sapiens
tacaaggtttagaaaaaagttgaaactcttggcttaaattaggtacctatttttaatgatttttaagggtcatttgagcatacaatagtgtaaggatttcatttttaaagagtttttctcttgctaaatgaaaatgcaaagaggaatgtctagaattttttttgttaatgtcaattccaaagttaccatgtctccatttggcagttctgagagttggttttcttaggatgcagtcaacttcttcataaaatctcatttttcttggagggttgccattttttctttgtaaaatgctatattcatattttacatttttatatttcgtatgacattgtttccggtctctgtctatcccaaactgcattaattaatcttctggcaatttcctcaaatattttcttgtttcttgtggccccttcaagcattcgcttaattttttcatcagaccatatcaatgctctgacctcactgtcacaccagtattttccggcctctgtgttactcactgttataatctgtaaatgacttttagcatcttctaaaggattacctacaaatcaacatgatttataattattcaaacatagataaatcttgtatttgattatcattcacttaaagcaactgtgatggcataaagtaccaagaatacaataataacttcaatatgagtcaaaagaaattttgtgtccatattcaaacagtatattctaaaaattataagacagactgttctcattattagtgagaaaatttagctgcttttcatcataggtgatcttcactggatatttgtgaatatggaaagtcccagtgtttactaaatttcttttagtgagaagtgggcatagacattttccttctttctctactgtattctctaccaactcaggtataaggaagcattttaggtaatacacaatagagatcttctctgttagacttcatatatcaaaatgacatttaaaatttaccaatttagaccctgcagtggacccagtattattttggggtgatgatgtgcagcagggggtgacagggggaaggcatactccacaatgctttctaacagtgagttcctctcatcttaaattctcctaggttttaattctgaataatttttcagccttatgaattttttttttttttttttaagagacagggtctcactatgttgccgaggctggcgtggacctcctgagctcaagcgatcctcctgcctcagcctcccaagtagctggcactacaggtgcctaccaccatgcctagtgcctcatggaaatttgaaaatgtgtttaaatcactcttgttggatataatttttaaaagatggtgatagaaatgtaaaatggtgaagtcatggtggaaaacaggtagttcctcagaaactttca

SEQ ID NO: 111597 - DNA, 1037 bp, Homo sapiens
aaagtgctgagattacaggcgtgagccaccatgcctggccaaccttatctttaagaagatggaatctagaaggtgagatttctatcacttttgttttgtatttggtccagttttttgtcttgggtataatctaatctgaaacatttagtcctggggttaacagaatacctggaaggtatattagccatttcatataaaaataaatagagtatcaattagttaagccagtcatgcactggatatttaacccagatgggttcatccagatgtactccccgtttttagtagttctggctgtcttcagatttattccgtagctctgctttctgtaggggaattttcacatgtcctcttagctgtaaactgtgcatgcatgtgtgtgggtatgttcatgcctgatttatataatcaccaaatgctgttttggtcctgaaaacatcatttcagtagtttgcggagttctgaacaaaccagacaccccttcttagaataaacattttcatctttaaaacacagtcacattttatggagactagaatggcctggacatatttgaagattccataaaaggaattagtaaatgtctgtagatttatgccatgaatcagctaattagcctttccttgattaggagataaccatgcccttccattcaatgaattatcacttctcctggttaggaattgaaccttacaatgacaaacattttcatacttctaaaaatttataagatttacctgatgaagttgggttttctgtctgcagaaacattctgtagaatcttttggttctgttattacgctttgaggaaactgatttgtaatgatctcaggagcacttttcttaagagatttagacactggttctgcaaacagagtacagaacattaccactggaaaggcacttgtgagaatgagagatgcactcagtcagacttatatggatctagttcccagttaatcttcatttagttttgtggagaacacaggatttgattgtcagagaacttactttgggctgccaaattaaggcaggga

SEQ ID NO: 111598 - DNA, 1235 bp, Homo sapiens
agcagggctgagctggccacgccacctagggacagcgcgcgccgccgcagtagctggggccaccctcgggaaggaagagcctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggtgagcaacagggtgggggtggcgggggcgtgcgtctccatctctcggagccgcttcccgcagtcggcgttctcatgagcgcccgagggcccgggaggaccgacctctccgacctaagccagtacctgcctgtggcgtcgaccgggttgcctaggcgtgcacgaggggcacctcgcttccatgaactttagcctgtcctgcccaccctcccagccacttatgccttttaggggctctctccctccccgccccccggtgtgtgcacccatccagaggctggccagcttgtaaaccgccggtttgcttggtctagctgggtcagggctcctccccgactgcaggcgggttctagtctcccggagcctgtggctgctcctgtaataggctagtgtggcgtggcggccagtccaggtccttcaacacctaaaggttttcgcgcggggcctccaaccaccacaagcttttgtttgcaagggcagagctattgagcagattatgggtttgaaagtagttatcgctatgggaacttgaggatgctagacttcagacccagggaaagatgactagttgatgttgagaatgactactggtagtagatctcacataaattaaatggaaataagccaaccatagggaacagtgcatctggaaaagattcattggtagacgtcttgcctaatgaatgaaaacgttggtaataacatgacaaaaattaactcccttcttcaaaagggggacaggggagtagtgtctctatgccaagatccatacacttgattttgaaaaattgggagatcctttcgagttaaaaaaaattactttgcttcggtgatctttccttttcttactacctgacttaactggaagttgatataaattattacactaggataagaaaaacaaacctgggtttgatattct

SEQ ID NO: 111599 - DNA, 1046 bp, Homo sapiens
tatttgctgcacgtggaaatctccgttattttccagcacccaacagtagcgtaatgggagtaacggacttaacctcatttctctttcagagcatttagccttcatatgcccttccctgcatgcttcccccaggccgtcaagacttggtacgctccaacttctgagtcgctcccgcagccgagaaggggccggggtatgcgagcttccgcagagtggggaggggccgccagtgcgcgccacttttcgcctgtccgggcactgcgccagcgcggggcggcccggaggcggggtcgcgtctctgcgcctgcgcggcgggaagccagtggggcgttgtttcgtccgatatccgcgtttcagtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgagggtgagtaacagggatccgggcccttcacggtctccctgacccccaggccgtgagctcgcggccacgtgcgagccgcgaaactctgtcccgcctccctgcagcagcgcctctaggcagccgcgcgggcgcacacgtggcccaggcgctcccgggcctccccgaactttactgcctcggggatggggagaaggagcaaagtagaggagaacgagaaatggccaaggggtggaaaggtgcctggaagtattatttataatcaatagctattgcaaaatacaagcaaatcagtcttgattcgtcaaaacctgagtcttgctttgcccgttaggttaatgacctttctaagaaggttaataattgaaacttttgaaagacctgtctagaggccgggcctggtggctcacgcctgtaatcccagcactttgggaggccaaggcgggcggatcacctgaggtcagtagtacgagaccagcctggccaacatggcgaaaccccgtctc

SEQ ID NO: 111600 - DNA, 1086 bp, Homo sapiens
actatcttaaatatcttgcatctttgcccactactctttccttagaccaagacatttctttttcttttcctttttttttattgagacagggtctcactctatcacccaggcttgagtgaaatagtgcaaatcttggcccactgcggcctcgacctccccaagtagctgagactacaggcatgcaccaccatgctgggctaatttttgtttttttggtagagatgggattttgccctgttgcccaggctggtcttgaactcctgagctaaagcaatctgccctccttgtcttcctaaagtgctgagattacagatgtgagccactgcacctggccagacgtttcttgttcaagttactgcaacagcatcctaactggtcttccaagctctagtttttgttcactcaccccttcctcccttcattgtccatacagaagccgtaatgatctttccaaatagcgttttgctttagcacttaaaagccttatagctcttcttgggttaaagtctaaactcaatcagcatggcttgtgaaacaagaaggatgtgtagcaaaatggaagggaagttttccaggcctaggaaagaagagattgtcagaagctaggggaagattgtataagaattaaagatgttggagttctagataggaaatagacaaataagagtttggagcagtaagccagggctgtatcttaaagggacttttaaaccatgttaatgagtctagacattacattagggagggtagagattcatcctctaaattaggtgccctacagtggcaactgttaactaaattacaactactttgtttaatggttacctccactagctggtgatgtggcccctgtccaactcttaagtcttgtctcctgccattctttagctgcagcccccaccccttcccctgcccaacagcaatgtacatatacccagagctccagctccaaccagactgaagttctgcaatccactttgaccaccttgtatttattcatcaacactacctacccctttctctcctttggctaaatttcgatgattcttcagatttcaacctgtcactttcttgtagacttctttt

SEQ ID NO: 111601 - DNA, 1067 bp, Homo sapiens
ttgcctacaaaaaagcaaatatcagcaaaaatcgcatattttttcctgcaagatagtttagatactatactgtgagtgtgtctgtgaaaatactagtatagttacattactttaagtgggtcttaattaattttaattctagttcagttctgctatgagaggcaggttaatagtggaaagagcacaggatttgatgtcagaggagttaggattttatctacctcttatatttcctaactgcatgaccctcaacccttttgatttctgctttactaatttctacaattatttatgtaattaaaattcttcacaagatcatgtgaatcaaatgtgatggtatgagaaatacattgtagagtatatggttttatacagatgatttaatttttattaatattacttaatcactgtatatttacagattaattgttctaggtgatttagtcttcagcattcaggaagtttctgaattttggtctatttccattttatttccacagtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtaagcagctccctcaaagtctcttctctcaccttctctggtaagcatgtcgatgtctttcatgtgaagttggcattaatatgaacaacttgtttgcagatgtctcaaaagctaagtgaatttaaatcaaaccaagaacccttaaacttcactataacaccttatttggtttgggattattagtatcattgaattaaaaggaatcttaacaagtttgctgtaatctttatctggcacatgcactctctgtgcagcttacctctccaaggccatcttcactttaaggaatttaactatgaaggaaacccattttaatgttaagcagttctaacatgaagaactgaaatttactccctgtaattctataca

SEQ ID NO: 111602 - DNA, 1302 bp, Homo sapiens
ctcttgaactcctaggctcaagcgatcctcctgcttcagcctcctaaattactgggactacagtgtgagccactgcacctggatcaaaatttcttttcttttttttttttttttttgagatggagtctccctctgttgcttaggctagagtgcagtggcgctctctcagctcactgcaacctccacctcccgggtttaaatgattctcctgcctcagcctcccaagtagctgggattacaggtgcacaccaccacacccagctaattttttgtaattttagtagacagggtttcactgtgttggccaggctggtctcgaactcctgatcttgtgatccgcccacctcagccccctaaagtgctgggattacaggcatgagccaccatgcccggctgtggctaaaaatttctaaggagttcatgctcaaggtgaaaaggatgttggtttttctgaaaagtttaaaaattttagattgaagttaattgtactactatactttattcacaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaaggtacagataaaacaagtacagataaaacaacaggatttgaaagtaaaggttatagttgagagatgctttcataaaatagtttttgaaaactttgttgacatgctgtttccagattgaatttggtgttgatgtaaccaccaaagaaattgttcttgctgatgttattgacaatgattcctggagactctggccatcaggagatcgaagccaacagaaagacaaacaggtagataatgcttcaggtttttttatcctttttgagatcaagctgagatagaggagaaaggagagatgaggggaaaaagcaaattattgttcctaatgatatgaacctgttttgtggattgctgtttatttttaaagataaatgtctctggtatcctaatagaagaataataggaataatactttacatttataaagcaaatttctcatctgttatcttaataacattgtcacaacagtaacagcaagtattatctttgtttggctaaatgaaaactaagggtcttaagaggatgggtatcttcacaattactagagtcagggacagatctgggactctattccaagtctcctgcatgttaccaggccacatttctgctcctatataa

SEQ ID NO: 111603 - DNA, 1050 bp, Homo sapiens
ctgttgcagggtggggagcaaggggagggagagcattaggagaaatacctaatgcatatggggcttaaaacctagatgacaggttgatgggtgcagcaaactaccatggcacatgtatacctatgtaacaaacctgcacattctgcacatgtatttaaaataaaaaataacagaaaacaaaattagagcaagaccctttctatacttaatatataaaaattctcaaggcagttaattgtagttgctagtacagaaaacacttaaccttaagtgaaaataaaagtatactttactatggaactttgttagtttaattcaggaagtgaaaagatgcattttcagaagtatcccttgctatacaaactcttcataatccctccccaaaactcagaaaccaaatagtttcaggtagcaagagatacttgttttctaaactttctatcttattttctagtcttatcgggacctcaaagaagtaactcctgaagggctccaaatggtaaagaaaaactttgagtgggttgcagagagagtagaggtaaaccttctatagtaaaactgtatgtattatgtgtttttcttctaagaaaatcttgtttcaaaagaaaaaaaaatgggagagtatagtgcttttcttttcagtgactttgttttttgttgttgttttttttgagacggagtcttgctctgtcgcccaggctggagtgcagtggcgccatctcagctcactgcaagctccgcctcccgggttcacgccattctcctagctcagcctcccgagtagctgggactacaggcgctggccaccacgcccagctaattttttgtatttttagtagagacggggtttcaccgtgttagccaggatggtcttgatctcctgacctcgtgatccccctgcctcggcctcccaaagtgccgggattacaggcgtgagccaccacgcccagctcttcagtgactttgaaagtgaggaacacttttaggaaatgtatcagctgggctatccttactaggatactggaactccgtgctgttaagctggccaat

SEQ ID NO: 111604 - DNA, 1040 bp, Homo sapiens
gactttaaatattcctttaagttttatggtattactataattctgggagttgaatggggtttgtgattatgcaagggtcataatcacatttgagaacattattcttataggaatatatattttgagttacaagcaattaacttacaaagacttagaacatgacttctgatttggctaatcataccttaaagcttccattaaacaaagtgcactaaaggtcttaggatgaaatattttgtattataatttcctgaaaattaaaagattttgagtatctttactgtttattttaaataatttgtctgataaaaattgaattctttaggtcttgatgaagaccactttcctttatatattgagatttttaaaaataaatcctgtctttttgttgtttgtctctgtcttaaatttgatctgttaagaaagaaaatattgggcccagatataattttactacaaactctagctcatttattcatttttgtttttatgttcttttcatatccacgtattttttcttcagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggtaaaccacaagtaatatggacatttcaggtatttctgattttgctaaaagtaattacacactttagactaataatgctgaaaaaagagctttgtcagttttctaagggaaaaacacatgatatactaggctttctttttttttgagatggagtctcactctgtcgcccaggctggagtacagtggcgccatctcagctcactgcaagctccacctcccgggttcacaccattctcctgcctcagcctcccaagtagctgggactacaggcgcccaccaccatgcccggctaattttttgtatttttaatagagacggggtttcactgtgttagcc

SEQ ID NO: 111605 - DNA, 1017 bp, Homo sapiens
gccctgggtttacaaccaaatgtttctcaactggaaaaaaatgttgattatttcgtgtacaggttgttgctatggaagtgtagttactaattttgggggagtgggaggttgggggaactcagactcctttgatagctaatgaattctagaactcttttcagaaaattgcaaatacatacaattttggattctaggttaacaaatctctgctttaggaaacaggaggataatttataaatttatcaaagaatgaattgcttaagagattatgttaaaaaatgtatcaaagggccttaaaatttgggggacactatattaattaaactttccttcaactcttgtttgaagacgtgtccctaaacccctagtttatattaactggttctccctgcaccagttgagggaccacccagtcaagaaagacacctgttcagatggtgtcattcttcactttggccagcctatacagcaatagaagaggcctatgagctattccctcactgacaccctgctatcccctttataatgtagatctcaaaaacaaccaaaccgattccagctactttattacttgacttatagtaagtggcagagtaaccttatgttttgaatatatgtgtaataatagtatcttttatgttttttcagagaagactattcaaggacctcaagtaattaaaacatataggccttaaaccaaaaaaaaaaaaaaaccctgtctttaaatctgttttgaatgtttagcataattatactcttgtcatttccctaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtaagatacattgaatttttaaaaactgttcattacaagcatttaacagatgcacaacagtagacagaatagcataataaaatctc

SEQ ID NO: 111606 - DNA, 1052 bp, Homo sapiens
catagctcaagtttgtctaagaacaggtacttttgtactcttaccttgacccttattttgcttcagttgttcttcgccagggattgaaagggatagtgtatgtgaacagaagtttcaaaaagataagtttctttgtaagtgagttctataagaagggtgatagatgatatatataaaatatctcttcatggcaggtaatactgactgcttttcctcttgtaatcactttaccactccggtattaaagacagttgtacagattctactttagattagaataatgcagtagctttttattttctgtggcaggactgctctgagtataaaattttttgtaaggttgtattttcattactaattgagctcaattttctgtcttttccttgctgaaccaataggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacaggg

SEQ ID NO: 111607 - DNA, 1048 bp, Homo sapiens
agccgtgcctatttctccttcaaatgactccctatggcttctagttggtagtcttttatttaccacctcatagtccttttatttatatcccataaatgatcgtccggccccgcaccgtgggaccaggacgctgcctcgaccatggcggtctcctggaaacaggctgctttgagccgaaactggtgaccgtttcccaaccccgtccaggagtccgacgcctcttttctccaggccaacttcaagtgaggtgtatcaactctatccgcacaaatttcttgccacgagagcagaagattatgatctctgatgctgccttagggctgaagacactcccaactcggcgacgcttagcaatcatcgacttcctcctcctcttggctgcctcggagatcctgttccggggcagaggtctccccgccccgcccctcgtctcctccaagatggcgagcggcggcagcgggggggtgtcagtacctgcgctgtggagtgaagtgaaccggtatggccagaacggcgacttcacgcgcgctctcaagaccgtcaataagagtaagtgtcggggtgggcactggggcgggcccaggccggctggaggatgcggcctgtttccggcgcgcgagaccacctcgcgcgggaggcacgggaaggggagacccccgaaacccccccgtctattgtccgcccggctcgggccctagcgcccggaagacgcaggtctcactcctcggcttcaccaggccagcctggggtccctggttgcttacagccacgtgtacttctctttttaccctccgcgggaagcgagggaaggttttaaagagaccgcagctcccggagtccatttcaaactgttttcttatttgactcctttgctgctttatttcacaaatattccaaagtgcctccttttcttcttcgtcttgagcgcagtgatcaggactctattgctgagggagcttgttctctttggccgctaaagggggaggaacctgcttgggacacgtagtttagaggctggtgctaaccaggtggaagctgtacgggttct

SEQ ID NO: 111608 - DNA, 1228 bp, Homo sapiens
aagttaggaaatatgtgtgtggaagcaccaacacttgaaataatgtcggaagaaaagtttggcctgtttttttgccctgtaagggatgatttcggtttttaccgcctttggtgtgaggtttaattcatcatattcttttgttccttactacatacctggaatatggccatgctgcttaatgttctcggtggtgcgcagttcttctctactgaagatacagcctgtgcatgttagatttggaaatgtaattaccaaggcagggcttagctgttcagagtagcagtaacctaaaaggtgtgtcagtaacatgcaaagctatctaagtaattttcaacactctagtactgggttaacgtgaaaagtagtgattgtgcccacagtgcacttttggtgatttcagacattgaggaaaatagctacgaattagaattatttgatccctaaatttgtttgaattaactctagccttccaaccagtactgtatacttagtatagtattttgcaggaattctttaatcagcaaagattgtcaacttgtttaccagtatgttttcttaattggtagaaattcttgtgattctttgagaattggacttctgtagttgcacaggagcaagagtaactatgatcctggtcattttaacaccgaacagttgttagcgttgaaacttgccacctgagttcttccttatactttggtcatcttagttgaaaaggggaaattttaatgatttttggaaacgttgccagcaagataaattgcctttgtattatactttataagatttttccaaaatattcatttcatattgtcagtaaccttattaaataggtaatgcttttctaatcattttgtagctaagaaaactgagatttggctgttaagtgatatgcccaatacctcaaagcatttagtggcaagcttgcaccaaacctaggtcatttgcttccaaattctacctgaactttttccctgtgaagtaatgaactatgtagaatgtagcatgcatttcaagatgaaatatctggagaaattgcttctttcttctttatttcactgcacttttttggtacatgtatattgggaatctttatctcattgaaaatttaatctataactctccttattgtcacttcttaagttaaaagcaaagattagttgttttctgggtttgttttgttttgttgctgtttcttccagttgttctgaccaattatttctgttgc

SEQ ID NO: 111609 - DNA, 1053 bp, Homo sapiens
taatcatttgtttcttaaacaagtttaaagaaatatggcttattgttttgttaatgaatttaagaaacttctaaaacaacccatttaacatccttcagattatctttgtatctaagacaattacttatttagcagatgaatgatttccttcttaaatgtttatttcaaaaggccaataattttaataacaatatccatgaaagagaggctagggaagttgatatatgcttaattatatgtttgattgatatacatttacaagctatctgatatttagacaagtctctaacctttgtcagttttctcatctgttatcaggactaaatccagtgtttagagtggtgttgtatataatgggtgcattgcattgttagataataatcagatactgtttttttttccttcttcagtaactctctctcctttgaaaaggcatattgcgagtacaggctgaacagaattgagaatgccttgaagacaatagaaagtgccaaccagcagacagacaaactgaaggagctttatggacaagtggtaattactgcttttaaatacatgttgacagtgatactgagtgagcatgactacctctagcaaggagcagggttgaggaaacccagcccatcctgatgctccacaaaactgaccaccaaaccagtccttaaggtttgaacataattcctcttcttgatcttcatacaaacagttgcatatataatgtgctatgaacaaatgacttcctcaggtaatcagaaaatcaaagaaaatgaactaatctgtttaattttgacttttgagttagaaagatgaagcacattgagcttgtatattaaacagatttgaaatactatttcactaatattttactctaaggatgtcatgatagataagaatttagatgattctagcccatgaaattgtgaaaatattttaaagtattttgagacataaaattaaccctaatgtaaaatagggctgttaatgacaagaggacagaaatgtgtatcttacagctagcaaaaccctcttaaagtttttctttttttttttttt

SEQ ID NO: 111610 - DNA, 1079 bp, Homo sapiens
tgacagagcgagactccatctcaaaaaaaaaaaaggtatgtacttgttttcagacataatgctgttgcacacttaatagacaacaatatagtgtaaacatagcttttatatgcactgggaaaccaaaaaatctgtgactccttctattgtaatatttgctttattgcggtagtctggaaccaaacacgaaatatctccaagatatttctgtattttgaagaggagtgagttactttttatttatcatctaaattctagagggcatagcttgtagaaattgccaagttaggtatttttgtagtcctaatacacttcaatttgtgctgtccctttttttccttcaaaaagctcaaaacaagcaattaatagtggaaaaataaaacaaatcttgttctccatttctttaaagcagttcacttgttaagcctttttatacctaggaagcctcctttgagaaggctttaaaaggagtgggggtagattctgggataactatatgtacatgagtagatttgaattgcagagattcaaaaagagtagatttgaattacttctgtgaatcaggataaatttatatgcatcttattagcttaggcaccccaatcaggtagatagattcaagctctcctgctgtatctatataaagttaatagaaaaaggaataagttgaaatctgagattctgttaatgatagataaacttttctttgttaggaccaaaatgtctttgactccaagaagaaagtgaaattaaccaatgcggaaggagtagagtttaagctttccaagaaacaactacaagctatagaatttaacaaagctttacttgctatgtacacaaaccaggtgggtaattacctttggtgtcatggctaaaccttttgtaatatggtatatgaggagtaatagggatattagtctaatctttttatagtttttgtttgtattttgtcttcaactcataaatatatttttttgccttcctcaaaatattatatatattattggctgggcacaatggctcatgcctgtaatcctagcactttgggaggttgaagtgggcggaatgcctgagttcaa

SEQ ID NO: 111611 - DNA, 1007 bp, Homo sapiens
aagtcctgggattacaggcatgagccaccacgcccggccgagagacagtaatgtttttattatttagaactgagtcaagttattcttaataatgtagcaaaaaatacatatatgcattttgttgtttttgaagcaaatgcttatatttgatgtgtttgatttttttaaacagttctagaatttaggcatccaagtgaatgtttagaatttctcctttactaaagactcttagagctcatagattaaattcaataaatggaaaccattttcttacaagaaaaaattgagaatagatactgtaaactgattctcttaccctaggcagttctttggttaatatttgtttcaactgattttcccatgtttcttttctttctggtcatttagtgtttaatttcattaaccagtttatttttcttgtgggggttggatatcttctaggctgaacaatgccgcaaaatatctgccagtttacagtcccaaagtcccgagcatctcttacctgtgttaatccaagctgcccagctctgccgtgaaaagcagcacacaaaagcaatagagctgcttcaggtaaaataattacttgaatgaggtgtcagacatttgcagctttgtttcattttcattgtgttgtaataacctactagcatgtaaatttaatgggaaaactaatcagaaatgtaccactacacaaatttcattgtcattttagttaactcttgggttacagagctttatataaatttctttgtgttatataaatttctataatgtaaatatttgttataaatgctgaagaatgctgttttgtttggagatctgtttaacctgagttaggggatcatttaggcatgtataattccagaacatacttaacctcttttgcaataatctgatctccagtgagttctactccagaacctcaattatggagatactgactttgtttttatcaacccaaaccagctattatattgcatatttaaatttcttgaatataaactaca

SEQ ID NO: 111612 - DNA, 1133 bp, Homo sapiens
actttaaggtaggagtagtaattataatagtaatagttgtctggtataaatttaatttcattctctgctctggtattggtttcttattcagtcaaatgtgccaggcactatttaggccttatagtatcactgaaaaccaacctcaaataatctcagatctgtataggaatttcttagcctatatcattttcgtcagtgtgatttctttaaattagaacaatttcataattgtggccaacaaatttagtttttagttttctgattattcaaatattgcaggtttcaatcattaatacagctgtgaaagcatcttttccatagtagaaactaattctgtagtggtagtatgtgcatcttttggacaggggctgttttattcatgtttgcattctcatggcctctgtgcagttggcactcagtaaatgtaatatggtagtgctttcccttaaagattcatattttaaggatcgtgctataattactttaccttagagtcaaatacagtatatgactgaaaataaaatgtttctaatatttaatatatgaccaccttttacctttcaaggaatgtatccatttcatttaggttgctgactttattggcataaaagttcttcattttatttctttattgtccttttaatatctatagaacctctctcattcctgatattggttattcatgtatttttttctttttccctctgattagcctgtccagaggtttatcagttttactgattgttcttaaagatccagctttttgtttgtttcctttctatcctcatctcctactgctcagcatccccctccccctccactccagctatgtaggcctccttcctgtccctcagccacaccaggcaccctttttactggcttcaaacagctcatgccacatgggattcatcatgagagttcagccgctctatgtatgcctcactgatcatacacttaaatgtccagcagtgtcttattgtagaaacatttctaagggcttattctcaacttctgtacttaccaaaccatttgtgaactggcactgctttaaaggaaagttttattttacagatatctaccttcatatttggaaaacacggttgttcatggtatttctagaagtaaagttaact

SEQ ID NO: 111613 - DNA, 1081 bp, Homo sapiens
ctttcagaatgctttttttttttttttgagacggagtcttgctccatcgctcaggctggagtgcagtggcgcaatctcgctcactgcagcctctgcctccctggttcaagtgattctcctgcctcagcctcccaagtagctgagattacaggcacgcactgccacacccaactaatttttgtatttttagtagagacggggttttactatgttgtccaggctggtctggaactcctgacctcaggtgatccacctgccttggcctcccatcgtgctgggattacagacgtgagccactgttcccagccactttcagaatgcttgacaattattttgaagtgttaatttttatgccctttttagtgccttttttggtcaatgtacttaatatagattttacttacataaaaaaattaataaactcacaggtttaaaatacaaaagataaaaaagtgtaagagtaagtaaaaagtcttccatccgtgtctacccacctccctcccagggccataaccaacgtaacttgttttgaatctccttccagagatattctttgcatgtatcttacctacacatgttcttctggcaaaaaatttattctctaaagtcttgccaaacatagagtaacttaccaagggattctaggtagtcatgcttgtgcaaattactttttacatagacttaatgtgtgccactgaaaaacttttttcagtgtaaacagaatctgttttcgaattgtcacctctgttttctaaactactttccaaaaattatagtatctgaagcttaattgactttaacctgaatcaaatcttaactaatttgttagctttggtaagctgataccaagtcttaaaccatgtttatgataagtgcccaactaactcttatagagcacttacttaatgctctataaatattttatcacaaagatggtaatgatttttttttctctttgtagacagggagatttgaaaaagaagaaaaagaaaaagaagggtaaggcattaaaaaagtctttataaattttctccaaaataaatgtttgattttagccctatatagaaatatttggacataa

SEQ ID NO: 111614 - DNA, 1532 bp, Homo sapiens
tcttcaataaaaacagtgaaaatgttattcaaaagaaaagtcgatagggagttggggagcttaccttaaaagaagtagaaaatgtgtgggagattgttaagtgtgataagtaaaacccatgtacatacatttttatactcttccttcgttgaatatatgagtgaccaaaaatgatctgatgatttcagggatgccagtaaaactgtgagcagcccacccacctccccaagacctggcagtgctgcaacagtatctgcctctacaagtaacatcatacccccaagacaccagaaacctgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatggtgtctccttctggttatggattttgaccattgattacctttctcaatgtaatgaagtattttacagtcaatttgtggtgtaaatgttgctcttgtctttccttgcttacaaactactttcacattgaacagctgtgagacagacatattgagatgcctgcccttgttagtattcattttatgctgcccaagatatcatttaatttagacttaa

SEQ ID NO: 111615 - DNA, 1036 bp, Homo sapiens
ataagttttaattgtcaaatgaagtataaacacatgaactttctagaaatatttcctcttttggataggtctttaaccagttcatatatatactttgtcaaatatatggatgtgtatgtgtacatttataagaaccagtatggatacatccattcactgtggtacattttaaaataaaatattttagcagtgaatatggattaaggtgttttgggtgttggcattttatggaggacttcctggttagtataaccaagaattttcttttaagctgagtatcaaaattgtgtgtactgtccctcttagcaaacccataaaactaatctaatgggattgagagaaccccgtgtaaacttactgaaaattcatcttggtgtgtgtataaacagaagtaaacctttgaaaaagtcattaagcatagcaattccaatgctattgggaacagccaaccttaaatatcattgcatcactcaagccttctggaacctgctattcattgttccttacaagtctatttgaaacagatacaatgaaggaaaataagtttattacattgaaaaataattgtggccgggcacggtggctcgcacctgtaatcccagcactttgggaggccgaggcgggcagatcacctcaggtcagaagttcgagaccagcctgaccaacgtggagaaaccccatctctactaaaaatacaaaattagccaggcatggtggctcatgcctgtaatcccagctacgtgcgaggctgaggcaagagaatcgcttgaacctgggaggtagaggttgcagtgagctgagatcggaccactgcactccagcctgggcaacaagagtgaaactccgtctcaaaaaataattgtgctggacgggtgcggtggctcatgcctgtaatcccagcactttgggaggcccaatcaggcggattacctgaagtcaggagttcgagaccagcctggccaacatggtgaaactccgtctctactaaaaatacaaaaattagctgggcatggtggcacatgcctgtaatcccagc

SEQ ID NO: 111616 - DNA, 1029 bp, Homo sapiens
cccaaagcgccaacccactgcggagacagaaggccgcctaccggggaggccggaggccggctagtcgcggactcgggcgaacccaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcaggcagggatacagttcctgcaaggggtcccggggggcgcgggaggcgcaggacgctaggctctgccgtcagcccgcaacagcgctcagtccagggagggaggcccgggtggggggcagccgtaagcccccgctcagcgtgcagccaccggggacttgcgcggccgtggcaccgctggagggggcggcctggggctggggctgcccggcggcgccgcgaccgccttccttcgctgcgtcccgcccgctccacgcctcgctcaccgccgccgcttctccctgccccgcagcgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccaggtgcgtccccacacgcgcccagcgcgccccgacccctgcctgggctgagccttctcgcggctgggcggtcctgttcgtccgcgcctcccgccgggctgccctccccatgatctcccatcgcttctgcccgcatcccaggggcccagaccctgcatggctcccgccgccgcctccccgcttccccgctcccatgggcgcccggtctccccgccacccccatccagccgtggttccccgggagctgcgcagaaacccctcggtcaccagtcctttcttttccactctccccggcagcccgggatacacgctttctccctctgcgagttgggagcagcgtctct

SEQ ID NO: 111617 - DNA, 1057 bp, Homo sapiens
ctctggttgcttgatgagcaaagcgtgtgggggaggagcaaatggcttcgaccaagcagcagatgagcaaggcagtctaagaggagaaaagggaatcacataatttgtatttgtactttctttaaaaaaaaaaaagaccaaaaaccaaagaaacaaagctcagattctacttagcgatctcaagacttgcccacagatactcaactaagtgtttaacaatgtctacaccctgtccaggccagcctgtgtctcttctccagcccgtagctgtcaggttgttttatacgctggtgccacctgtggggcgtggtacaggggggcctgctggattacatcttagtgtgtatttactacacatgctgcctgaactgcctgcattctggctgtggcctggtgtatatcccaggccttgggtcatttccatcctacgtctcccagagcccatagatacccggggtggcctttaaaactggtgtcaggctgggcctggaaagtaccacccagatccagaaccagcctgcagaatccagctgcctggggtttgggagggaaggccttgacaggcactaagctggctgttccctgtgagtcagagcacactgcactgggagttacatcccttgggatgggttgaacagtcacaaccagaggatacagagagtctcttccttacctccttcaagccaaccacgggctttgtgtattagttttttcatgtacaaagctgtcaaatagtaaggtcgaagggtattccttgtcccctcttgctaataatgcaggattctagccctctctgcttctcatcttagatatttctgaatgctcacaggagtttatcttgcatccttatgattaagtcagttcaatttcaatgttatgtcctggactctgctgccagtgtctggcactgctaccctgtgctgctaaagtgcagggcaaagtagggagacagcatcatggccccctttttataggtttcactctgttgttaggatataggagtggtacagtaggccaaaaagtgaccccccaaaagatatccacatcaaacccctaa

SEQ ID NO: 111618 - DNA, 1154 bp, Homo sapiens
gcccgacgcctcgcgagggcgcccgcggagcctccccggccctgggcgttgggcgagccccggggcggtcggaggggcccgggggcggtcggagaagcccggacgccggctgcgcggtaactttccgtcctctcccgggacgggggccctagggctggggagggggctgcctggactcggggaggactggttccggccaaacagcgcctcgagcttgatcccctcccccgttttagtgttggagagcgcaggaaaaggctcaggacgagtgtcggggcgactcccgcgagttggtgtgtaaatgtgtgcagtgagcgggccgaggcgagaggaagcgagagcgcccgagtttgcaaagagctgctttgtgtttggtattttgagaaaatggccgaatgcctatttcagttaggaatgccgccgccgaggcaggcgctggtggcagcagcacggaggaattcgtgcagcacgttgggctttcgggctgtgcctggacggtcttcctaacaatcgttaaaattccatttggggtggcagttaggggttagggagcaattagaaaagtcgatgttgggccaaattacccaatagcttgggctgttcagccccgggacagccttcgccctctgttttctgtgatggcatttgcttccaacttttgttggtacgtagaactaaaccggtttgtgtttatacacttgggtgaagcgggttactttttgtattttcggtttaactttattttcttagaacttcttactttttttaatttgcgagtgaacacttcgtttgagaatggcaccttttagattgagaagtaacgtagcatctagaaagcccaacttgttttgaagaaggtgatcttgtaatggcttccactaggcaagtaggccaagtcaagcacaatgcaagaaagttgctgattgtcgagttgagttgcacgatgattttattcgtattgaaaagcttggaattcagtgttgtggaacttcagcctgcagaaaaataagcttattaatttttatttgtgaagttttgaataaatcaaacttcctttttcacaagaaaaggggtccataaatgttttttcttttaagcctgtggagttgtcgaaaaattaaggggctgactgctactttttcacagtagtttat

SEQ ID NO: 111619 - DNA, 1429 bp, Homo sapiens
tgaaggggggaaaagttgggaggacaataatttactactcatgttttgaatttttaaaataattttaacagtaaaaatgaaggttactttttatccccaccagaacaattaaaagtgcttgaggaggcaccacatgccagtggctgaatgatgaatgagttgtgcaaacaattggtagaattgttttatagggatagtagaaatttttttttggtgattgcagtagactattgggaattaacaactattttaaagatttgtttttaataggcgatgaagtttactgagttataaagatcatactggaaaatttttaagttatgaagaattacagcgatgtggttttaagccagtaacagtagtgtttaaactggtgctcttgttttgttttgtttttaattcagaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggtaagagaagctttctagtccataagttcagttctcttttctgattgttacttgagtggttagttaagtagtgcttgagaaaaaggactctggttcaaatccaggttccattttgcta

SEQ ID NO: 111620 - DNA, 1050 bp, Homo sapiens
ctcactcagaagtattgttttaagctaacactttcaaatggtagtagattcatcatttacaagttaaaaaaaaaacctaaaaaccggtgttaatagcatcagacagttcaggtagattttttaaaaggtgattcttaatataacaaaaatgctttgtaccttatcaagatagttttttacttatcactacttaatgtattaacatgcagtatcactgtgaaaattaaaagggctgtgagaattcggaaagtcaatgttgttttcttgtcagcaaagccaaaataatgtagtcatagtttctgaaataaataacttacattttaagtacatgataaattgatctttttgccagaaataggaaaaaaaaattcttgttaaaatgtgctgagcgctgaacattgttgcattgttagtgagaattgtatttggctatttcgtgacatttaaacactcttatattattgaaattttgcaggagaacgcccatataaatgtgaactttgtccttactcaagttctcagaagactcatctaactagacatatgcgtactcattcaggttggtaagaaattggaacttttctatcattttcagtaaatgaccattttaaggaaattcttttagacttgtaaccgagtcatttacttattatttatttttaatataatttagaagtcagaatttaaaaatcagtattccgtcaatctggggattcctaacatggaatccaaaggtggacctcctgaaaatggaatttttgtgtacactttttctgggaggaggggccttaattctcatcaaatctttgaagcgttccgtgactccaacaaaagttaaactaatgtagaccaagactgattgatcttttaacccctacttctcatatttctcctaacagtataaagctgagagtcacaacgtgtggttgacaagtgtcagggattccttcttagcttctcaggtcctgaaatgaaggtttgttctgtttcaaggtttggtcgagcttttgaggactgactgcaaaagtttagcttgaaaaagaaaatgat

SEQ ID NO: 111621 - DNA, 1089 bp, Homo sapiens
tctagctctatctagaagttcttaggccttatgctacctatctttctacattctatgtccacgtatgttaaaatgtttgtctccatttaaatcattcactggagagaaccaggtatagagtaatgtagcatgttgtagaaacttgcatatttgtaaatctgttagtagaccaacatggagaagaattgtccagtcagctgaatatctaatttgactacctggataaggtgattattttatcaccaggcattttctaatcatgtaaaacttaacatctacatggttttacctaatgtctgagttttgctttatgaaaatttttagtacaatttgatatgaatttgagaatgtttgagatgaattttcataaatgtcaatttccgtttttctactatgcattccattggaccagtggggtatggataccatttggtaatatttactagagtgtgatctagatgggtatgtattcaggtagaatgtattactcttatgcctttaatttgggggtgggggttctggttttttatgtatcagtgattgtgactttgcttattttacataccatatctatttgtgtgccacttctcattacctagttcctttatgtattttatagaaaggtggggggaaaatcaagaaagttttctgaataattaccttggcctatatttttgctttaaaatagcaatgctagcgcaggaagtttgctaagtgaaaatttactcagctcttgccatgacggacagaaggattaaatttcaagaaaaagcctttgctcagactaaagcagaatttcaaaacttttgcacctaggatctgggagtatcgcccagagtgaaagatatttttctcaagatttaccataagaaatttagggtggagggagtatgggaattttattttatttttatttatttttgagacgaagtttcgctcttgtcgcccaggctgtagtgcagtggtgcgatcttggctcactgtaatcttgccttctgggtccaagcaattctccttcttcagcctcctgagtagctgggattacaggcatctgccactacacccggctaattttttgtatttttagta

SEQ ID NO: 111622 - DNA, 1252 bp, Homo sapiens
atgatacagcattttaaatagtctttgttgttactttacatatacagttctttatattttaatcttgaatttgtcttaatctatgtcttctctcatacttttgatttgccttcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagccgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatgg

SEQ ID NO: 111623 - DNA, 5039 bp, Homo sapiens
agagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttcagttcttagtttgtaaggtatattacattttatattcatttatgatagcagacaaccttttaagattgctttaattagtatctgatgttgatttttaagtggcattcttttccttaggactttttatgtatacctgttgattgttgtgtaaattttagtaaatctaagagagtgtactaaaccagcaggtatctgttagcttatgtgtttaattgaaattagaaggctaagatggtataacagcattttattgctttgtccagctacaacttgtcatttttttctccatgtcttatcttcctgtttcactttagtttattcttcgttttttattgagatctataaaaaattggcttacttaatagcaaattacttgaagaatttgcctgctttatataaagttagcactttaagatttttttttttagagatgagaagacatttaaattgaagaaaaattcccccagcaatagacagtctatcagtccaagtatttacttcctgagttttgatcaatattttttatttgtgtatgttaatcgtcataaaaacagtgattttggtgtgttttttattttggtgctttaatggcttaagatgttgcacattttttttttcttttggtttctgtttatgtttttttgcctatgcagttaaatttttcctagaaatagcatttgtgttgaacagtaacactttatacatatatatatgcatgtttattttgtttggcgtctttggagggatgcttttagacttgtttgcaaaagggcagttttctttttctttgctgcagttgtctattttgcagaataatagtgtgtgcaagtttgtgagcaaatgaaatatgcaggttcaatctattgattttgatttttacatcttatatctatgccagaatctgtatttcatataacttatttatttcgaatggatgtagtaaattcacagctatcagttttgattttgcaataaataaaccactaggttgcatgtcgaacaaatttttatctcaaataccaaccatcagttttttttttcatgtgttttggtacagctaattcctaattgtagagtgttaaatgtttgaggagaaccttttctcatagatggttggtgttcatatggctactttacaataaagagaactgtaagtgatatttggaaactacaaacctggaattaggagatataattattccttcaagttttatagaatatcacttgggagattccaaagccatagctattacgcggcaaacctaggataagaaaggtagtatgagtgctggtagaccagctgcaactttcctatacagtgaaaaaggctggtgaaacaagtacagtccagattttttaaaatcatactttctcagggatctccacaaactggtgggtgtcctggctgtctgtgtgatagcctctttctataggtgaggcctcaaatgaattgcagctatcctggtgttcctatgagggcactttgtatgaaaaagggcatgtactccaaaacatttttgtaggttctttggccagttgccaaagagtgtgaaagaatccaatagaggatttttcttactgatagcagtcattcattgcagtaaaataaaatatgatcccattagggaatcttgaattctgacctcccatactccgttttgaaataaccactttatatttcattttttaaaaatctgatgatctctttgaggcaggtttcagatttggcagtacaacatgaaagattaggaaaagcattaataacgtgtgggtggaaagcttgttaaaaatctgagagtgaagtttgagttaaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggcttataactatggctggatcttttgctctagtcttctaagaagggccattttattttttagagtcacttctaaagtcatgtggtaattaactttggagactgttttgcgtatgagtgctgatacaaattaaaacccaagtagacctcattgcatgtcaccctatgaatgttgacaatggaaggaataccttgcctgtagtatactgtcacttctggattgataagctgaggaagaaagttaagtttcttttttacataagtcagaaaaacttacagctggtgttcctagtttcctggttgacctcagcagatgaagtgaacagatagtgttaattcagattgaagaaattatctgaatcttggtttgtgtagatttacaatctacatgcaatattaactaaatcagatagcttttacagtttcacatgtgtacataggttccctcccggtcccttccatatccattagttattgaactttctaaactggcattgaaacattacaacaatgttttgttgcaccaattttataaacttaagcagtgcaatacgtgttacttttctgaggcaaaccaaaggtaaatttctcaaggttcttgctgccttctttagcagcatttgatggaagatcttttatacatttgtaatagataaaaataaaccagattgcaaatccttttttaaaatcctaaaccatgtaccaagtttttggtccaaattatgtaggataagttaaacttaaattgcattctattaaccaatatgagtgtatttctgtaagcatagttatgttgaaataaagttttaaaaaccatgatgcctttgtttattattggtatatccagaatgtaggaaagccaaatttatgttgctggaactgcaagtgtattaataggcttttgaagattatttctcaggctgggcgcagtggctcacgcctgtaatcccagcactttgggaggctgaggcaggtggatcatgaggtcaggatttcaaggccagcctggccgacatagtgaaaccacgtctctactaaaaatacaaaaattagctgcgtgtggtggcaggcgcctgtaatcccagctactcgggaggctgaggcaagagaatcgcttgaacacaggaggtggaggttgcagtgagccgagatcgtgccattgcacttcagcccaggcgagagtgtgagactctgtctttaaaaaaaaaaaaaaaaaaagtatcacaggtagaaaagtcacagcatgttg

SEQ ID NO: 111624 - DNA, 1645 bp, Homo sapiens
agtcatgcagcattgcttcagctgcattctcttaagttacaggagagtcaaaatctacccgattcaaggagagggtgcatagaccactatatgtgatgataggagtgtcaagatcacattatagaagaccatgtcggatgggagataggcttgtggccatctttggaaaatgcaaactttcatacctgtacatgtatgaaatgttgctataatagattgccccaccttagggtattgcccagttgttggaatccttccatggctctgcccccttaccctgttctctgactctagtgtctgaaaatcttgctgatcaataaaatggaaaacttaacattcatacaacttacattgaacctttctaataaacctctttttatattggaagaatacctgtgtgacatagacataaattattttattaatgtaattgaaattttagaaaagtggggtgaaagcattacttattcagcagaaagtaaatatgtttctgctacttaaagtcataggagcaagatgttaactaagtggcatctcattgcaaatgagtacaatatttttgtttttacagatatgcaatatgatgaggatgatgatgaaatcaccccggatttgtggcaagaagcatgctggattgtaatcaggtaactttggaccaaactgaattagcctgaaaaggcactttagatttcctgcttattcttcttgataaatagctcttctatataaatatgctacatgagagtagttattttatttatatatttaacattttaagtatttcagatctaaaagttacacaaagaattcatttaatcattttaaccagattccgaaaatgttaccctgtactacatttctttgtctttttctctttttgtatatatatatttttttctgaaacatgtgagagtaacttgcagatcatttgaccctgggaggttgaggttacagtgagcgaaggtcgcaccgctgcactccagtcttggtgatagagtgagaccctgtttccaaaaaaaaaaaagaataactgcagacataagaacattcttttacataatcacaattatggtgatcttatttaatctatagaccttacccacattttgccagttgtcccactggtgtttatagcaaaatacaaatttttctgatcctggatccaacctaggatcacatattgcatttacttgtcatggcatgttcttttgtttcctttaatctggaacagttcctcagtgtgtctgttcttttttttaccttgacatttttgaagaatacgggccagttactttttaggatgcctttccgtttaggtttgtctgatatttctcataattagattcagatgattacttttggcagaagtgacatagtctcagtgcatcatatcaggaggcatgtttgtttcattactagtaatgttaatttgattgcttggttttctcattattttaaatggacaaagttaaaattggttgtatttcattccaaattcccatccaattctaagtgtaactaaatgtaataaaattacgagaagccttgtataggtaagaaaagtaacttataagtgataaagtaacatcctgtaaggttaggatgttaaaggcttataactcttctctctcttctctcatcccct

SEQ ID NO: 111625 - DNA, 1050 bp, Homo sapiens
cggttctcctatctcagcctcccaagtagctgggactacaggcgtgtgccatcacacccagctaatttttctgtttttagtagagacggtgtttctccatattggccaggctggtctcaaactcctgacctcaggtgatctgcccacatcagcttcccaaagtgctgggattacagatgtgagccaccatgccccacctctttgacatttttgtgtagttgctcccctgccatgtatgttcacgtactatacatatatctgtgctttagacataaaagagcaacaactttcactctgcccaaacaatttttgctcaccttccccacgcttttttttgcaatattcctcctgttgagaatatatgttgtagacctctacatgtttaaaataataccattttattcggcagtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtaagtgtgccaactatgactacaggctcaataggaaacatgtttataggactagtagattcttttgtttgttgaatataaattattttgcttttctttcttggtcaaaggtaaaactactgggtgccgggtgtggtggctcacacctgtaatcccagcactttgggaggccgaggtgggctggatcacctgaggtcaggagtttgagaccaacctggccaacatggcgaaaccccatctctattaaagatacaaaaattagctgggcatggtggtgggtgtctgtaatcccagctactctacttgggaggctgaggcaggagaatcgcttgtacctgggaggtggaggttgcagtgagctgagatcatgccactgcactccagcctgggcaaaaagagtgagactccgtctcaaaaaacaaaaaaaaaaacttactggggacttttgaattat

SEQ ID NO: 111626 - DNA, 1047 bp, Homo sapiens
aaaaagtcagtgggtaattatgtagggcataattacttttagaaatagatgtttgaaaaattatgcagagtggtttagaaataagttttttttataattgtattcttagaaagtaagaataaatcttgaaatcacattgaaggaaaaatgtttatggaaaagaagtttgataggcatgtaaaatcagaatgactaatacttggtttattttttagggccatgctgtaggacttgtgaagaatttagccttgatggcgtatatttcagttggatctcaaccatctccaattctggaatttttagaagaatggagtatggaaaatttagaagaaatttctcctgcagctattgctgagtgtgtatagatggaattagttttttaaactatagttaatctttagttgttgcttagtatagaattgttaagtgtaaaatgcttttgctttttcattgtagtgcaaccaagatttttgttaatggctgctgggttggaatacataaagatcccgaacaacttatgaacaccctaaggaaattgagacgtcagatggacatcattgtgtctgaagtaagaatctttagttaagagggtgtggactgtgagatttttaaacaaggcataggactagtgaaagttatctttgcattggcatcttttctttgaactttattcccttgaactgtaaagtgtaaatttaattataagttattgctaggccgggtgcagtggctcatgcctgtaatcccagcactttgggaggccgaggcgcagatcacctgaggtcaggagttcaagcgcagcctggccaatatggcgaaaccccatctctactaaaaatacaacaattagccaggcacggtggcatgggcctgtaatcgcagctactcgggaggctgagacaggagaatcacttgaacccgggaggcgggggttatggtgaggtgagattgcacctctgcactccagcctgggtgacagagtgggtctctgtctcaaaaaataaaaaaaagcctgggcatggtggctcacgcctgtaatcccagcac

SEQ ID NO: 111627 - DNA, 1083 bp, Homo sapiens
ttgttttctgtgtgggctgtagtattagagttcagaatagtttgtaatatttggaataagggtgtgattcatggtatagagactcctgtggccttctctctgacttggaactgattcatgtatgtggtttttaatctttgttggggattatgtgacattccgtgtctatttcctcacaggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtgagtacaactttgttcatgtagctagttttagaaagtaaaccaaatccacttaactaacttatttttatatgaatttaggtacgctctgttaggattccacagattggagacaaatttgctagtcgacatggtcaaaagggtacttgtggtattcagtatagacaagaggtaggtatctttgatctccctcatgcccaaaccagttttgttaaatattttttttttaatcaaaatttgctttaacttaagagctcaaagatgatacaggttgaactttttgattttattgttgaataagtatatgaacataccatgtttaaacagaatttgggacatacagtaattcagttgggagaactgaaatgtcagttctagtttagtatatgtatctttgagtcccttttaaaatttttctttgtaggatatgcctttcacctgtgaaggtatcacccctgatatcatcatcaatccccatgccatcccctctcgtatgactattggtcacttaattgaatgccttcaagggaaggtaagagatgttcttcaaaaatatagattctaagctgatgcttcttctaaaactctgataggtgattgctctcacatttgagccagggtactttgtaaaaagctagtgtgagacttacttt

SEQ ID NO: 111628 - DNA, 1433 bp, Homo sapiens
atttttaagtattcttttaaggtaaagtggtaatagtctaacatatggatggcttggttttagggcattaaaatgtcattttcctttgagccatctgaagtacttaggagtctcactctttttgtacctgatcccatggatcgacttctatttgaatacttataattgagtttttcttttttaagcaagtttatttgttctaaatgttttgtgtaaggttataaaatgaaccttatatatcacagctttccataacatagattttgagttcaaaatctttgaattttaaaatacttaaaataatactttcaaattttaaaagtatttaaaaattttttgaatgcatttttattgatatgacttttagggggagacagactgaagcaacattttaaagagtacttttttttttaaaaggtatcggctaacaagggtgaaattggtgatgccactccatttaatgatgctgttaacgtgcagaagatttctaatcttttatctgattatggctatcatctcagaggaaatgaggtatatttgctcttatagtagtaatttgccacttgtttttttttgtatgtgtgtagttttattctgaaacaatgtaaccttttattgaagtatcatatgtgcacatatagaaatgtacagcttgatgaattttcacaaagtaaacacagctgcatgactaacaccaagatctaaaaatgtgaaggtagcgactgaaccttttttagtcgctacctttccactcccaccccaagctaattactctcttaattgctaacattatagattagttctgtgctttaatttttatataaatggagtaacacaatatatacacatatcttctttgacgttgtttaatttttaggtctacacttcaaaatctgtgtttgttgcaggtcctgtacaatgggttcactggtcgaaaaatcacatcacaaatatttattggccccacttattaccagcgtttgaagcatatggtggatgataagattcactctcgtgctaggggacctattcagatcctcaatagacagcccatggagggtagatctcggtaagaactgtatcatcatcattattattaattaaccttatattatgaaaaatgtcaacacaccaaaatggagatagtggtatagtgaatgcctgtgtgcctgttacccccatttcaacaattatcgactgatggccagtcttgttgcattcatctctgtccttctaacctttgatattatcatcatgttttaaaggcagagtctcactctgtcacccaggctggagtgcagtggcatgcccacagctccctgcagccttgaactgggcacaagcaatcctaccttagcctcccaagtagctaaattaatattgtctcttaagtccttttttgaatttattggttgtcctccaacctttttttt

SEQ ID NO: 111629 - DNA, 1010 bp, Homo sapiens
aaaccagtttaggttttagtgtggtaatttctctaagctattcatcttttggaaataataagactttgtacaagggattttaaacaatgagtttttgaaaaccttttagttgaggtgggtgaatataaattatgtctggcagaatgggtaaaataccaaagcctactaggagaaagaaccaccataagctgaggtagcagaatgtgtgttctcagctccactcatttattcattatctacagtaccagatctttgtctttttctggggtagagaagtggggtcacttcaatacaattctgctaattaccatttgttttttcttttcagatttctttggtgcgaatgccttacgcatgcaaactattgtttcaggaacttatgtctatgagtattgcaccgcgaatgatgagtgtttagctattttacaggagtcaacaagataattaaatatcttggtgtcttgtttctattgtgtggctttttaaaaatgacaaatatgtactgtgttgtgataaaaagtattttatttgtttaatgatatgcatgcttttcttctgtaaatatataataaatttttgtagatagtcttgatgtgtgatctttattttgtatttctctgtgtaaaaccagtgaatataactaaagtgttagtggattggattaaaagaaacttattaggcaagaacaggtaatgtagttatccatgactacttttaaccatgcagactaataatattctggaggtttatagctcggcaccttcacctgtttaaaaaaaaaaaaagataaaaattagttacatatggggatgtggttgacttttgaattggcaggtagttgagtgtttccaaataaatgaagatgttaaaatatggggataaaggatatatgagtaattgtataaatgatatgctggagtgctctgtggaactcaagttacatgattttagctatgaaaggcaattttgctgtattggttgatgcatcaaaggtacatcttattatagaa

SEQ ID NO: 111630 - DNA, 1043 bp, Homo sapiens
caagtttgattttgactcttacatgttagataaggtaaaagcatctaagtcataataacgatgttcagtcacccatccagataatcttttggagtctcatgctgtacattttaatggcatacttaatgcccttatgggttgctaactacagaatttcatcaatagctacgtctgatactttcatacttagttctgttctttttaaagcaaatgtactagtcatttttaaatggctgtgagatttattgtgtaccttttttcactggtatttcatgtaaggcatcaaccactgtaatttttgctgatgctgaagcctgtccttgggaattggatgcatggcactcatattctccagcatcttccttacttagaggagatacctgtgaaagaaaaaagatctagtattcctctgtggtggtcttctcttttgtcagtggttccagtgaggtcattatttcataaatttcctaagatgaccaggggattcatagcaaaggtactgctagaagcagtgcaagtcctgtgataggagacttcgataactaccatatttggtttgctgaggattcatatgaggaaatgtcatggacaacttttgatcatactgcataggttaaaaactggataggtacacattatcggtttaagggcaaccttgataagggtatatgatcaaagtattctccatgaatatccagggtcaagtaaaataaggtatttattaatcgataatcagttaaaacaatgcttgggccacgcagctccgtgtgaggattttgctttgaactcttaggaaaatactagttcttgttaattcattggttgttttcaaaacatgcaataaagcacttttcctttagtttctctgaaagaggagcagcgactccatggtaaggctattccaaacagatgtggaagagcaagcacctttaggctggcggtacatcaggcacctttgccaggtctgcttatgtctaatgctaagaatgaaactcttgccagctcttggtactggtactcaccagcacccagccagttacttc

SEQ ID NO: 111631 - DNA, 1046 bp, Homo sapiens
cctcagaataaagtaatggtattggctttggtctcagcctattttccattgatgaagctgttgcaggaagagccccaaggtcccaagcatcaaacctagtgctgggtgacagttcatcagttgaacatggcatgacaggcaaaaggcctggaactgagaagcagaatttccaagagcatgagtgaatgaatgatggtgaccagtggcaggaaattatgaccatgtatattccccaggcatgcagaaaaatacattagtttaaaacatgtacgcttagcaggaaactggcaggaagaaataaaagaggatctatattttaaaagtatttaggaaagggaaatagttcagtgaaatgctgggtttactctgttagaaagtctgacatacactatgtgcaattgtagggatgtggccacttccaagtagatgatctggtgtacaaaactcagtattactctccttttgtttttgcaggtaaaaaggggtcactatggagttcaaaggacagaactcctgcctggtgaccgggacaacctggccattcagacccggggtggcccagaaaagcatgaagtaactggctgggtgctggtgagtaccagtaccaagagctggcaagagtttcattcttagcattagacataagcagacctggcaaaggtgcctgatgtaccgccagcctaaaggtgcttgctcttccacatctgtttggaatagccttaccatggagtcgctgctcctctttcagagaaactaaaggaaaagtgctttattgcatgttttgaaaacaaccaatgaattaacaagaactagtattttcctaagagttcaaagcaaaatcctcacacggagctgcgtggcccaagcattgttttaactgattatcgattaataaataccttattttacttgaccctggatattcatggagaatactttgatcatatacccttatcaaggttgcccttaaaccgataatgtgtacctatccagtttttaacctatgcagtatgatcaaaagttgtccatgacatttcctcatatga

SEQ ID NO: 111632 - DNA, 1246 bp, Homo sapiens
cacgccactgcactccagcctgggttacagagggagaccctgtctcaaaaaaattaaatagtcagttgcagttgtgttctttaagttcctatctttctgtcagtgccacctagatggcctgtcaaaaccttgacccagccaccaccagcgttgctgctgcctagccaccaccagcaggggtgctgcccggtaccttgtgggcaaaaggctacagcaggagttggtgaccttcacaatgcctagtgacacagggatttctgccttgcctgaatcaggcaaccttttcaaatgggtggggaccatccattgagcagctggcacagcatatgaagacctgaggtataagctctccctagagctccccaggggctacccttacaatgtacccatggtgaagttcctcacgccctgctaccaccccaacatggacacccagggtaatatctgcctggacatcctgaaggacaagtggtctgccctgtatgatgtcaggaccatcctgctctccatccacagccttcgaggcaaacccaacattgatagctcgttgaacaggcatgctgccaagctctggaaaccccccacagcttttaagaagcacctgcaagaaacctacttaaagcaggtcaccagccaggagccctgacccaggctgcccagcctgtccttgtgtcgtctttttaagttttccttagatggtctgtcctttctgtgatttttgtatagcactctgtatcttgagctgtggtattattattattattattattagtcttttaagcctccagttgagtgcttgtgatgtatattaaataaatgcattttgggttgggcatggtggtgcagttctgtgatcccagcactttgggaggctgagaggggaggattgcttgagttcaggagttcaagaccagcccggacaacatagcaaaaccctgtctccataaaaaatgtaaaaattagctgggcatggtggtgtgtgcctgtagttccagctactcaggggactgaggtgggaggattgctcaagccagagaagttgaggttgaaataagctgagattcctgccagtgcactccagcatgggtgacagagtgaccctgactcaaaaaaaaaaaaattaaataaataaataaataacaacaaaatgccccagaactgcccaagattactagtgtctctggctcatgaggtcagactaggaggggcctcttcaaacagccccctaagcttccacaactacagt

SEQ ID NO: 111633 - DNA, 1050 bp, Homo sapiens
tatgagagatattgctaatggccatcaccctaatagaaaacttagaaaattttgatttaattcatgagaatctagcttcacgtatttgtttcatttctagatgatacgtattaaagtctttatacttgcaaatatttctgaggattaaagaatacttgtcctcccattttccaagatctaatcacaatgattcccagtccttacattataagatttgatcagatctgttctttgtttcctagcagcatgtgttccctagcagtcatacattccacaggtcctgatgtcattagaactgtgtgtgtcagtgtattgtgctgtctttagctgaaggtgaatgtgtcagagtatttgaatgccattccatagctcttccttatcactaagtattcagtaacctgatctatttgtgtatatggttgactagactatttctacaaaatcagggtaggaggaatgattaactcaaagttttatatgaactattaatttttttttttagatagagatgttaggctgcatcaggcatccccggcctgaagagtgataagccagtatgtgatttgcctgatgggtaaatgcttttgatgtctcatttttggttgcttggtgtgattatccttcagactgagagtgctcctcaaaaatatgaatggaaagtctttcagaaatgattttcttaatcatgatcttcttaacattttgcagatttaaatactcttttccacagggaataatagcaagtatggcacttactggctgcagctactgtggctggcattgtttctactaattaggaaaggcagattttttttatggatttgatttaccattgattcctttgtgagctatagccaaggaaatcataaatagtagattaaaaagactataaagtcatgaggattgaagttagtcaaataatatgatgcaaaactgaattgtttttcagattggatttggaccactttaagtgttggttgaaactctctttgaaaaggactgccaagtagaagtgacagttactgttagaagtggggagttttggcccag

SEQ ID NO: 111634 - DNA, 1057 bp, Homo sapiens
tagggacaggcatggtggctcacgcctgtaatcccagcattttgggaggccaaggtagatggatcacttgaggtcaggagttcaaaaccagactggccaacatggtgaaaccccatctctattaaaaacacaagaaattagctgggcgtggtggcacatgtctgtagtcccagctgcttgggagcctgaggtgggagaatcacttgaacctggggggcgtaggttgcagtgagccaaaggttgcagtgagccaagattgcaccactgcactctagcctgggtgatagagtgagaacctgtctcaaaaaaaaaaaaaaaaaaaaacacaaaacacacacacacacacacacaaaagaaaatatataggataatattataaatgaatgattctggaaatagtctgcttcaacaactttggaggaagactcataaacagcactggacaagaagactcaagatatgaattttagctctggatttgctgatgggccaacattttaccttctcagagcttcagtaccctcatcacaaaagggctataatatctgccttgcctttatctcaagattgttttaaggatcaagtgaggtaatgcttagaaaagtttgtgaaccatgaagtagtgtaatatcattataatttccctgatttgagtcatcacccctttttagaagaattaactgaacacgctgtctgctgaagtcttatcactctgtgctagagccttaacccaggctaggctacaacatgacaaaagcattatgaatttaatctttggtaaatgccattagagaccttcatcagggtaatggctctgcaccaccctagtacactacaactctgattatagtgcacaccacacttttgcccagttataaactatatgattgcaaaaatgaaaacttcagttcaattttctatgatttttccttagcaaatttaatattccagagaatttaaaatattttacataatgtaattttttatattgacagtcaatactcattacctctcacatttatttagcaattatgagttgtcagatatttggcaagtt

SEQ ID NO: 111635 - DNA, 5472 bp, Homo sapiens
tagataatctggactttatgctacatcaacatgatgtcatctgagccttgatgaaggtatagggagaatccatgaacatagtttgatctggcagagagcagtatggaagataagtagtggaaagggactaggtggaggccaacggattagggccagtaatgccattttaatagactgaaatcacagggagtgtaagagctgggattagtaggagagggtcatgattgtgagaggtttcagacttttaaagcctgctgaaagtcctggttgtgttgttctttatttagttggaaatgcattgttttggaatttagaaccagggccatggttaacctgagataagaagaaatgggtttaatgtgtgtatatggtagccataagccatggaaggagcacagagtaaaaacatttaaaggtgagtttttgatgaacacctccacttaaagaagtagaaaatgaagagtgagtgaaggaggccaataagggtgaatgttaatgagaaatttagaaggaaacctacaaaaataggacaatgtgactgtcaggttttaacctgagctggggtccaaagggagttgatggacaggtggtgggtaattgaaagaacactcagggggtgaaggggcataggcaggtgggacatggctttattatacgctgtccctcacagtgtcagtgatacatttatgcacttcacagacaacagtggctcagagtcaggtgatgagccgactcataacatggtagcataactgtgattatataatgcatgggattgtgcacctgcgctctaatcctgctgcatcatgctgtaacagatgtttaccttggcctactcttgactgccgcacagccattttccttacactccaccccctaggctgagggggtcctcttagtggggaaacttgcccacacggtggcaccctggacccataggccacagcagtaatacaagaagcaacaacctactactaatatccctgttacgctccccatgattatcagggcccaacgtaggccagagctcagggatgcccaccatctctgtggggggtcattagtaaggctctcaactgcttcaacctcctgtgccatctcttgcaaggctgctattatgttttgttgattttctggaataaatgtacaacattgtgtccctataagggcacagatgccaccttgggcagcttactatatctaaggccatccagttttgcagcaccatctttcatctttctggtttgatcaacctcattggttaacaggaggagggtgacttgggtgtaattcaggggccaagctgtgtgctctgcaagggctgtaacctgtgtttctacagtaatgacacctgctccagggatggtcaaagctaaggggtagagccaccaaggggcttgcagcacttgcaaaaagtgggaacgtagcacctcccagttgtgtgggcatctaggcaatgtgggaagcacagtggcaggcacaaaggccatccccaggtacaagggccagtccagttcactggtgcatatggccattccatgtctccacagacccataaactcccagggggcacaaagtccattggagcttgacgttgatgaggccacctattccactacacccttggtgtggtgatatatgttatatttgtgcaggctatggtgggcaaataccccatgttgacaccatcccattgttgctgtatacatcgtggtacctgtggggtgggggcactatgtgttcccctgctaaccagccccattcatcatagacattacaggtcagccaggggttgagcatgtcataggttttgccatgccccctatccaaagtttaccatttcacattccaggcatcgcccatgggaccccaagtctctagccatgtccagttctccatagaagctaagtgtatgtggcagggcaagccgtccatagctgctgctggaagggtggtgcagatcctacagttggaaagattagtcacctcagcataggtgtgggcccatttcacaatgcttttgcagcatgtcaatctatggtcgaaacgacaaagcaggcacaggtactaacaaggatgaatcatgcccttcaggcaaaatacaggctaaccattcatttctggtagctgccagtggcttctgcccagggtggtgctccccatggttcctttgggtcctctatctgtgctaaagttactggggagctcatattaggccacacagatggtacagatgtcccacagaggagggttccttccctggccattcccctatgaacagtcattcacggaggccatatattaaatacccaaggagtgacatgtaaatcacacagtaggccctcccccctggggctatggtagccaaccatctgcaatgggccttcgagagtccatggccaaagccaggttttttgttatcctgcctttaggtgcattgaggcaggcaacagcagattaccattcgtccccatatctagtgagaggaggtcatccttggtgtctgtatctgtaactgaatggaggcagtggcccagtgtagaagtgccccactggggctgggccacctttctgtggctgttcattcaaggtttggagcatcaggtccaaccttgaactacagccccacaaaggcaggagaataacatgcaaatgtaattcattttccataagtcttgccacatggcgtggctccaaatgagttggtgaccaactagccaattcggtaatttccaggtagttaaccacaagattgggccctggtaaactgcccatctattggtgcagattgccataggtgtctccttcttggtgatcaccatccacactgctctgagttcagcccactgactactttgtccacacctgataacaaatcatatggtgtcagtactaggctggaccgcaacagcagtccaggaagcagtcgcaccctggctggacccatccatatgccatgccccatcgggaatgggggggtgcccctctcctacagagtcagcagtacagttatgtttttcactttcactgactggcctccatagccgtctatgtatgcagccttgcctggaaacttatctaggttcccatagacgaggctacactctgcaccagcatttaccaatgccaacactggggagagtggattgccagttccacatatggcctctggtcatctggtttccccccaagccaggcaccttggccagttccctaatcaaacacaaaaggctctttacctccacccaccttcaagtagtctttgagctggagcatcctggtggaactgggtcgagcaacatcatcctgccccgtcttgggcattttctggaattgctgctctggggacaattgcctccacaaagttaacagcacttcactgggttgcctatcagttttatctcggtcaaccccagcccaaatcaagtcaattcccatctgtgtgcaggtcacccactggggcggttttttgtcccacgaggtggcccctgtggaaggggtaccttccccttttttatggcacaaagtccctggtcctgccaatggccctctgcttctctgagggccaccatggcagtagtcatctcatgtatgcagtgccccatgtacagagtaaggacagtggccagagagccgaaagcactcaggggtgcagagctcaacacaagttccctcatgtgggagggaaagcattcaacatatggccctcaggtatttaaatcaaacaaaacttgccacatacccatttcctgaattacctgcaccagctctgcatatgaatgccatttactcacagtttttggtatttctctggcattgttccataccattctatgacagccatcagccattcagtcagggtgtggtcgcctcgcccctgtgttaaccgcctgctcacctgcaatcgctgttggagggatgggtcataatggaggccaacttttccatttcagaggcagagcagacaataccatcagctccctcatccaaaaggcaaagcatccaggtagataggggttcccccatgcactgctgacactgtttacctaatttatgcaagtcagttggggtataggcactgtatgacatgtgctccaccacagtaggaggtccctgaacccccacgccctggggccccagtggctgttcctgctctattttctgacggaccactgggtgagcctgcagtggaggttcttcctccttggtatcagacctggcgggggtctctgactgggatggctggcccaggcccacactagtggcaggccctaattctcgtttcaagctgtatgtccggatctccaggcgctctgcttgaccctggaggtcccttacctgagctgtatccctcagggactgagtgtgcacttcctgtagcacagtcaaaaacgcccatccaactctgccggcaaaggctcgctccttttcagtgctctgtgcttcaaagtgcttcagcgccttctccatggtcatgggagacccgtccaccatcacccgtgttttcaccggggcccatctgagcaggaaggctgccacaaggtaacacaacccatgctgagaccacatagctgacccaggaccatcaggggctgaggactcactcacctcggaatcctgttgactacgccaattatcaggttccaacctgagctggggtccaaggggagtgggtgaatggatggcaggtagttgaaacaacactcggggggccgtaggcaggtgggacatggctttattatgcaccacccctcacagtgtcagtgatacatttatgcacttcatagacaatagtggctcagagccaggtggtgagcccactcataacatggttacataactgtggttatataatgcaagggattgtgcacctgtgctccaaccctgctgtgtcatgctatgccagatgtttaccttggcctactcttgactgctgcacagccattttccttacagcgacagaagataacattaaagggaatgttaaggaaagaccatcaatagtttcaaaggctaccaaaattagatctgaaaaaattctagtgccagaaaattagtttatattcaaatattgagagacagtgtatataacttactaggtaagagtagattcaggagtgtgttgtctgtttctgccacttaccggctatgtgatttggtagttatgtcatgcctagcctcagttttctcatctgtaaaattggagtgataatagtggccacttcatgaatacatcatgagtattaaatgaattaatatttgtgaaatgcttagccggtatctgtaacatagacctatctaactgtatctctgtaactatcatatatctcacatgttctggatatctagctatcatttatctatctatctatctatctatctatctatctatctatctatatcatctatctatctatatcatctatctatctatctatctatctatctatctatctatctatctatctgtca

SEQ ID NO: 111636 - DNA, 1068 bp, Homo sapiens
atcaatgaaactagttcacgtgtttaaaactctttaacaacaaaaataactatgatctacctggttctctcaagggcaatataaccttacccactacgactatgtctgtgcaaagttaattacgacatcatgcaaatagcacctagcaccttttttatctaatagatttccaatgattcaatgtactggtcattatgtattagagatttattctattttttccaggtttctaatgtactttaaatctatattttactttaagttactatttttcttttttgaaattaaatatgtgaatacattctcattcatagtatagatttaggtaaattatgactacacatttgtttttggcatgaccatatgttgaggtcatatttctcaaggtaagtttcatcaagtttataaaaaaagcaatagggatttaaaaaataaactatactttataacttatcgttttgagttttggaagtatccggtagctgtctggagggtaggctgagagtgggaataaggatggggaggagtatgttgagaatggaggctgggggtaaaattagttgttgcaaaagacaagtaatgttgggagcctgacatggtttggctgtgtccccacccaaatctcatcttgaattgtaattctcacaattcccacatgctgtgggagggacccagtgggaggtaactgaatcatagtgtgggtctttctcgtgctgttctcgtgatagtgaataagcctcatgagatctgatttttgtttgtttgtttgtttttgatggagtctcgctctgtcgcccaggctggagtgcagtgggcgatgttggctcactgcaagctctgcctcctgggttcacaccattctcctgcctcagcctcctgaatagctgggactacaggcgcccgccgccacaactggctaattttttgtatttttagtagagacggggtttcaccatgttagccaggatggtcttgacctcctgacctcatgatccacctgcctcggcctcccaaattgctgggattacaggcatgagccaccacacccggctgagatctgatggtttt

SEQ ID NO: 111637 - DNA, 1045 bp, Homo sapiens
gtaagagctcagtgtatttctggtgaaaacacacatcaatgacataaaagaaagtaaggcaaatgttaaaattgctacattacaaatcataaaaaagagaaacattgaaattctggggaaatttcaaaagttaaatttatatgcaactaattctgtttaattgagaagtgttgcaaatttgataacgatgttaactctctgtctacccattttctagcagaaaacattcatggagttcttaaaaaggtctctaacaaatgaaggatataacaattcaccaagcagtgattttaacccaatatccctatgtaaagtagctatttaaaaatactctcctaatgtacttttctcagtttatttttccaaaataatacaattattaggtagggggcaattgtatcattatagtaaactataatatgaaaaacttggattaattggcaccatatttctattatccatctatttaacagaactgaaaatgttgctggtataaagaaaatattgaaattatgtgtttaggataaagggttatggtgctggaaaaataatattagaattatttcaaaggagaactagcaggagaaaatttgcctctagaaccacagaagctaacaacaagagtaaaactataaaccagggaagtcacaacaaagaggtttgttccctagaggacagagccaaggaagttggcctgctgtgcttatgtttttaaagttctgctttaaatcctatcttggcaggctaagaaaaacataatgtggtaaattttcttttcctgctgatagatcagaaaacattcagtagcactaattcaaaaagcagaataagaaagcatgttgaaggcacaggaaacaggccaggcgcggtggctcatgcctgtaatcccagcactttgggagaccgaggcgggcggatcacgaggtcaggagatcgaaacacagtgaaacctcgtctctcctaaaaatacaaaaaattagctgggcatggtggcatgcacctgtagtcccagctactggggaggctgaggcaggagaatcgcttg

SEQ ID NO: 111638 - DNA, 1081 bp, Homo sapiens
ggatgaagtggctgaggcaaccatttcttttcttgcacctggctggagaaatgaaattctgtagaaccaatttaccctgcggatgtatcctagccatgtaataaaaggggaaagctgcagtttagttttactaggcatagatttgttattttgatctcagtatatcttactcctgtgcttattcatcatttgattctgaatttggtagggaagaaaagagtgtaatttatcagttgtactgataaattagctactgccaggttaagaagctacattaaagaatgaatagattttgcagttacaaaatctattcattctttaatgtagcttcttaacctggtagtagcttttttgctgtgcttaaatttacatacctactttactgatttagctacttcattttgcccaaaaccatggacatctttcagccctcaccttactcgattgcttgatggttcttgatggagttagatgttcactttttatttaactgctaatttttctaatttgttttcattatttcatactttcctgatacaactactatttcaatggctgaccctttctttttctttgtttactttttgtttattcagactctaattattgtacttcctgagggcttggctctgagatttgttcctacatactctctgtggtaagttgtattattgtacaccaatatttattttccctttcttttttttttactctcagccttctaacgaaatataatttttttatcccattggcgaagtgacactttttctagcttaatgtgagcaggtttgccacatgctatgtctgagcaagagctacaaatacaatagcataatttggcttagcttctcttgtttttccccgcttctgtgaggaaagtcacatcctacattgaaggtatccatattccccagtctagaattaaaaggacaattgtagaagacacaaatatgccccacagactagagcagaggcacaaccatcccacagaatccacaaaaacggaatgagaaataaacctgtgctgctgtcagccactgagcttttgggcttgttagttacacaacataaactctcaaga

SEQ ID NO: 111639 - DNA, 1116 bp, Homo sapiens
cttcaaattgttgggaacaaagaaaacattatctgacctgtttatcattcaagtgtcagacaattcatgaaaaaaaatgtattgttacaaaaggagatacaacactgttaaacaataaaacattattttcttgtattattgttttaaattaaaaaatgtattttttaactctacaaagagcatcataataaattgtcgatttgttcaataatagttaacagttagttaggtccttagcattaagaacctaactagtaaagctcaaaacagctgtaacgtgtcttgatgaatggtataaattttaaatgttcttgttaatttgaatttctcattttactaaataatgcaagaaaaaaatgagccattgtaactaggacaatatttggattacattagtcactgattcaatatattgccacagtaggcattcaaaaatgatttgaatcaattttaaattcatacatatatgttggataatattatgagcgaagaattgtactagatagtatagggtacataaagaagatgatacattacatgttatcaaggagcacatccaagcaggtcatacacattatataagcactatgtgttctttttcaacctttcagtgaatatatagacattcttagagaacaaatataaaataaattccaaataattgaagatgcactgagggagccctgatcctctatagacaattagaaaacaatttgcttttgaacataggtggaaatgaagagggaaatcagactgaataaaatatgcttaaaacctaaatttaaaatccatagcttagagaacaatagacttgataattgttgaaactttccatttaagttatgcattttgttctcttttaagcaggcacctgattatttttttctacatgaaatatagttaataatagtttgtaacatatggatagataattctaccaaatgatgatgacaatagtaagattaacagaatattgcatgattattaaacagttctaaatgcaaatttgttttctagcttgctactatggcaaaatgtcatatttaacatttttaaatggtggaatactttacattttatatttaacataaattttatatttaaatataatatttt

SEQ ID NO: 111640 - DNA, 1038 bp, Homo sapiens
ctttatcctagaaaaggtacctgttcccctgaaaattaatatgattagcctgaagacatagtgaaaaatgacaaccactttattaggttactaagatcatcttttcctgtctattcagaaaaacaaaggtttcaataattcagaattataatccactagtgataaaaacaaattaatcactattatcattaaatatacaatattagggcccactgagagccatcccagtaacccgaccaccgctggtcttcactggacaccatgaaccacactgtccaaccttctctcctatcaacagcggccagccccccaactatgagatgctcaaggaggagcatgaggtggctgtgctgggggtggcctacaaccctgctcccccgacgtccaccgtgatccacatccgcaacgagacctccgtgcccgaccatgttgtctggtccctgttcaacactctcttcatgaacccctgctgcctgggcttcatagcattcgcttactccgtgaagtctaggcacaggaagatggttggcgacctgactggcgcccaggcctatgcctccaccgccaagtgcctgaacatctgggccctgattttgggcatcttcatgaccattctgctcatcatcatcccagtgttgatcttccaagcctatcaatagatcaggaggcatcattgaggccaggagctctgcccatgacctgtatcccatgtactccaccttccattcctcaccctgcccccggagccgagtcctgtgtcagccctttatcctcacacacttttctacaacggcattcaataaagtgcacgtgtttctggtaaaaaataaataaataaataaataaataaataaataaaaatatacagtattacacacttacccttatatgatatccacatttccaaaaatattcagttgcatcctcctctttgctcactcatgtttaagtttttcctatagcaaattaaaagggaaagatacaggaaaagagagaaagagggagtgcgagcaagtgagcaaatcaaatgaaaaactg

SEQ ID NO: 111641 - DNA, 1061 bp, Homo sapiens
ttattccctttaagctacctttatcttcatattctctccagtctcttccctgctgaaacatggtttcaacaacaaacctgacctctttctctgtaatgtattcctcttttctccactttctaaaaactatctcagggcagtctcaacgacaaatatggctttgacagccactataagctaataaccccccaaatttacacatttctctcctgagcaacagaatggtaatgataacttctcatttgtcatctccacttgggtgtctgacagacaccttcagtacaaaacacacaatagtaacttcttaacttcccctcaaaatttgttctttctcctacttccccttctccttttttaaatcccatactttatttcaaaacctctttttgtttaatgctatcactagttacccagtttccagaaccatggatctggagttcatcctagacaatttcctgtctttagatgcctgaaagagtgtttcctatgggattccaacagcagtgatcagggcaaaaatgaatggctagagaggaagacataaagactgtttttgaagacacatgagttacttccaggaatccccataagtaactgagggggttattaaagaaggcaggatatgtgatatcaagaacaactacaaaccagaggaatttaagttactcaattttacccaaaaactaataaaacctagacatttccaaattacatagtttggatgtctgtttcttccactatattgtaaatctctggagatcgtgagctatatttcattaatctttgatttctcagtgcctatcatggtacccaacatactgtagatacttaatactatttaatatttaaatgaataaattcatataaaagataacttttccggagccatttactttttttatgattgaggaaattcagtggcagagtgagccttcctctgagtccctgatcagcgaaggagtcattgctccattatctttctcatcaggccattcccattgagagatgcgcttcaggccagggcttctggattgcttgtcagcaagtcatcttactctgca

SEQ ID NO: 111642 - DNA, 1439 bp, Homo sapiens
aaatttaatggcttaatactcttgggctgggcgcggtggctcacacctgtaatcccagcactttgggaggccgaggcgggcagatcaccaggtcaggagatcgagaccatggtgaaaccccgtctctactaaaaatacaaaaaaaaattagccaggcgcgatggcgggcgcctgtagtcccagctactcaggaggctgaggctggagaatggcatgaaccctggaggcggagcttgcagtgagccgagatcgcctcactgtactccagcctggatgacagagtgagactccatctcaaaaaacaagaaacaatactcttgtattatctatctcacagttatgtagagagaaccatgagcttgaccaggtattctctttagagtattacaagactggaatcaagatgttgacaggtttgtatttctttctggaggctgtaaggacgaatctgcttccagtctgcttccagtctcgttcagactgttggcagaactcagttttaagtggttgtgggactgaggttcccatttcctcactggctgttggccagggtgtcattcttagattttagaaataactcatgtttcttggcatatggccccacatctttagtgccagcaacggtgcaagtccctttcatgcttcaaatttctgtgactgttccttctctttcgtttcttctctgcttccagcaggagaaagtactctatttttaagggcttaatgtgattagattgggcctacctacattatcaaagataatctccccatctcaaggtcccttttgccatgaaatttaatgtatttacaagttctggagattaaagccagcacatttgtggggagtcgttattcttcccactacattttaaggttcctttgaagtattatcatggttcagttttgaatgagatttttatttttatttttacaggttttttatgttaactttggtgaccttttgtgtactttacatgaaacaccttatatattaagtactggggattcgttctatgttccttcaggtaagacaatttatttcacttagacaacatgtatatagttgtttttgggcactatggaaatggaagccacagtggtcaaaatgaagtgtgatatgactgatggatgtcagaacagtttggtacatattttcctttcatttgatcattaggtaagtgtattagcattttgtggtggtttttttttgtttttgagacagagtcttgctctgtcacccaggctggagtgcagtggcacgatctcagctcactgtagcctccacctcctgggttcaagcgattcttgtgcctcagactctcgagtagctgggactacaggcacgaaccaccacatccggctactttttgtatttttagtagaggcgggattttgctatgttagccgtaacagatcacctgacctcaagtgatctgccc

SEQ ID NO: 111643 - DNA, 1057 bp, Homo sapiens
acttcagaaataataccataggtaaaattcattttttaatgtctactttcttccaaatggaaagtaagctaattttattcttaaaaaattattaatagcatattataaatttcttcatgagtaaatttcccagtcaaatgaaacccaccattcctatgcccaagctatggttaacatagacatttctaaagtgttttatatacctctatctcacttagagattatgcaaaacatcacttaataccttgataatgcaagagtttacatgttaaggcttacagaaaataggaagtttagggtgtttgcttttatattaaatcattatgggtttttaagtttgaatttttgtttatcagagtgatttataaataggaagagacttctttgcgtttgacagttttataacttctctatagctatattttgtactgaactttttgggattgagaataattttaagtaagtagtttgtatttcaatggtatttcttttgcagagactaacttaatggtaaatctaggtatacctcttggagatcctttgcagccaacgagggtaaaggacccagaaacaagagagattattctcatgggtaagatcaggcatgatactgaaaatacttaattaaacaatttgtaagaaaatattgcttgcttgatgattggcctgtctactttccctttctctccccaattctatcagtgctaaagtccagaagagtctaattccaacgagcaacctatgtgaagacaactgtgggggaatattgatatcagacagctccaggggacacttaacaccccggacttgtcctctggggcacaagtagtgctacaatcaggaatgtcgtctcccccaacagggtctaggccttctttgaccaggaggacacatgggaacagaggctgtttatggggaattgtagatagatagttggcagactcaaggatacgcttatcatgaagccaggcagggattgtgggtagggcacagacaaacttctgggcctacagatggcagtaatgttacctgggatatgaatcctttgtgaggatga

SEQ ID NO: 111644 - DNA, 1063 bp, Homo sapiens
tggggtgaaatgatgaatcaggagtagggaaagggaaataaaaatgttcctgagcagggcttcagtatttacagaggggaacattgagcattatgcctaagagcagtaggcaacttctcgttagcttcagcatagctttagcaaacaaaaaataggtaagaacatgggaatttgaagataagccaacaaactcaatttagtatacagaactttgcattgttcagataagatgagtgtacatttaacattgtcaacgctgagtattattaggtttttaaatatttgccaatttggtagcctgtttttccattggcttttctttaattgttagcataaatatttgttttttctagtcttttgtctagaaaaatattcatgttctaaaaaataaagctttcatgttctaaaagacagtctttccactgctaagtaccatcaactaaaaactatgtatacacttttgtctgacatctttttatagtattgccctccaacacaccaaatgttcgcaggaccaagagaacacgtttgaaacctttggagtactggcgaggagagcgaatagattatcaaggaaggccatcaggtaaaacttatttatgttataatatctgtcaataaaaaatttgtttactatgtgccagacactgcactacatgtttatatacattaccttacttaatcatcacccccccaaattttgataataggatttaaattcatttttgtctgattaatgtagagatgctgatattttctctttggtagctgaatgttgttattcctgtatcatctgacaagatttccaattgcataatataaagcgttagattagaacgtgagaaaattgtaactggtaaaggtaaagtagttttcattatttttcctattaaccattttccattttctcatagttttctacaaagtagtgtagggtgggcaagaaagtgtagtgttaatcgtagagttattttctttcttatttttgtagagatgaggccttgctatgttgtccaggctggtctcatcttatgggctcaagcagtcctcccgctttggcatc

SEQ ID NO: 111645 - DNA, 1036 bp, Homo sapiens
tgagactgtttcctcttgaatcaattttgataatttgtgtctttctaggagtttgtccatttcatctaggttatttaatttgttggcatacagttgttcctagtattctcttgtaatcacttttatttcttttgactttaatggtaggacccaggaggatactagaacctgaagaattatacagtcactaggaagagtgtatcttgtttgcatatatttggagtaaactaactaccaaagagatgagctcagtccctctgaggaccctattgcccctcagtaggctgactagggatatcaaagaagccaattttagttgtttatggattctccagtaaaccatgatagattaactgtaatatatatcaagctgcttatagataaggtctccttatgtccctttcaccaccttccttggcaggtgtcttctccatttctctcatcagaatttttcaaattgggactcttggtaggtcctagaaaccagtttccttccttagctagttgcaagtctcagaacctgaacagggtgatctgatattcgttatagccaatattacattgtctttgtacccacctgtgtatcgtttctggaagaaaattttattttgaagaagtataaacactcatacatttatcatttttatagatctacaagaagctcaaagaatgaagataacattatgactgcacagaatgttcccctaaagcctcagaccagtggatatacatgtaatataccaacagagtcaaacttggattctggagagcataagacttcagttttagaggaaaggtatgcgtgtattgtaaggataatagttgtatatattagttacccattgctgtataacagattacccaagaactttattttaattttgttaaaagcttaaaaacacttattgtttcatagtttctatggctcagcaatctgggaggcttagctagctagttttggctcggatattctcaggaggtagcagtcatctttctggttttaaccctttaaagtcttgtctggaactggagaatc

SEQ ID NO: 111646 - DNA, 3001 bp, Homo sapiens
gttgatgtctagatttctagctctaaatttttgtgatgtcattactattataaataagggtgaacagacatagaaatgtgaaaggagggaaagatttgtaagattaagggaaaattgaggagatatataaacagtttaaaagaaatttagattttatttcctagattattttctttactaaacaaatataaaagctttatttttttgaactgttaaaagtatcaccctgtttcagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactccttcaaggtagaaagtcaagagaaaagcatcataatatattacctaagactttggcaaatgacaaacattcccataaacctcacccagtagagacatctcagccctctgataaaacagtactggatacaagttatgctttgataggtgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggtaagtgtttatattaaatataaccatgagcattattctacccattttatgttttttaatatcctaacttagctttggcaagtaggcaaagtaaacctaaatgaacaaagagcctgaaaagcctataggttcttttctagaacctttttattttatatataatttaattctaactcatatagtttttgtttatcttgtgagatggcagtatatatagagggcaaagtgaaaagaaaaggctagtaaacaagttagtatcggaagatgaataagacagaatgataaattatttagaaaataaaaatgttaaaaaaaatcccagggtaccgtgggactattttttatagagataaaagtccattctcttccatcattcactcatgtgtctaacagttgttgaatgccatacactgcattaggcactgtaatcacaaaaattactaacccattatttctactgttaacaagatcattctggtgggttctgtagaataatagataatatacatacatgcataggattaaaaggaaggatacaaaattttgatttatccataatttcttaggaaaagacatatgaaggaagtatacttgaaagatgcgctctataattgtaaatattaaacattttctgagtacctgctatattctacacactaatttttacatatattctgtatctagattggttagtgaatataatgctcattaattaccatatcagttgtattaattttctattgctgtcatatgacaagttactacacacttattggcttaaaacaacaaacattgattatcttacagttctgtgggtcagatgtctcactgggataaaatcaaggtattggtggggttttctttctttctggtagctctgggaggaagtctgtttctttgccttttccaccctcttgaaactacctatattccttgactcatggtcctcctccaccatctgcaaaactagcaataccagccttctcatgttgtgaatttatcttgcctcttcttccatcatctcatctctctgaccacagcttttaaaagaaacataattagattgggtcaacctggatgatccaagataatgcctctatttcagagtttataatttaatcacactttaaatctcctcttcttaagttgaaaaaaatcattatttcaaaacaggaaagcagtaattgcctacttttacttaggacgttataggaaggaactgtatttttttttcagtttcagaagatacttatttttttggctgaggagtatataagagttatcaagcagtgtgaaaatttgcatttaataggaagttagtgcttacttcagcagcacatataattgacagaaagagaacatgtgacttttaaaaatggagatgaaaaggccacaggataaatttaagaagttcctgtaattgacggtttttttataatcttgtggttttctgaaaactcttttagtagattgtgaattggttttatggttttctttattttaggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtaagtatttttatttaaattgtgtttgttcatagacaaaatcattctgtaaggggcattatgtttgattttatatttctatatagagaatatcatgaggaccaagttaaattgggtcatcaaaaggaatattaaatcaatggtaaagatattccttgaagcgttaatatatacagtattttaggaatagggataatagctgtgggaaaacaaaaccccaaaccagaaatccctgctttcatggagcttgcattctagttgggaaaggcaatataaataatccagctattttaatgtcctggctgtgagggatacaaagattgataatatgaggttctgccaccaaggagtttataatctaaaagattatagtttattacacataaaaaagtaaattacttgtgttggaggttcccaagactaccctcagatttggtaatttgctaggaggactgggcatatagttgtactcatggctgt

SEQ ID NO: 111647 - DNA, 1985 bp, Homo sapiens
aactagtttacagtcccaccaacagtgtaaaagtgttcctatttctccacatcctctccagcacctgttgtttcctgactttttaatgattgccattctaactattgtgaaatagtgtctcattatggttttgatttgcatttctctgatggccagtgctgatgagcattttttcatgtgtccgttggctgcatagatgtcttcttttgagaagtgtctgttcatatcctttgcccactttttgatggggctgtttgatttttttcttgtaaatttatttaagttctttgtagattctggatattagccctttgtcagatgggtagattgtaaaaattttcttccattctgtaggttgcctgttcactctgatggtagtttattttgctgtgcaaaagctctttagtttaattagatcccatttgtcaattttcacttttgttgccattgcttttggtgtttttcatgactgatacttattatagtcattcagccaggatacacagctgggtcagtaagggaaaaatgcgcattagcagagtctggaggaatccatatataggcttcctgtgttcctcaaggggccatatagaatgtactcattcccttcagcagtgaaatgcagtaacgtgtgtacattttttctcctcagagaagccttttgaaactcagcctgttttcactgggggttggtcccataggcatcccctgcctaccaaaattttacgcactcccagaaggaaagaaagcagatgttcaccacagatcacagtgtttatttatacaaacagtctaggcaggctggcgcagcaggtgcaaccttctctgttggtaatggagggaacattctaaaagttaagtctccagatgccaaccaaggggtagccctgtaagctggtcctttaaatatatcaggcctcctatgttaactctttcctgcagagtgaatctcaatactacagtgttttacgtgtctattttgaactttacatagataagattgttatgtacttctgcaggttgcttttttttctggttaaaataataatttatattattgtagtttatttgttccattgttacgtatgtaatatggtatatctatactataatttatttatttaataagtttattcagtcttctgtccacatagttgctgtttagagtaatattgtttctgtgataggttgtatgaaatttcagctttactgaataatgccagattgttttccaaagtagctattactttagaaataaaataaaaagtagtataaaactcttaacagctggtttgttgttttagaatacttgtttttccccccatttaaaaaacaaatatatttcattgaattggtaagttaataaaatagttctaatgttgtatttcttctgtgctcagtgccagaaatcacatccaaagtcagttccagtttcttcaaagaagaaagaagcctctctacagtttgttgtagaaccaagtgaagccacaaacagatcaggttggtgccatctccatgggcattatttgcttggatatatttaaaaaatgagaaacgctaatggtgcatgtgttgctttgagtatgaaggtcagggtcagcctagacagaattgtgaattgtgaaatggatgaatttgtttttgatttccttacaactccatggtcagtgctctttttctctcttcttctccatttcctttagtcagtgatacatgctactactttttaaagttttctttctttttatttttcagattaaaagagtgttactccattgagttaataaaggtttaaaataagaatttagtcattactcctatcattctgctgaggtagcctttaaatagttctgtaccttaattggtgcccataaatgaaaaaaaaaaaagcatgtgtgtttgtatgtgtctgtgcctgtacctgctttcagaaaaggctattataatttccttttacaccaatagtgtaagagtaccttttacct

SEQ ID NO: 111648 - DNA, 1649 bp, Homo sapiens
tgctatctcaactcactgcaacctttgcctcccaggttcaagtgattcttgtgcctcagccttccaagtagctgggattacaggtgtgtgccaccacgcctggctaatttttgtattttttagtagagaccaggtttcaccatgttggctagtctggtctcgaactcctgccctccagtgatctgccctcttcagcctcccaaagtgttgggattacaggcataagccactgcatctagccagaaaaaatatataatgaaaatagatgtgtagaattcttggaatcgctggagaatttgagataatctttggtgatttacatatctgtttaaggaagtcataaattacagcaaaaacttttccaagtgctgattagcatcagcaggtattggaataagagaataagccagccaaagaaataggggcagatgatagaaaagaatgttttctatacaagctctgaaagaagagctggcatatattgatacttcaggtgttttgtttgcttttctcatttcctgatgcttctcaggaacatttgaatattaaattgaggtctctacttgatttaagctaattgtggtcagtgagtcaacagatggttcttcacatgtcatatacagctacttttaattgtgactaatagatattacactatatcttgtttttgaaaatttcatacttttgttttaggtcttgccaatgattttagtacaaattctacaaaatcagtgcctaattcaacacgcaaaataaaagacacttgtattcagtcaccaagcaaagaggtaagtgataaagaagagctggtataggtttaatattttaatgaatgaaggtatacacaatatactcatgtatattttagttgtttgtaagtcttattcttgaaagggaattctatattcccattgactttctataaaatttggaggtattttgtgaaaagttttatttgatattttctgttggaattgggattatgggaattagaattatcaaattataataaacatttttcacttctcctaaaataatactcaaattaggtttttaggaaaatgggcagtgatcaaagttgctaatcaggttggcagggttggttatattctaataaatgaaggcacttcattgttatacggggaaatcaatcttctgttgattatatattttaattgctgttagtttgatcagaaataaagtattggttgacttaactatactaagtagcagactttcaaataaagtatttgaagctaatctaaggcaaattattcaaaagcacaatactaattagaaaaatcatatagtgctagaagtaacacttactagaaaactgtaaaaggcaatcaacatattaaacatatgtagccttttggttccaagcaatgcagacaaaaccatttctttcagaattgagaggccttctgaaacttgataaattacaatggtttttgaaagttaaagcaactttaggttttctgggataaacttgacttggtcataaagtattaactttttttgattaggtttgcctaatattgaagatgtttgcatctatgtttatgaataatattgtctttttttgaaaaatgttcttacagggctttggtatcaaggttatgctagaggttcctcttctaggtaga

SEQ ID NO: 111649 - DNA, 1060 bp, Homo sapiens
ttcacttttctcaaaacctgtttactaattccttgttaaattctttcttaaaataaatgatgtttgttttccttgagcaatacacattttttctctttactagtttgtcttttagtaattatattccatcatacatattcagattatataagactaaagttaatcattacctttaccttttggcagattttatttttcaaaaatggctacagcaatattttcaatcccacatactcttctagaagcttactacactgtagtccccattaagacccctgaggtcaggtcataaaaggatatatagctggcttccttttggctctctctcactcttttacttgctctcttggaaagctcacctttggaacctagacgccatgttgtgaggaagctcaaactagcacacatggagaaaatctcatgctaccagcctgcaggcagcatcaggtggtcagacatgtgagtaggcagactttcaaatgattccaggccctagatttcacagagcagaaacaagccattggtactgttctgtggtgtgccatgccaaacccctaacctaccgactccatgaacatggattgtttatgcaactaagttttagagttatttattgtgcagatataataactagaacaactcttcaatttccaagttatgtactattgtcatatattttatctgtattgtgtgttttaattctgttgtcatgtactttaatgttctttaattctaagactttatatagtcagtgtttgtgtttatacatacacatatatataaaactttctttgcttttcattattttttgtatctaagacttactcctatgggctgaacgtttatgtcttcccaaaatttatgtgttgaaattctgatcttcaaggtgatgtaatttggagatggggcctttgaggggtgattaggtcatgggggcagagcccttataaaagaggctggagatctctcacccctaccatattaggacacagcaagaaggtgccatccttgagccggcatgtggaccctcacgagacactgcatgtaccagtgccttaat

SEQ ID NO: 111650 - DNA, 1006 bp, Homo sapiens
aaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataattgtctctttgtttttatagtgttaccacctatgtgtgtaaacttaaacaatacagtttgcttgtttttgagttttatttaaaatcatacattcttttgtagctgcatttgttcaagatgggattgattcatgttggttgtagctgtactttattcttcattatgtctgtgtaatttacttttctgttaatatgccacaatttatttactgtagacaattgggatgtttttagtttcaggcaattacagtttcacaatgaacatcattttatgtaactcctagtacaaagagtatatatttaggagtagaattttttggtcatagggtattcatatcttaaattttattagatgattacaaatttttttctaagcattagtatgttggttggttttgtgttgctataaaggaatatccaagactcggtaattcataaagaaaaaaggtttatttggctcatggttcagcaggttgtacaaacattgcaccagcatccctgcaatcatggcagaaggcaaaggaggaactggcgtatcacatggctagaggagcaagagagaaatagaggaagtcccagatcatttttaagaatcagatctcacattaactcatggagcaagaactcgtcatctcaacgagggcaccaagccatttatgagggatccagatatccatccccataacccg

SEQ ID NO: 111651 - DNA, 2756 bp, Homo sapiens
aatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtaatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaat

SEQ ID NO: 111652 - DNA, 1011 bp, Homo sapiens
atgagagtacaaaatactataatccacagtaagggatatatagcactatatttcagatacatttgcacaagtctcaaactatatatttgcaagataattattctggcattatttatcgtggccaatgattagaataaccgaagtgtccagtaatggggtactggaacatccacacagtgaaacccattttaaaaagagagagacaacactgtcttgctaaaacatactgatttataatacactggaaggatcagcaaggtactgattaaaagtggttatctatatgatgtgatgaagaaataagattatggaatattttagaagatatattatcctttatttccccacattaatttctagcctgatcacaaataatggacttctgaaagtgggttttttttgtgtgtgtgtcatcactaaaaggaagaaaatttcaatgtttctgttctgaatatttttctgtaacagaaatggaatatcatttacaatttgggatcgatggaccgtacatggaaaagaagatttcaccctcttggatttcataaatgcagtcaaagtgagatacttttgttcatttagttcattagtagctttatgtctggtttctgttttgtttttatttataattttattggaagttataattatttaccatgaatttgctttttttactggtcataaaacattgtttacgaacaatgttaaataagcattttatgtttgagcgaggctttcattgtttcttttttggatattcacttttaggagaagtatggaattgagccaacaatggtggtacagggagtcaaaatgctttatgttcctgtaatgcctggtcatgcaaaaagattgaagttaacgtaagtattcaacattatatgcagcgattaacaagaatttaaatgtaagttgatgcacactaaaaaattaaatatagaggttactataattcagataaaagcattagtcttgtctaatgacattaataaagacagtgaatctgccaggtga

SEQ ID NO: 111653 - DNA, 1059 bp, Homo sapiens
ttctgaccaagaaagccagccacaacccttcccacacaaatgtgaatccattcatttacatggtaaataacctcattatttataataaatatctaaggtgaaaccaaaatcaccttttttactttatccataaattagtaaaatgacaatgtgtttttacatttaatgaaatcaaatataagaatcttcagttatatggaggaacaaataattactactgaataactccctaaatctcaaattattttcagaggagttggtctttgtgtgaatacctggaaacactatattagatacacattagattcacacttgtgtgtatatgtatattttttctatttttttaatttagtttttattctttgaaagagacaaggtctcacatatgtggcccagcctggtcttgaactcctaggctcaagcaatcctcgcacctcagcttcccaagtagctgggattacaggtgcataccaccacacccaaccttatgtatatatatttttaaacacttagcttgcattcactaaccttcctttcagcagataactctatgcttaattttctcatctggtggtggttttaggcttccagtcaccttatgctggactgcttcttctataagactttctttttttgtttttaaataaacacatttacttagtttgaacttgatatatactcattaagaccaaatgtataatatttcttatgacttaaaatgaattattgttcactggtctgagttttctggttctgtccactcactcctcttcccaaggtagtcatgatcactacctgaatgttaagtgtttttgagaataactgtttgatgttttgtcttttataacttctgtagtgttttggtgtagaccagaatatttttgtctaacttaaaaaaaaaaacttgaaataataattctgtggttatatttcttcaaactacatttaaaggctatagttcataatgagttaaatatcgtctttaaaactgtacattcaaattttgctttattttttaatttcaaaaggcacctcagtttccttcagaatgctgcaaaa

SEQ ID NO: 111654 - DNA, 1008 bp, Homo sapiens
ttttattaagccctttggaaagaaaaaattgaggtaagttctagttaaaatttcatgagggaacaataatctccaagacttattactcttatagtgaaggcaactttaaagatgttttctcactttcttttaatcttttgctaacaaggcccactttttagtatcaaatattcatagcacttatagtgagtacatatattatagtactaataacttacagctaggaaaatatgaggataacttgtaagataagaaatcagagttaaaattttgtatgctatctcttaccattccccttctcaaacagaaaagaaaagaaaggttaaagaagaaggaagggaaaaggagcttgaggtgaaaaaagaaaagcataaaacacatgagttgacacttcaaacttaggctaacttttggtgagggatgtgtatatgtttgtaattggaagtatgttgattttttttttctctcccattctagaagatacagagtggacacagtttagaaggctgttttcaagttataaagttacttagcagaagacctagaaattggtcccagtgtgtagaattagcaagattaaagtttgaaaaatattttaaccataaggtaagtatgcattgtgagacattaagaaaaggtctgatcttggcttatttagttattaacaaattaatttcattgacctgaaatgtgtattctttcttttggcaagcttttcagaaattagtagtaagttaaatgagaacacatgctaatctaaaagaagtttgttcagaatagaagaagcaagaaactgagaaaatagggacatttagtcagaaattttgctgagattttgccatttccacccatatctgataatcacattttatgtctgtttccccatctgtaaaatagaaataataaatttgtacctaatacataaggtagtggtaaagataaaaggaggtaacacaaagcatttagaacagagcctggcacataaaaaattactaaatattagctgtt

SEQ ID NO: 111655 - DNA, 1451 bp, Homo sapiens
ttgagaagagatagtgtggtagaacttgtagttagaaaataaccaaagaagaaatataaagcaagggaaaaggagtaatattgttaggaattaacctagagataaaggttaagaaagccccagatttagggtactactagatgtatatgtatattgcagaataggggaacaggaatgatccactgtttgatagtagtatatctgttttcctaaaatactgcattcaagaagtgatcagtatgtgaaatggtcaatagaaagttgtaggttgtcctttggttacattgttattgctcacttttttgttttttacttgctgtcttttcaaatagtcgttgcttagcaaatctaaggcctcttttagattctggaacaatgggcactaagggacacactgaagttattgtaccgcatttgactgagtcttacaatagtcatgtaagtgaatcaatattttgaaatagatgtcttttttatatcttgtaatttttgtcttaatcaacaatttgatttagctttcctaatccttctgattttgctctgccaatgatgttcatacatatgtgcatgtacattttttaaaatataattgaacttttttttaattatcagaattttgtgtctggtgtttctggagcattattcttctgtttactatttatttctcagagctgcttagttttctaataccctttgagtttaagattgtttgataagaacaaactattagattgagactagaactgtcaacaaagacataaaattttattcacttgctgagacaaagtgagtcattttagattaggtaaaccaataaacctaggcaaaatgtactctataatagaatgtggatttcttcaatggtactttatccacaaaaaacgacttaggtatttaccatttatttaatacatgctttctgcaagaaacctcaagcattgaggacatatttctgctcccagatgtttttctccatggaaaaactcatgcttttctgagcactatactgggtattcctgaattacttttcaaagcggggcagtgttataaaactttaaatgtcaccttgattcatgaggaaaaaaatgatttatagatgatggtgtgtcatgagtactacatggtgctttaaatgagtacacaaataataaataagattcatgtttggcattacatagctattaacaaataggttaaatgtcaaaagaattaacttctcttattgcctaagagagagaagatataaaaatgtctggttggattttatttatttttggatttttaataggcttaaagctcaaaactagattaaatcaataaaaattggtcattgcttccccttaagtacctgttgtcatattttataaattagcgggatcccccagaagaggaaataccattttgtactctaaaatcctttccagctgctattgaacataccatacagtggg

SEQ ID NO: 111656 - DNA, 1313 bp, Homo sapiens
aaataatttctgaaaatatttccatccagaaataataattttaaaatatgttagtaccaaagtattcaactcgcatacctctaagaacttatcttctgcagagttgatttccaatgttttactgaatgtgttctcatttttttctaggcacttaccaagtcaaacatcattactagggaaaaattgtaattggatttttaactttttttaagaactgtaaagtacttaactataagatagaaggtgtttagatttttattaataatttgtaaattatttggactaatgtgcattattaatgtagtgtgattacagtgaatgtaatttctacaagccaaaaatgaaaactggtctcattactctcattatatatgtatggactatgactgaacttacacattcttatcactctggaatatatagaaaaatcatagtcctttttttgttgtttaacatattccttctgcttatattatttgtttagaaacctaaaagctacactgctgctgatgctactctgaaaataaattctcaaataaagatagatgcacacctgaacaaagtatgtccaaccactgagaccatttacaatgatgagttctatactaaacaagatgtaattattacagcattagataatgtggaagccaggagatacgtagacaggtatgttcttgaaattcatgttcctacagaattgtctttagttttcacttctgtttcccacattacttattgaaaagttacggaattatctgattattccttatgttcctattgtagtactcctcaaacacaaaccctttgatgatttctcattatacttagaatgaaattcaaaatctgtaacataacctaaatgtttttcatggagtacttttcacctgttcaccatgccagagtaacatttaccagtcttccttggctccccttattctagctgtatgtgcctttcagttttttggctgtcttttgttttttctgaattgtaaagctatttttaatactttggggtgagtcccactgcaatagaaaacatagaaggagtaactccttcacccccagaaatgccccaggagagaaaggctacctgagaaggaagcacaaaaaggacccactgcaaactcagggcaaagggaatgccatcagtcctgggtcctgtgagtactagaggaggaaacgtgagcatggtgggactggcttcaggcacagaggcgaagggcacgggggtggacaccaaaccacaaagctacttaggttcttccttctcgttttcccttttctgcttcagctgcatggtcttcaggtccctc

SEQ ID NO: 111657 - DNA, 1981 bp, Homo sapiens
aaaaaaatgataaagtaataggaaaaagtttcacttttataatgatttgccaactttgataattataagacgatttcaataacttgtacaaagatgatcttattaaaagattttctgaatcgtaccattttatacaatacatatttcttaccaaaaaagccttgagtatgtattctatttttttttaaaatggatgtaattttgtagcagtaaatgtgataaggaaggaactaacagtttccaaatttgtaaattttaataaggaaaggggattagatcatttaccttcatggccttgaggttaagtcatttaacttctaaccttcaggtttcttatttgttaaatagagttaataacagtattaagctaatgtgtttattatgatggttaaataatgttttaaaagtatttagcccagtgcctgggacatacaaccactcagtaaatgttggccgatttttaatgttctcaataggcacctttagagattcacacagctatgcttgccttggaccagtttcaggagaaatacagtcgcaagccaaatgttgggtaatgttttaagtttaaaaataagtattttcctttttataaaagtagtagttcagaaattataatttaaaaagtaactatgccctttgtaattacaataccaatagatataccaagctgtgcaaacatttattatgactttctggtccttttcctggtgggagtggagaaatttggtttataaaagtggaatcatactaaatgtgaatttttccactttgaagcctttaaaaattaaagcttcttaaaacaaaaaaaattctgagaattactgaattattaacacatagtaattttttttttaactttatatcctgttaagtcagagtactgttggagaaggtttttgctttttatatttgggattaaatcttgggattgggtgttgtggctcacgcctatgatcccaggactttgggaggctgaagcaggtggatcacttgaggccaggagttcaagaccagcctggccaacatggcgaaaccctgtctctgctaaaaatacagaaattaccaggcgtggtggtgcatgccggtaatcccagctccttgggaggctgaggcacaagaatcgcttgaaccaggaggcagagggtgcagtgagccaagattgcatcactgcactccagcctgggtgacagtgagactgtctcaaaaaaaaaaaaacaaaaaaaactaaacttatttatatactgatataagtgtgattttgaagtaatgtatttataagccaatcatctttaaatcagtacaacattttgtgctacctgttggcaaaaatcccacattcttttatatatttcctaaattttaattttgagtatgtcctactgtttatggcagttgagaaaattaaagttagggtgttctgttttgagttgtagatgccaacaagattcagaagaactgttgaaactagcaacatctataagtgaaaccttggaagagaaggtgactattgaaatttatggctgtccgaatatttgtttgttaatacataagtgttctgtatattagtattctcttatccttcacatccagctttgctactctgtggcattagacaacttttttcagtttgttctgttttaatttataaatctataaaatagagttaacctaccttcatagggttattgtgaacattaaataatttaattttgtaaagtacttagaaatgccatgtgacatatagtaattaatatttgctgctatttttttaactgttactattattctttattattctgttatgatttacttgatttgttaacttaaacttatatatgttagctttcttatataagtcacctgttttatatattatacattcatatctctttatcacatttcgtacatcagatttagatttaaacatttcacctagaaaatggtttttttgtgtgtgttatgatgccagtgcctgctt

SEQ ID NO: 111658 - DNA, 1050 bp, Homo sapiens
tttcattactgattgaggtgccaccttgattttgtcctttgtgtacttgagactgtttctgaattctctaatcttttccagttgtctgtttattaaccagtaccatattatattattatgataggtagttattattatattattgaggctttatgatatattttaatatctaataatgagtagccctcattactctttttctgtaagtttccttggttatttttaagtcctggagtttcacattggaaaaaatactctgcctagttccccacactcctcccagctcttcattaaaaaaaaaaaaaaacaaacaaacaaaaaaaaacactatgctggaattctttaattttgtaaattagggataattaacctcttatgacaataagagttgaaatttaaatatctatatccctgtgtaatgattttttaaattttttgtcttctagtgatatcgccattttcttttagtattggtgacaccacagaactggaaccatatttacatggaggcatagctgtccaagttaagactcctaaaacagttttttttgtaagtatttttttttcggcttaaaaaacatttttttacagaaaaagaaaggcagaagagacaaataactactcagttaaccaaacagattaaatgtggaacagaatttgtttttatttttatttttttgtttgtacccactttgagggaaatggaattaatctaatgaaataaatgaataaaatggatattaacaaaaaacttacacatcttttatagccagaataccatatacatatagttgagctaaatgggtatacccgaaaggaactgtatctttgtgaattatcaaagagtttatcatacttattacaatttactttctaagacaagaaataaaactaatgtattttcaagatttagcaagagttgttttgctttattattatttaattttctaaaatgaagatattcaaattatacttgttaatcctggtttttaaattttaatttaattttataaatttcaaaaaacagtatatatgttggaaatgtaaaat

SEQ ID NO: 111659 - DNA, 1036 bp, Homo sapiens
ccattttggaaaacagtttggcactgtctaatgaagttgaagtatacatattcttaaatcctgcatttcctctctggggatatacattagagcaggggtgtccaatctttttgcttccctgggccacattggaagaagaataattgtcttggaccacacatagaatccactaacagtaatgatagctgatgaactaaaaaaaaaaaaaaattgcaaaaaaatctcataatgttttaagaaagtttacgaatttgtattgggccgcattcaaagctgtcctgggccgcatgcagcctgtggaccgtgggttggacaagcttgtatcagagaaacaactcttaagtgtgtaccaggagatgtttataagaatggtcagaatacaatataaatgaatattaatgaccagttgcagacatcagtataagtccatctcataaataatttcattcaaaagaaacaagataaaagacactcaaagtgattccatctatacaaagtctaaaatcaggtaaaacctaagtatattatttctgggtacgcataagggtggtaagactatataagaactttcgtacatactatagtagattttcaataaatatttgatgtgtaaatggatagtttttactttctaaaacaaaagtcttgagtaccaatttaaaaagaaaagtttaggttttattatattttgtatgaaacagggaaggaaataaagatagcttgtgtttataaagttttgtctctctagataagaaatcccttttcaggcttttatgttgaatatgaaaagctgaaataatggaaattaaatatttatttttaaaacaaatgtgcattaaacatgtatgtgttaattctgaaagtaaatacttataacccaaggggttctgaaattatttatttatatcgaactaatctttaaaatgtttctcataagaattcattggaatttatattatctccaaagatagcatcaagtttctcattgttctttcagataaacacttacaattgactttattactatatcagactt

SEQ ID NO: 111660 - DNA, 1575 bp, Homo sapiens
tggaacataatactcagtttgtaaaattgaagttggtagaattggaggaaaaatgtagagctagcctgtgccagaaaaacattgatgacatttagcataattggcagtatatatggataatagttgaaggtcatcactagttaatatctttggcctaaatcttactgaagggatcagatggaaaagtcattaaagttaagtggaaaactgcataaagagatttgaataatctgttgtagatgtctaatgaggcatcatcctttttctaaaccatgtcagcatattaccttctgtgaattaatttattattgcatttctttggattgttctctccgccgattataatacagagacttttctttttttatattttaaaattgtttatataaatttttttttcaaatcagggatccacttaacactatttgcctttttgacatacctaacacatttctttccttttctagcatgattatgatatgagggtggatgatttccttcgtcgcacacaagctgttgtcagtggccggagaagtagaccccgtgaaagagaccgggaacgagagcgagaccgccctagagataacagacgagacagagagcgagatagaggacgtgatagagaaagagaaagagagcgattatgtgatcgagacagagaccgaggggagagaggtcgatatagaagataatgggcttttggaagcactgattgtttaaagatacaaaaaatcttgtattttttttttgtgtgtgtttacaagtagtaaatttattttcagctgtctgcctatgaagttcattgtgtagaaggatttattatgaccccctttgttccaagcatgcagtatcataagaactggaaaaactcaaatccgccaaaaatccacagctgacagttgaattgacacttttattggggcagaatggaacagtccaagaatgtagatactgattctttctccataaatgttcttatagtgtgttcatcctagagttatttttttgtttgtttttttcctttttggatcttgattgataactgccatgatattttgctttgatgtgtttctacatgtagttgcacacggttcagtaaaaataatgctgctatcgagtatgcaaatattgaagtatgatggtttgactgtatggcagtgttgtagcagcctcttgtttttttccccattgcctctttttttaaaaaacttataaagtcactttttatttttcctcagtcttcaatgacgagagcaatattaagaagacattgctatctaatttttaatctttttaaatgaaaaattcctatgttcagtagcgtggttgatgctattgtttagccttcccctccaaattgtatacattggcttggaatgttcacaacttgcgtgcgtggcagcggaagacgattcccatattctacattgctactgttttgtataaaataaattggtaaagattgacggttatcttttgtatctttttcttatccaattgcaggtttgttttattatgcaataatggacataaaagcatgctttttgttcaggaattttaggaaccccatttgct

SEQ ID NO: 111661 - DNA, 1144 bp, Homo sapiens
aagtgcttagaacaatgcctggctcacagtaagcaccatgtaagtgtttgctatttccattgttatttatatgataggagtagaaaagcataaacatgttaaatcttagaagatgtgtaattttcgacaaaaagcatattttgaaacaccttaatgccatcaaagtaaatgtctagtacagattcacttgtttgggattggtgttttggatgaagggttctaagaatcgcttgtttacaagggtgttggtagattcttaatgtaaatggttttccttttttagcccccttacccaggaatggaacaacctccacaccatccttactatcagcaccatgctccacctcctcaagctcatcccccttactcaggacatcatccagtaccacatgaagcaagatacagagataaacgagtagtaagtgcacaaggaggcaaaggtgtgagggaactacttagaattctgtaggtaacttaaatatggggagaccagagtatgatgattgacggaccattgcatattcttactgcagactgttttggaataattgtttgtttttattaaaaatgcctgattatgcccctttggattatatagatagaatatatttcttttactgatcaaatcacaaactgcttaaggcaaacgcctacaaatagaactccttttaggtagtacctaggctatgttctttccatattgagatcttaattatgctatgtaattaatattgttaatagatatttctgaactttttgtgtattcttactcaatttttctaggatagatcgtgtatattaagttagctgataagctgtaatctcatttagtcatttgtttttatttctaccaaatgttaaagctagtaactgataaattgttttacctctggttattgtgatgttagcaaagaataaccagatgttatgatatgtagcagacatgtcctttattcattgattctgttaattatttgataagattgatgtgaaagctttttttgatggcttcaaaacaggaccagtgaaaaaaagactctagttttagtttgagttttctgggtttttaactagtggggctgagtttattaaatgcttccccaccccccccaatagtacttttatttataaagcagaattgtct

SEQ ID NO: 111662 - DNA, 1045 bp, Homo sapiens
taagagagcaaactatattcaagaagggatatcatgtatttgaagagagtcagtgatacacttgtgaaacttaggcagttaggagattgatgttagtgatcattatagcactattatgtaacaagtggcttgattagcctcattcttccaaaataggttgtcctgttgtagaaagtgaaaatagtttttccccagtaacatgactactcaaatgtttttacattttaatttgttgggttcttattaaaagaagcaggggaaagaatatttttctaaccaccatcgatttttcattttcagtgtatacatcttcatttttgcaacttttgcaattttttccccctcccccttaagtttacattttaaaaagcttatctgtggttttcttggtaagacctacatatacccaaggtggaaagtaaacatttgttttaaggaagtcctgtcatagtgtgctcaagatagttcctctgcccttaccttccctgtgaagcagaaggaagaaattttctgattagcaagatttggagtgtgaacatagaagatacctatctgaaagcttctctagcagtttacaattctatgatatcattagttatttcctagattatcatgtaatctgagaagaaaatttgaaaatgggataatacagtagtagcatcacttaaagtacatatttcatggaaagaattgaaacgagtggtaaggaaggtttaattataatgccataaaagaaaaatataaatttgatttactaaaatgcttgatgtttgaacagggtatttaaaggatccacgataccaggaagtggacaggtaagtcgggttcactcttgcctagttttgaattacattcttggaactagtttatgaattacctgaatttagtttcacaaatcttattcccaacagacgattttcaggagttcgccgagatgtgtttttaaatggggtaagcatttcattttatctatttaatgtggataaaatcaggctctgatttattttgcagttctgtgataatttttaattatattgacattatc

SEQ ID NO: 111663 - DNA, 4823 bp, Homo sapiens
ctccaaatgagaataagggacacttctattttcatttggttttaacagctgggttaaggtccagcttctttttggtcagtttttaagttttttgagttcatagaagaaagggatatactaaatattttctgtgtcatttcatttgcaaactgcgtaaaacaactataaagtagatggtgatattcttgtttatcaaagaaatagattcaggctcagagaagagagcaggctggggtttaagccccaagttatcttggttctcaagcccttgctcttaagctcttttttagaaaactggagaatatggaaaaagtctctgaagaggctttctatagggaattaaccactgtaagtggtttttaaaatttagtcacatttaagtcacagttaatacaggaattcactactaaaagtagtataaggtccttaaaggattctgcagaagaatgtaattgatattactttgtatttaggcgtgaattacccttcactaagtcggctcatctcaccaatccttggaatgaacataaaccagtaaagatcggacgtgatggacaggtttgtggccttaattgattctttaaaaaaacacatttaatcaacccttttagagatctttattgatgtattcgttttaaccgtttctgatgaaagagaccacgtgagaatttgaaaaaataatcttatctgaagtttataataactgtgattgagactaataagacatccattaatgttgaaatataggcagctttatatggtactttcatttgatacaattgaaggaaatatttctaaagagaatttgccagatttaaatttgttttgactatattatcactgtttaacagattcttcagtttctgtaatacattttagaattgccgtttagtatatgtgctagttttctgagtagaaagcagctttctgaaaagattaaatatatgtactcaggttttcaagtctacaaatggaactgaaaatgtggagtaattgaaaattaaccaaaacctttctttgacccttgtaattctcacatgtaattctgaaccagaagttttgttttattttattttttaattttaatttttttggaaaccaggttacgagagtggctaatttttgtattttcggtcgagacagggtttcaccattttgcgaggctggtctcaaactcctggcctcaagcgatccgcctgcctggggctcccaaagtgctggaattacaggcatgagccactatgcctggccatgcaaaagtaatatgacattttattgctcatgagtaaaaatgttttcactttttcaattacaaatagctgaaaatgatttaattttaaagagcccatagattggtctgcctttgtggtaaatctaatgtatttcaatacacttagtagatcataattatcaaagttgttggtacacacactaacatgaattttttttttccattgtattaaatgaccttgtcctgatatttttctattttgcacaaagaaatagtcccttttcagagggtggttgtcacagaattttaagcaactgcatttgtgtatttaacttcagagattctacacttttagtttttaccctttatataaatacacaaaacactttttaaatgttttataaatctggaagtcttattggaatcccatatgatcatcagccttgggaagaaagcttccaagtcagtttttgttctggtacatcaggaaaatgcaagtctgttgaaagggtctgtttttgttttataaattgctactttcctattctaggaaattgaacttgaatgtggaacccagctttgtcttctgtttccccccgatgaaagtattgacttgtatcaggtcattcataaaatgcgtcacaagagaagaatgcattctcagccccgatcacgaggacgtccatcccgtcgagaaccagtccgggatgtgggaaggttagaaacgttctttggactgataataggcacatgtatcagaataacatgatggaggaatatgattcgtcaaaagtttgtcctgcggtaaagaagaaagagaaaatcctcaaatcaagctgcatggactagtttgtggcttcattgaggatttcacatggtcaccttggtctcagtcatttttcaagaggaaaatggggatctttccttatgcagaaaaaagtataaccagtgataaccagtttagattagataatactctgataatacaatgtatacaattgaaatgaggtaggcatttgttgctaagaacaggctagaaaggaggaagaggaggaagtctttatttgcaaaaattgttaatactttttaaaaagccttttctttcaggtatgtctctggataagccttatcagatatgggacttttataaaggatcactaatattttttcagaagatgacgcctcatttagaggataaaatattttaagttattttgatattcaagaggagcattattgggactgtttcagattttatcaccgtgatgtgttaaccctattgccaaatattctctaacatgtacccagtgaattcacacatcttgctgagcttctgaaaacaataggttctttccaaaggggatcaagtggccctgggagacccggcaacaaaccaaaaagaagggctgttgctgtgtctgtttacaacttttccagatgctggcagtacctgtggacttaaaagtgttttttagaggatcgccatggttattgatcactactttatgaactaaacagcattttccagaaaaagggggtttaacttgttacagaattggagaagtctttgcaaaggactgatttaagcccttctacccaacaccttcccctgtgtagatttgcatacagctaaatctaaaatattctgctaaagactattggatgtatggttgatgggatgaaacctttgattaaatttccttttggtggagacatcctgtggtaggtacagataatccaacaagagtccccatttctttgagcttaaaaaggacactgtcgagtaggtaggaggaaacctggcagagccccttatttttggcctaaaaggactgagcaccaagatgtcttttgaagttttaagctaagaggtttccagtgcaatacaatatatacaagtgaagtttttacctcagttttgcaatggactgcaaactatacttattacaccactacaccttctctcaagcctgccagggcctccatttatgtatgtggcttacagcttaaagtcagtagttggactactatatgaactgttactatcatgttttataccggtcgtaaatgcactccccaaactacaggaaagcggtatgtttattttttaaaccagcttttaattttcttagtattatttattgtagatgcaactgtttttattctgttggggggcttgggattattgcacttaactttgcagtttgagtgaactgtgttgaaaaagttaatgaaagcagttggtactcagacaaatagctgaaaactagtgaatgctaggttgttatcaagtttttatttgacattaaggttaaaaagatatatttattttctaaatattttggactttttttttgtttaactctttattagctgctaagtaaattgaagtgtatttaatgatgtgttaagttaacccgatttatggaagacagtaaagaacagccctctgtagtcagtaaagtttcaccttctaaagaatatattttgaattagttttatgaactctgttaaaattctgacccattacttgccaatttataaaagcctattttattacaaggcattgtctctggaaaaaaaaaattcccttaattcttaaatgtcattagatgtagaaagaaaaactaaatgttactaaggattattaagaaatagttttttaactattaagattttaaaaactttcctgtaaagttgcttttaataagtatcaaattttctgtatgatcatgtaaaattcataatttgtgcaaagcagaggaaaaataaattcttaattttgtttagacttaacctaaaatgacatttataagttttaaatatgcagattttagagttacatattgtacaatgatgataggtttttctagtttttatttttcatctgaatggagactttatttgggaaagtgttttaattgttaaaactgatatttagtttgagaatgactttgtttacttttgtttagactactaaaatgtgacttacatgttttgattggactagtctgcaattttctcatcatagcatgagttggcagagaatatctacttccagcagtacatttaaagtttggtttataggaattaatttgagaatcaaaatgtaggaattttaaaataatttgctcactaaaaaaattaagatgttaaataatgggttattctttgtacttatctctgtcagaaactcttgctttactctttgttctcccagcagtttttggtttaatttctaatgtgtctaatttgtgtaggcgtcgaccagaagattatgatattcataacagcagaaagaaaccaaggattgactatccccctgagtttcaccagagaccaggttaatattttataatcctgcagatatttgatttcaaattattggaaaaaaattaaaaaattaaaaacaaccctcacaatcctgcagttttaaaagtgaaaaaaattcaggacctgactacttaaatcttgagaaattttagtagttctcattagtgtaattcttcccttaacttcgttaaggttgtctagtctattccagtgtaactcatcataccctatgaattacctgaaattgctaattttgcaa

SEQ ID NO: 111664 - DNA, 1060 bp, Homo sapiens
taattgtctccattttttcccttaggtttttataaattattactacgttattctgacagctgataaataaaacctttcttcattatagcttacttaaattgaaagcacaccaaaatatgtagttttttttcaaacataactggaaacacaaaagagttgtagttaatttcactttgtggtctttatgttatttatgtagggtgtatggtccacgctccctgtaaatgagaagaaattaaatcttgcatttagatctgcaaggagtgttatcttaatattttctgtcagagagagtggaaaatttcaaggtaagaataaaaataatttggacatataaaaacattaattatattagcatctacatattatattatgatatgattctcttagggtttgcaagactttcttcagaatcacatcacggaggatctcctatacactgggtgcttccagcaggaatgagtgctaaaatgctgggaggtgtctttaaaattgactggatttgcaggtaaattatacacttcagtatagataactgaaattttgaatacactaccagtttagaataatgtgttaaagtgaaaaagtcactgtatacttatcttaccttgttcagtaactacctttatctaatgtgggacacaacaaaggcgtatttagtctaaagttacatgtatttgatttgttttgtatattagtaataaagcagtaaatgaattggacagttgcttgaaatgttgtctggcgtatctgtataattttagtgatttaacatgtcacttaagttattgaggaatgggaaataagtactatgacttggctaacaatttcggaggtaactagtttagtcgtggacagtattttttaaggaggttagcaaatgatgtttagttgccattgtgatcttctgaaactgagttaagatttaactgtatttattagaaaaataatcaggcttattttgaacactgagttgtcactatttttaggtccttactgcacactgaagtattgtacacaagaagctcattatttaagtgatctttacgtggcatacaca

SEQ ID NO: 111665 - DNA, 1509 bp, Homo sapiens
atcactaattatggtatatatatttttccagttgtaaagctttgggttcaggggttcatcagatctcttaagatagaatcagaattgtaattgtgctgaagaatggtagtggagtttaaaaaaataaggacttaagacagtgttacctggtgtgtagaaaggacacagttttgaaagaaattgtttttgctttgcaaatttccccccccgcttggaaaactgtattcaaggccacctatatatggcaattaaggccctgactttgtagttatttcgtgtgtttttatttgattgaaactgatgaaagaaacaagatgcccgtactttttaaacagtatttttaaaataaaacattctgaggaaattgagggatcaggagagaggagcacagactaatagaagggctatgcaaaaactagacatgtaatgatacattcttgtttgattacttctcttcgtttctgtattgtgatttaaaaaaaaaactcttgttctttttagatgagaaaaagaaggaaaggaagagagctagaggcatatctccaattgtttttgatagaagtggaagctctgcatcagagtcatatgcaggtattctcattttgtgatcatatctgacttgattctaatgtaatctgctttagaaagcgtgtggaggctgtagtttagtgtgaacttgttgatgtccattagcactgatttttggcatgttcagtgtaataattctagagaaaactaagctttttcttattattttaatcctgttctgttactgcttaagtggaattttcactttttttttcttggaagatgatgattcagtgactagttttctgagtgggaaactgttcaaatatacatacttttaaaaaaatccaaacaacccaaaaagcaaaacactcgtacacattgagaagttttttttgtgtgtgtgggtgcgccaggaagaataatttgtcttgaatgagaattttatgtgacaagactgtagaaattttgtcttatctctattaaagctcaatctgaacaaatgtactttggctaaatacaggttcagaaaagaagcatgagaaattatcatcttccgttcgtgctgtccgaaaaggtatcatttaaatttgaaattgttttcattgcatgctgcatagtcattatttttccttattggttctccattaatagctgcttttaatgtagtaatgttccgatatattacatgaagcaaaaaataatatcttaacatagaaagctctgtgtctgcttcttactgcatattttttagaataataccaaacatttcaggatattttagtttttggacaaaatgggatgggtgtgtgtgtgtatgtgtgtatgtgttatatatagatgtgtgtgtatatatatgtatgtatataatggtctgttattcttgaatctgagtaagaaaatctataaaacttggtaaccattttcatacttaaatatggatttgatatatcggaacatcactaggttaggtttactttc

SEQ ID NO: 111666 - DNA, 1028 bp, Homo sapiens
tttacaaactgataggatatattttttataatttaagataataaatatttcattagcagtatgtgttgaatgttcatttattgtggagaatgtatgaaaccactcccttgggtagggaacgttttgttgtaggaatcttctttttggtatctctgttatttcttagactttaatgtttgtattgtttacattaaacaaagggaacttacttaaatgggtaggaccagaaattgcatttgtaacaggctcctagatgataccatagtaaggtaacttgattgacacactttgtttttgtggagaagacatttcaaattaaatggtaactgtagttttataataaatcttgatatcaaaactctgttactagactaggtttattctaaaagagatacctgaaagttttattttccttataaaggaaaatcccttatgtggaacatgctttaggtactatattaatatgcaggaaatttttttttatacaatagtttatgaaagagtaatggggtgattttggaacttcttgattaagagacgtcagtttttaaataaaagtgatcacagttgagtttctctgtcatgaattttctagattccagttcattttaccttattctcagaatttttggtaactttataaaagcaacagactgattgataacagtttatttattagatgattttcattgttcttttgacctgagagtaatagttgggggagagggccataaacttaagagcattgggagttattcatacaaaaatgatgaaaattccttggagatttctcatgctaatgctaggtttagcattatataaaaacaattgagtaggatcttctgcttctgttattttccctgcattatctcagatctttttagtaactttttaattattgtttttgtctttatataaagagggtcttgctatgttgcccaggctggtctcgaactcctgaggtcaagtgatccgcctgcctcgacctcccaaagtgctgggattacaggcacgagcaactgcaccag

SEQ ID NO: 111667 - DNA, 2678 bp, Homo sapiens
gatagcccagacttctgtttgtgtgtgtgtgtgtattttgagaaactcactcttatcgcccaggctggaatgcagtggcacaatcttggcttactgcaacctctgcttcccaggttcaagtgattcttgtccctgagccttctgagtagctggggttaaaggcatgtgccaccatgccctgctaatttttgtatttttagcagagcagggttttgccatgttggccaggctggtctcaaactcctggcgtcacgtgattggcctgcctcagcctcccaaagtgctgggattgcaggcatgagccaccacgactggccaattctttaccctgtattagttttatagaaattaatcttgtgtcttgattctgaaataaaagtaaagctttttatataaaagtaaaagctcctaggcgcttgtggcctcacacttagtaagtactcaaaaatacatgttcaatgatagtgatttttccctattaatttttaattttatttgcagatggagaacttaatgttctggatgatattttaactgaagtaccagaacaagatgatgaactgtataatccagagagtgaacaagataaaaatgagaaaaagggtatgtaagagttctattatttttgttgaaataacagtataaatagaggagattcaatttcttaaaaaaaatgactgtgcttttttgtgcttgttccttgaggcagttaacactaaatgtacataataaactggtatccatatgaatagggataatctgtttttttctaatatatgaaacttctcaaatatatggttttattcccatagttgaaagctatgttttcttttagattaactctggagaagaaatctctcagaagacttttaaagaaatgaggcctatccccccttcctgatgtatatattattgtcagtctttggtgaaataaatggaatactacaaatacttcttttttttttttttacattgtattttaaaggatcaaaaagaaaaagtgatcgaatggaatctactgataccaaacgacaaaagccttctgtccattctagacaactggtttctaagccactgagctcatctgttagcaataacaaaagaatagttagtacaaaaggaaagtcagccacagagtataaaaatgaggaatatcaaagatctgaaagaaacaagcgtctagatgctgatcggaaaattcgtctatcaagtagtgcctccagagaaccttataagaatcaacctgaaaaaacctgtgtccggaaaagggatcctgaaaggagggccaaatctcctacgccagatggttctgaggtagtaaatattattgcagatataaaacagaaagccattctttttgaggctttagaactgtttattcaccctgaccttgtcttttatatgactgctgattccctttttctttaaacatcagagaattgggcttgaagtggatagacgtgcaagcagatccagccagtcttctaaggaagaagtgaactctgaagaatatggctctgaccatgagactggcagcagtggttcttctgatgagcaagggaacaacactgagaatgaggaggaaggagtggaagaagatgtggaggaagatgaagaagtagaagaagatgcagaagaagatgaagaggtggatgaagatggagaggaggaggaggaagaggaggaggaggaagaggaggaggaggaggaggaagaagaagaatatgaacaggatgagagagaccagaaagaggagggaaatgattatgacactcgaagtgaggccagtgactctggttctgaatctgtttccttcacagatgggtctgtcagatctggttcaggcacagatggatcaggtactactttttatatgtaaaagtttgtcttaaaaaaagcttgataggtttcagtcttgaaaatgtttaaattataaaattgttgaggagatgggggatattaataggattgtcttgtgatcctttatatgcttttgaatgttataaatacatttgaataatcttggataagatttacatattttaggaaaggcatttcctagctacagaatggttgtgttgtaaatgaacacaagtccatttgattctgtataaggaaatgtatttcagatttctgtaaattcttagattttcataccagtcagcagtttatttaaacactgatgtacttgaagtatattcataggaaacctgtccactgggtattacagtatttccttggtaaaatacccctagatttccatcatatggcttcagaatcaaaacagattatttcttttttatctctgggagcacagacttttcttctaattttgtgtctgtcagttgactggctgagacagggtcgacaagagggctggggtgtaaggtataagatggagatgaagactataaataaaattcttgtggaaaaatcaggtaagaaccatcttcagtcatttcttcaatgctatatatatcctgcctctctatacctatgagacaaaaatgtatgactgttacgtagttggaggcactaggcttaggggaacttttcttgggggagggtacagcaaggagaggtcagggtacttacagagcactatatgatgattataatctcatgactgtcttatgtaaagatgctaccagattgctacataagcaaaatgtactaaa

SEQ ID NO: 111668 - DNA, 3240 bp, Homo sapiens
gtggttgccatagtaatgagtaatcacacacacagaaatgttggagaagctccagctttgaatcttcccagcctagacatcaacgagacttgtcaatgaacaagccttcagatgatttcagccccagccccagccccatttgactgcagccacatgggagaccccggttgagccctggaaccatgagccataatgaaaggtgttaccattttaagtcaagttttagggtgatcatcttatacagcagtagataatcagaacatgtatgcatataccatacctgttttgttgaagaaggaattttgttttgtgttctggaccagattttatatatatcacatagcccagtcattagcaagagggttggggcaggcaggttttattaaagtccaatagttataaggaaggagagtcttcttacaggttgaaaaactcatagaagattcaaatgtcctgcttttcctttccccaaaactgaccttttttaagtgcctcttatcagaggtgaagaatcttgaactcagaaagactgggaatttcctgatacctaaatgcaagctataacctgcatttccttaacctccaagacttttccccttgtatattatattccagtgtatatataaggagtttcagtgatggagaaaagtacttaaaatttggtcatttgtattatatcaggggttggcaaaactctttgtaaagggccaaatagactttgtgggctgtaagtgttctctgacatattctttgcttttttttttttcttgttaataagcgccttaaaaacgtaaaaaccattcttgcaggccattctaaataggcaatgggccatgtttatcctgtaggttttagtttgccagtttgtggtaaaaccacacagtttattgatgttatggactataatacggataaaagtgtgtacatcatttaagtgagggtgttatagttgattttgaatatttcagtagattttaaatgttgtaatgttaaagatatagagctttctggtgcactaatttgaaatttatgttctagtatatatgcccttttaatattttgcatttgtgttctttatactttggttaaagttgcttttattgttccccatctgatttaactgtcaatttctaaagccggaacttcatactaatatccatttgttactagacaagtgtatttggtcaactggaacatttgagcttctctttctttatctgcaaagtaatgaatgattaaacatgctctattttatatgatttgtatatatgatatattttaaaagtgataaaattttaaaagtgacaaagtatttttaaaaagtagtaagcattggttaatatttgttgtcttgaaaaaggttgtaggtgctttctaaaactacaaccagtatctgaatttgaattcgttaaaactttaaaacagtaatacccctttttataggaaaaccaggctttaagtgtgtttgaaacttaaatttatttaaattaacattctgcaaaattatttcattctgtattaaatttagcatgtctaaagtatataatataaatgttcagggttcggggatgatatttctgaataagatctagtgattttatgaaaagatttgtatagcattatttgcctgtttcattgtgatagtcttgaaattttttctttttgtcttctacaaatgtatttgattctgtgaagacctgttggatctacttttttactgattagtgagctttgacccagtacttattaaacatctgtaaaacattgatttacttctatcagactattttttttataatttagagtccgaaaatggtgtttgccaccattcagatcttgaagaaatttttcttagcaaaaacatgaatctagatgatgagagaagcttttttgtttgacatatcttgattttaaataagattttttaaaagtaaacaaaaataaaaacccatatagcctgttttcattttagaaaaatgatagaaagtacatatcagcattggtaccacccaaaatgatcaattttgctattccagacatagtaattttcagatatctttagattgtgtctgtttccaaatgtaaaggaaaatgatatcttttccatttcctatgtaaccttatcgtttgtattaactattctcttcagtcacagatttctttcccactttggggaaaatttgaatcccatttaacctgtttatagcccccaggttaattaatagacctttctgtaattcatgtgggctttgtttttttcctgaagccacaaatgtaattgttctgtctcatcagttttcatggctttatacttcctctttggcacaccttaaatttggaaagatgtttttgatattggaatagttaatgtttaaacatttactattagcattagtacattttaaaatttaaaatggtatttgtgtgtatttctaaggtttatcttgttggacaaggtagaagtggggacaaaactgagttttatgctttcatgatcattgaataaagtcatagttcccttctctgaacaagttttgtgcttttacagtccacaccagcaggctctaaatgttttttttattatatagcacattgataattttttcatttaacttgcagtttgacataatttcagataagcataatagctacaagtgcagtgtgaagaattttcttttactctccaaacacattctgcagatgttagcattttgtcacatttgtctcattctgtgtgtctgtgtgtgtacgtgcatgtgtgcacacttttttcctgaaccatttgtaagttgtagacataatatatctttgtccctaaatacttaaatatgtgttataaggactttgacttaaccatagtacagtcaaaattagaaaaataacattgctacttactctgatttacaaactttattcagatttcaccagtttttccaattatgtccaatattgtgggctgtgttcagttatcatgcctctctaggtctgctttgatatgaaatagttcttactctttgtttcatgacagtgacatatttggatgccctttaatttgggtttgtctgatttttttcctcatgtaggttcagcttttccattttgcatagaacattacaaaagcattgttctattctcagagcattgttacaggaggtccatgatgttgatttgtctcattactggtgatgttaactttgattatctggttaatttggcctgtgaaacatttctccactgtaa

SEQ ID NO: 111669 - DNA, 1096 bp, Homo sapiens
gattccataaatggtttaagatcttgatagcaaatgagtctataagttgcagaaattggcaattatattaatcacagaacagtaaagacccttgttcatagagttcttgatggggttttgcacttatctgggtaataaagacatgaatttctataatctataacaatgcttcaataatactcatacctagaagctgcagcccatataagtggacagattgctagctccctgtgattcctgtggtgataatttgcccaagaaactggatttgaaaggtgttgcaatgttggtgttaactaatattaaatgccatttttctatataaggaggaaatatgcatcttttctattattgcaaacaccttgtataaattgtattaatcttttacaaagttctctacaaagaacagttacaaaagtttaatctatccaaaatgtgtatgagtaatgtgtaatgagttactgtgttaaaaataacgtgttttctagattaccagactagaagctccctgagtgcccggagtacatctgtcttgttcactgggttctttgtatacagtaattgtgtttcagtaccttgagtatttaccaggttggacttcattgactgactggttaaatgacatgtgcagtatgataacgaaagctaagagtttctcagtttaagttatacaacagttctcccctgacccccaacctctaccagccttattttcctggtaaatacgttctaagatccacagtggatacctgaaacaatggatattactatatcctatctatactatgtttttttctatatgtatatacctatgatgaagtttaatttataagtcagggactgtaagagatcaaccacaacaataataaagtagaacagtcattacagtatgccatcatcactactcttgtgctttggggctattattaagtaaaataagagttactttgaacactgacactgccatatgtggacagttgatctactacccgagacagttactaaatgactaatggcaggtaacatatgcaatgcaaatatttgttgaccaaagggatgattcattttccaggcaggacagagtgggacagtgcgt

SEQ ID NO: 111670 - DNA, 1244 bp, Homo sapiens
acttcatctcagtagggtttttctttgatgcggatttcacgcttgactttccgtttagctgtcttgggctgagaggggccctttctgagttgcaagctcctaggtttatttcctggtaggatcatgcggatgtaacgcgtattttcaggacaaccatttctgttaggctaaaatttgaaaacccctaatgccgcgatcaacactggtggtgtggtaagtgagcaagtttaggaagtggcactggcaggttattaatcttgagaaatatctgcaaataacttctggctgttcctgttaaataggcaaagtgaattacccgttttgttcctcgaatacttattttggaaaaacatagtacttggaaaaaggaatacttagtttggaaagatgactgtgtgacttaggctggcaaagaaatcctgggtgctattatgttagaaaaaccgtgtgtagctcccagagggtacagtcagaaacaaatgaatgcaagttacagagagttggagggataaatttcagtgaaatgtagagagaactgacgttgctgtaatggaaagatagtaatactaagttcccaagccctagagatattaatgtaggtcctagatcagtgtctctctggagagtggtctagattaaatgctgctttaagatctttttcaaccctaagattaacataatagtcttggaaagattatagttaaaaatatgacacggtcgctgctctgtgtctcacacatctcttctgtgtgcctaattgatttggggtttttttgtcgggggttgttaagtgggctctagagtcaagttacattaggcgtgtaatccttttttcttaatttttctggtttctgcatcaggagagtcttcatgcttcaatgaactgccctaggttagggacaagctgggaaagtggaatgggtgggaatacttttaagatactgcccttatcctaaagtagttctttgattaggttatagcagtttaatgttccatccttaaactaaatgctaaaaaatctccctgggccttttttttttttttttttgagaaatccagaagtaatgggaacataggattgtatggtgttagtgagtaaaggaaaatgcttttaattagttaactcagttattaaaatacatgatcttaattagtaagtattcagcaaacatctgattgtctttctaatttatgaactgtggatatgggagtctgtagtggttgtggtgggcgaaatgaaccaa

SEQ ID NO: 111671 - DNA, 1193 bp, Homo sapiens
gtaaaaacaatttaaagagagaaagagaaagatagagagagagagaattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgaacaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgac

SEQ ID NO: 111672 - DNA, 1038 bp, Homo sapiens
atctataatgtatctactatttttaaaatatcaaaatgttcaaatgaaaataagtatacattttaaagtagttacttctaagggaaaaaccttagtcataaaagcttctattgctcagagcaatgtatgaacaactctttggcattatccccaggatcagtttacaagtcaaaaataaaaactacttccactattttgaagtcaaattttataagcctactaatattgccccacagtaatactgaattcaaaataacattaggcaaattccctaaaaatgctatagtaggatatttgtattacattatatccaagtgttgagacattttaaatagtactttttaataaaaaacaatcatactgatcacctattgtgcttactttcagaggcaactgaaaggatgaaatcactgacttggatcttgggcctttgggctcttgcagcgtgtttcacagtaagtatcattaatcacgatcacacttctttatagtttctcattaaccattacttcagatttctttttacattaatgatgttaccttttcttatatattagtaactattaatcatcaatgaaacactgtttagggcttaaatttaaatttaaaatctaatttaaataaccacacatgtctgatggctgccatactggacagctcaagtctgtggtatcagactgcattaaacagatacgtataaatgttaagttcccatactctagtcagttacacagtaggtaaaactctataaaaatagataatcaaaataaaaccgttttcccagcatgtagtttatggatcatttacaccagagtcacctaactcacttattaaaaatatagtaaagacctcatccaagcttcaataagagtatcagataatgggacctggaaagatgcattttactaaggatctacaagtatctttgcatgctaaattttgggagaatgctaagcatttatatataaacagctactttgtatacaaaaccaggttaaagacaaatgagatactaaatatcatacaaaattacaaaaa

SEQ ID NO: 111673 - DNA, 2266 bp, Homo sapiens
taaagcgcagcgccctctattggccatcgggacctcgcctggaggtgccgtcaggattccgtcccccagccactcccaggcactcgagagtaagcgcattagcccgagaaagcgttctgtggaacggaacttccttatcctatcgtttccacacggaaagattttaattcaccggaatcgactggcgttaaagggcacagtgaaaaggaagttggtatcaacgtgatctcgactaagggaccgagcggaagtcctcaatcgtacgccacgcggagagcatgctgggggccggaaggaagaggaaattccagtagccgatcaggagtctgcaaactccggtggtaggggagcgcgctgctgtttagagccacgagttaccggagcgcctgattcctgcgccgaagtcagtggtggccgaaagtccggagtcgctgtaaaacctgagattgtgagccatggtggggagatcccggcggcgcggagcagctaagtgggcagctgtgcgagccaaggcaggtcccacgctcaccgacgaaaatggagatgatttaggattgccaccctcaccaggggacaccagctactaccaagatcaggtagatgactttcatgaggcacgatcccgggccgccttagctaagggctggaatgaagtacagagtggagacgaggaggatggcgaggaggaggaggaggaggtgctagccctagatatggacgatgaggacgacgaagatggagggaatgcgggggaggaggaggaggaggagaatgccgatgatgatggtgggagctccgtgcaaagtgaagctgaggcctctgtggatcccagtttgtcgtggggtcagaggaaaaaactttactatgacacggactatggttccaagtcccgaggccggcagagtcaacaggaggcagaggaggaggaaagagaggaggaggaggaggcacagatcattcagcggcgcctagcccaagcgctgcaagaggatgattttggtgtcgcctgggttgaggcctttgcaaaaccagtgcctcaggtagatgaggctgagacacgggtcgtgaaggatttggctaaagtttcagtgaaagagaagctgaaaatgttgcgaaaggaatcaccagaactcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgtaacttttcacataaagagaatgcatctttgacagttatcttatttgtaaggcagcctataaaatagttctgaagtatttta

SEQ ID NO: 111674 - DNA, 1077 bp, Homo sapiens
gcagcagcagaagtctttgaaacagactttggtttgggcttggtggattttgcttttggaatcagttctttctttacagcatcatccttaagtgtcaacagatgacgaatttctgaggacagcttctgatccacaacggacagcttgttgatcaaatttcggtaggtaacaagcctttctatgacaggatgtccatgtgctgggactctcctagctttcaggatcaaataaaaactgatgttcgagcaataattcaagtagaggttgtacttggtcctcaagtattggcttccttttccgggtggaatgatcccttgttccaccaactctaacaatggctccagctcatccttaacctctgtcaacttgactttcaggtcttctatcagctccaagagttctggtgattcctttcgcaacattttcagcttctctttcactgaaactttagccaaatccttcacgacccgtgtctcagcctcatctacctgaggcactggttttgcaaaggcctcaacccaggcgacaccaaaatcatcctcttgcagcgcttgggctaggcgccgctgaatgatctgtgcctcctcctcctcctctctttcctcctcctctgcctcctgttgactctgccggcctcgggacttggaaccatagtccgtgtcatagtaaagttttttcctctgaccccacgacaaactgggatccacagaggcctcagcttcactttgcacggagctcccaccatcatcatcggcattctcctcctcctcctcctcccccgcattccctccatcttcgtcgtcctcatcgtccatatctagggctagcacctcctcctcctcctcctcgccatcctcctcgtctccactctgtacttcattccagcccttagctaaggcggcccgggatcgtgcctcatgaaagtcatctacctgatcttggtagtagctggtgtcccctggtgagggtggcaatcctaaatcatctccattttcgtcggtgagcgtgggacctgccttggctcgcacagctgcccacttagctgctccgcgccgccgggatctccccaccatggct

SEQ ID NO: 111675 - DNA, 1029 bp, Homo sapiens
cacgtgcttgggcgggggcgagaagcggcctgcctgcccccctccacccggggcgccctggccctgtcccgggtcccgggctgggaaccttccccgaaggagtctaagagggggcggcgcccggagaccccgtggcccctctgacccgcctttttcgggctcccggcgccgcggcagctgagtaggtgtggctgctgcgccgccgccgccgccagtgcggccttagtaatactagtaactaattttttacgagcgttccttccatgccggtaaatatgacagatccgtcccccggattggaaagagaaatcggagcggtgcatgagaagacaagaagggaatgtgtggctttggaaggctacctcccagggttatatcggttgtcgggaagaggcctccacttttaaagccactggcacacgcgagcgctctgaatgcagctgacccacactccgtgctgtattttttattagtgaactgtttactgtgctggcaaacgagtagggccctagagtcgtcaatgaatataaggactcttagaggaatgttaaatctgattttcaaatacaagctcttacagtatgaaaatgtggctgacgatacaaggcatgctgtaagcgccaaatactttgctgtatgagttctggaaagggagacagaaacttgcctgaagcgatgagggaaggacctttcccaccatacaccctatatttttaaagcacaagtacaaatcttttagctgctctgccctgccaagaaaccctgactcaccttttctgccccgatccatctcctaggaaaagataatatttattgattatttcctatgtgcatgtgttgtgataatcatggttaataagtttgtgtgcgccaaactgaatgccactttttcagatgcggaagctcgatttatcccaagtaacagcttaagagaaggaatgcagttgacccagattgcttttctgctaaacccatgctctttaaatctaacaagagatccaaaactgtgatggtgggtgacaggttaac

SEQ ID NO: 111676 - DNA, 2040 bp, Homo sapiens
tactcaatccttactaattttgaaacacactccctactttgtgaagtggctcaggttatgagctgtagaatttgttgtgggaagtcagtagcacaccgtaagcattaaaaaattggtttgaaattgtgtgaaaggaaatttttttttgttttgtttgcttttttgagatggagtttcacttttgttgcccagtttggagtgcgatggggcaatcttgcctcacagcaacctctgcttcccgggtttagctgattctcctgcctcagtctcctgagtagcagggactatgggcatgcaccaccacacccacctaatttttgtattttagtagagacggggttttgccatgttggccaggctggtcttgaattcctgacctcaagggatccgcccgccccaacctcccaaagtgttgggattacaggcgtgagccaccatgcctggccaggaaatgtttttagagttacaaagcaaagcagtggtacttgagaaggtaagtagcaatatggccatgccccctactgtatttgaataattgtgaaaaggttcatagtctccctaaaacttctcaaggctgctggccaaggtggcattccctctctttgcaaagccttttttatctgacatgctccctaccgaccggacaagatactcagctttgtcagagggagtggtggggcgggggtgggaaagtttggaagaaaggtgtgggaaccttatgatgtgtaggaaaggagagcctggcaggccaagacagcaaaaagcaggtggaaagctgaagtcgttgtagcatgtcgccttttagagtgtgattcttctaacttcagagtctgtttagggactctccacagacatttatctacttctgctgtcttttttatgaacttaggaaatctgatcacttgaggtgagaatgcttggtaaaattctgacccatctctcttccttcctcaaaatctgagagataccactgtaaccctctgctcacatctcctttttactttcctttgcctctgtcccataaacgtttatccttactgactttcattttatgtgttgatagggtttttccagaactctcaaaggagaagcacttatcatagtgcagttatggtgacatttacttactgcttactttgtgccaagtgccatgctaagcatttaactccgaaatggttaatattattatccccattttgttaatgtagaaatgggcacagagaagtaacttgccaaggttactcagcagctaggtggtggacctaggattcactgtgagcatgctgactccagagtccacatgctatgtcacactctttcatcacctcccgtaactggaatcaggtcctagattagaggcacgtcttcaggcaaccagccctctggttccatattctactcactaatgccctatttactaaaaatgagtaaattaatgaaactcaagagtcaccaatctgatagaaaaaatggttgtatatgtaaaaaacgctgaataggtccatttataacagacattaagactttcctaaacacctaaaattgtctgtttcttgtctattgccttgttctttcttctgcatccctagcatatgggaggtaccctgtacatgttgagtgaatgaatctgttatgtacatgtaatgaagccagtgttagactgacctgtttgttggggcataaatatggtttgattttatagaatttgggggttttcacaattgaagtgaaacatgagggtggaaaaatgccattgcaaggctatatacatatctataccagcaagtatctattgagagtctggtatttggtaggtactattttgagtagatacgtaagaggtatgcaaaatgcatatttctttggtggagcttctggtctttgtggagctagttatttagtttcattttacaactgagtaaattgaggcaagaggaggataaatttcccaaggtcacctactaagtttttgatagctttacgtctgtgtaaattattgcctacagccactgagccatgaaatcagttttacttttcagg

SEQ ID NO: 111677 - DNA, 1043 bp, Homo sapiens
tgtctttaagcctctaaataaaacatttgaggtcacttatcacatctgattctattcaataatgagaaagctattaattttgttcatatatgaaaatgttatagaaattgtagtgatttataacactaagttaagacaacatgactataattataggattgtacatgatgaatacagtagaaacaccagggtatttggtaatggtatcctcaccattatatgaggatacaattttaagcaagttatgacatctaggaaatgtttgataaaacatttttttaacaatatggattattaggttagatgagaaaataacttttcagcatttatttattgaatatggactcctaagaaagcataatgcctggaaaggttaaatatgattaatatggcatccctatagattacaatagaatggtaatattggaatctattggccattgctttttataaattatttgtggtaactattatgatccatttgagatttccactgtcagtacctctgagatctttgtggtctcttgacttgcgacttttttccaggactcttgctaatttatgagaggttttctgcttctaccctttaattctcttaataccacagaaagagagctgatttgaatcatagctacaaatcgttttgtttttaatacagttgcttcttagctaaggtttattctctgtccttatactgatgaaaaaaaacaaaaaacgcttgcatatgaggagaaattctttataaacatctgcctgatagttaggcacatcgacaggacaaagaagaccataggtgaattgtacctagcagatggggttaggaaaggtgattctctgcctttgaccttgagttgaaatcttatcatgactcagaattttcccattgtgtttgataagcattttatcttcccagtcagccttagccttgagaaagttttagggatggttaataacacagaacacaaagcagtcattttgggtgtgtctttaagaacaatgtttaagtggtttttaagaccctttgcatcttttaacaattggtt

SEQ ID NO: 111678 - DNA, 1054 bp, Homo sapiens
caatagactaattatgtagctctgaaaagatttaagctggtggcactgtaaacatctacccttaaggtacatagtgactcaaaggaccttgaggtataaaagaatggcatgttacctattgtagtaaagtcctgagcatgccaaggtaaagtggagaacagctttacatggaaaagacagaccttttagtttctgggggagaaaagttctcttaaattaattgcatcactctgatacttaaaactttaatctctgttttaagaagaaaacagaaaatatgtctgtttgtaacagaaaaatgttctagatgggatatgcccaaggaaaagtccgagatccctggtatccaccacgcattcctacctagaaattcactttccagagcctttttctatacaaatcttggaggctcttcatattttgctttactaaggtaggcttttatcttcataggtgacaaatagagtttctaattaaatacaatacaataaagaacaaaatgggaatattccctctattgacttttgcaaggtcacagcaagtctgtaaagtaataatgtggatggtaagagtccattctcatgaatctgtaatcctacataatatagatttgtggcacattatattgtcaaaggattgaacctgaaaatgacttctgcaaatatgtctatatataatgtatttcagcactaatttactataaaataatagtagccaactcacagtatttttttttctgtatgagacactttccatttgctttacatatatagacacataattccaaaattaaaaaaacctctggaaatgaaaagcatttttcacaaatttgcctgaacttatttggtgttacaacatgatgtgaatttacttgaggctatttatagtctttattctacttaatctgaatattcatttcctgcagaaatattaatgtgcttgattgtaggttactgcctcagatcctgctagttctgtatggtgaataaacatctggctttattgaattatatgtgatttattttgtgtatcttcaaagtagcctcctttattt

SEQ ID NO: 111679 - DNA, 1354 bp, Homo sapiens
tcttcttgccttctcaatattcttttcttgttgttttttgtttgattgttttttttaaatctgtatgcctatgcttaccaacttcccaatattccatagcctatttctggattacatattcttttctattgagctgttttcttcattaataccacacaattttaggcactaaattgttaaaatgttttattatattatagggctaggccacaaactgtttgtgaaagaagaagggctgagtcttgggaagtagagaatttttttattttcacaaaatattatctattctaaaagcatgaatgaatccaaaaccatcttataacctaggattggtttcctgaaaagttgtgtgtgtatgtgtgtgtgtattgagagtgcgcttatgttgtaaagaatattaaaatactgctttatttttgttgccttagctaaaaaaacttttctcggacaaaataaatccttctgggggcctctagaactggtagaaaagcttgttccagaagccgcagagataacagcaagtgttaaagatcttccaggacttaagtaagtctaaggttgaattccatttctcaggaacagcattcttattaactatcccttgaagagcaagactaaagacaattatgtacgaataatttattttataacaatccaaaatgcatgatgtcatgaataggtgctgacaggagagaattggtatacagaatattgagaaaaatgtgctcttgagggataattattcatctaagagagattgtctttttgttgaaatgccaaacatttgcttattttttaaagcacttgggagaatcatatctaagggggtggcatgctgtacttgacttagggaaaaaaggtattcagtgggtttgagagtcaagattaaaacagctgtcaaattaacctgaagagctagtgactgtagcctgccttagaactataaagtagtgaccaccttcccaaatgagactggtttaattttaatcagacagaggcctagattgcctgtgtccacattcatgctttggacatttatataatccacactgaatttataaggatttgctattattgatctgatggaacatttttagttgggtctcccagaggctgtgtcttcaaattgtagttacattcagtaattctttttgaaagcatttgttccgggtcacattagcccacacacaaaaattccttgcatgggaatgtactgggagaggtcctgaggagcacctcagtgtgcttgttacactggaataccattagcaagaataagtgaactgattctactgtagcctttgcttctggtgcttatgttttcagttgtttgatttctgtgtttttgtaggac

SEQ ID NO: 111680 - DNA, 1094 bp, Homo sapiens
gtaattgcgatgttaccccagggacccagatggtcctctgggttccctgggctcttgaatatatcaacaacattcacatttaggaggactgcaactgcttcattttgtgctgactgctgtaaccctgtaggtatatttctataataagatatgaccatcagttgtcgtaatatctactgaagtgtctcaaatatgtatatattttagatgtattaaataacactatctttggcttagcaggtttttcagatttgtacattattgggcaaatgttattgtatatcctaattattattgttaattattaattaattattgttaatgtctctgaaaatgaatggtagcttaagctattttgccagaatattcagacctgagagttttggtgtactttttcctgtgaaatattatggtttgtacttagttgaaggaacagagtgtaagcaatttacttacctttgggggcaggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcaggtaggggaaatatgaggaatagactcactggctctctaaaatcctggggcttccctcctcccatctgatcctccagaatcacactttaattacaagaggaaagaatcacatctcattttgatgctagctgccagtaaactactttcagaatcagacaaccatgggatcctgtattgctgttctagaaaaccatggccacttttcacattatagtagaggatgagggtcttttttatcctatagggtaatttctactctgcagtctaccgtgccagctaagttatatattctattagcttttacactggaatgtgatacattgatgaactattactgtgatcacactgcatataacaatactaactttagataaattgcttttttttccatttcaggattaactgatattgaaatatatgaacatttctgttttcccacttaccattagattcaaaagg

SEQ ID NO: 111681 - DNA, 2230 bp, Homo sapiens
tatcgttattttccataacagagttcagacttaggagtaaaacagaaaagtgaactaaacagtcgcttggaagagaagactaatcagatggctgctaccattaaacaacttgaacaaaggtaaaagtcctgtttctttaatgaaacactttggattgtcagtgctgaagtgaaaagaatgtgctgtacattcggcaaatagaaaatacatgaaattcttccaaattagcatcagacattctggtagaaaaaagccagttgaatgttatgtgtgttttctaaggtatgactgaaatgtttttaggaaatgtcaatcacttgactagcctttaaaaaaaaaaaagaaaggtcagccttttatgactgttttgaacatcagaactcttaatccatgtcagagtcatgtgttagaggaaggatacttaaaagcatggaaggactcttaaatgtatgtatgtaattctgtgattttattgttcatcactgaagtctttgaatacttggatgctaggggatatagaggcactgagagataggtgtcctccaaggatctattctggatctttctctcccttctttaacccttttctcttatctcccttttctttctcctgggtagttctgtagcttccactgtcacctccagtgtgttttcccagctcttaccttcatctggagaccagtcttgagttttcatcctttgggcagctatcttccaccagtatctacaattcagtctgcccaaagcacatcttcttcctatgctactctctttctgtgcttatgtgaaaccaccattttctctctggcaacttagcagccaagagaaatggctgagtcttcaaggatgaatgtgacgtggtacccaaggtcatttgatgtttctacccttaacacctgtttgtcacccttcttgcacttgagcaaaactaaactgctggtccctgtacttcccatttttcccatttatttctttcccaatagttccaccaattagaaatgtcctaattcttcccactcccttattcgtcagatacatttttaagtttaggctcaaatgccacctccccagagtttcctctgatacctctttgcagctagaaatgatctgtctttctgggaactcccatagcttcatactcatatctatctatactgcttatggcacttctcactgtctactgtaccttttaactctttatatatgtctcctccgatgcgagtgtaagctccctgagattagttaacgaatcttttaagttcccgtattagatctgtcgcagtgccttgaatatacaagcattcattcagtagatatatgaatgaatggattaatgggtgatttcttatattcagatgattcttaaccagtaagggtcctgaacagcagtgcatattaatgttaactcaaaacttaatggcaaatttataaataaacctgaaacctcttacatagccaaatacaaatgtatcagtctacctaggaaagatggttaggtacttgctcataaacagttatatgtttatgatttaacaaaatgattttactgttcataaattgtgcttttgaaatgaaatgtatcaaatttcttttcaatgatgttttgacttggaatttaaagcaaacagaaagagaataatgacttatctctttgagtattaagctgacttattctcttgctatttttgtgtttcctgtttatccattttctcattctcctttcacttcattgtcatttttattttatttagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttct

SEQ ID NO: 111682 - DNA, 1050 bp, Homo sapiens
atttcaacctgaatgggttttctggtgacagtctcattcatttccccttcttgggttaatttgctaaagctcacatcttaagaatatttgggactgatacacaacatgtgataatggataatggatagatttccataatatcaaatagaaaaaaagctactaaaatatatggccagtgaaccattggagttttacacattgggaaacataaatgctaactattttgatagcaaaaaggaatgtaaaatataacttcaaatctatttttaaatgggaacccttatataataagtcaagggtcagattctagtgattcattttaagaagcaaagtttcctctccttggaggtcaaaattaataattatgttgttctaagtaatataaaagacctacagtatttcttgtttgaaaaaaatgtttgtattctgagctttttattgaaatgatataaatgaaaatacatgaagttcctatttgtcacaattttttacttctccattgtaggctgcaaccccaccctatggatgaacaggtaacagagcctcctgtttcaaaacatcttgtatgaattatgaagttggttgtaccgtgcctagccagcaaataaggtagcatgggcggaagatgagtgaatacagtgtgccatccttctaacaataccctgaacaaatatgtattgcctgaagctcacacaggaagtagcacagctttgagcagtttactaagtaaacatcagttctcacctattttaaattatccctgacataagatctaggagagctcactttatgtccctttcctctagtttttccttacataaaatggagagaaaaaagatgttttgatcacttagaaataagctaacataaatgattgtaaaacactttgttaatctaatagtatatgataagcccatgagaaagacagtgaatgctactgtgtctgagtcaccctgtcatttacctcttaggttataaaataaaataagtcctactgctttcctttttttttttttaaatggagataaggtcttactcacattgcccaag

SEQ ID NO: 111683 - DNA, 1005 bp, Homo sapiens
aaagtaaataactgcccttttcagaatctccttccacaaaacaagccaactcttccccattccctccatcttcctttccaagtcataatggaaattgtaaggagttttaaaaatagggtttggcttttgcaaatagaagatattgattaaagcaaagtcaaatatagagtaaaataagtttaatttgttttcttaagacagggtcttgctctgttgcacaagctggagggcagtagtgcaatcacagctcactgaatccctgttctcccgggcctcaagcaatcttcccaccttagcctcccaagtagctgggactggctttttttttttttttttggccggggagggggtctcattggttgctcagcctggtctcaaactcctgggcttaagcagtcctcccaccttgacttccacagtgccgagattacaggcatgagccaccacacctggccaagtttaatttgttcatggctgagaacagttagctcggaatacttacattgttttttgaataaggaattccttattctgagtgagtcacgaatgagagctgatagatgctttcttgaaaagggcaatacagtcatcccttggtatccatgggggattggttccaggaacccaacttgatatcagaatccatgggtgctcaagtcccattatagagaatgggttatatggtatttgcatataacctacatacatcctcctgtgtactttaaatcatctgaagatgattacttatacctaataaaatacctacacatcacttcatttgcatggattcaacatagtgcttggtgttcagtaaattcaagttttgcttttttggaactttgtggaatttttctttttctgaatatttttgattggcagttggttgaagccatggatgcagaacccatggatatggagggctgactgtacttacttacatatctatctatctttgagtaacaaactctttgggggaaaagagggaagtgtattgagcaagagaag

SEQ ID NO: 111684 - DNA, 1734 bp, Homo sapiens
gcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatcagtagtactgcctagatggaaatgcgttttcatatatggttgaatatgccaagctatgagaactggtatctgtagttgtacgaactattagaatgtgatctttgttgctctttcacatttggtatctgatttgctgtggaaaagatctgtggggcctactgtgaggaattcatctgcaattgatttaagctaatgagttttatttgcacatctctggaaaaagaatgcaagcaaagcattaaaatgctatatgatggatgggtaaggttgaaaggatatatcttcttggcacgctacaggctgagttttctgtacaaaatgtggccattattgggaaatcattttatgtatttgaatgctcccttttgtttttgttcatgatctaggctagtacgtaagtgattgctaaggtggatgtagttatgggaaaggaagagaagcacataatacagtaaaagtaatcttatttccatgcaagtggaagacggtaccgtctccccacatttgagaagactgttttgcatcactctttgctattgaaggaagcagtgatggtgaatttccttctgtttgggttccttgtgtctataacttcctttgtggtaaagccatcaggaagaatagtgggagtggggcatatggtcagggtgctcatatcctgctttagcctagctgctgcttacggagtg

SEQ ID NO: 111685 - DNA, 1504 bp, Homo sapiens
gtgcctggcaccgtgcctgactaatttttctatttttagtagacacaggtttcgccatgttggccaggctggtctcgaactcctgggttcaaatggtccacctgcctcgacctcccaaagtgccgggattacaggcatgagccaccgcatccagcctgtttgtccattttacattttgtttgtttgtggttgtttgagacggagtcttgtctgtcgcccagtctgtagtgcagtggtatgatctcagctcactgcaacctccgcctcctgggttcaagtgattgtcctgccacagcctcccgagtagctgggactataggcacccaccaccacactggctaatttttgtatttttagtagagatggggtttcgctacattggccaggctggcttgaactccttacctcaggtgatcctcccacttcggcttcccaaagtactgggattacaataggcgtgagccaccgtgtctggcctaaattttgtttttaattagggaaaggaaagggcaaagggtttgagttgctgtctgaactgtgagaaaaatggctgtaatatttttctaccttttcaactttttaaaactaatctttctcattatcctcagatcataggtatattgaactgttcctgaattcatgtccaaaaggaaaataagactctaggggctccagataataaggtaaatttaagaggtaatactgtgggctgggtgcagtggctcacacctgtaatcccagtactttgggaggccaaggtgggcggaccacctgaggtcaggagttcaagccagcctggccaacatggtgaaaccctgtctctactaaaaatacaaaaattaaccgagcatgatggtgggtgcctgtaattccagctactcaggaggctgaagcgggagaatcacttgaacccgggaggcagcggttgcagtgagctgagattgtgccactgcactccagcctgggcaacagagcgagactcaaaaaaaaaaaaaaaaaagagagagatacaactgtggaaattatttgctattgataaactaataatcattcactcactaatttgtaatatggtagaaaccattctctttttatttttcaaatttttttagggactaggtcttgctctgttgcccaggctagcagtggtgcgatcatagctcactgcagcttcaaccttctgggctcaggtgattctctcacttcagcctcccaagtagctgggactacaggtgtgtactaccatgcctacctaattttttaattttttgtagagatggggtctcactatgttgcccaggctggccttgaacttctggccttaagtgatcctgctgcctttgcctcccaaagtgttggaattacaagagtgagccaccccgcctggcaccattcctttttaataaagatcaaactaatgataattgaagtgtcaatataaggaatgaaaattctcgctctggcttctcagatgtggggggcaaaaaaaaaaaaagaaaattct

SEQ ID NO: 111686 - DNA, 1050 bp, Homo sapiens
catgcccagctaacttatttttatttttattttttgtagagacagtgtctggctgtgttgcccaggctggtctcgaactcctgggctcaagtgattctcctgcttcagccttccaaagtgttgggattacaagtgtgagctaccacgcccagcctttgttcttttttttttttttcagtgcctataatctagaaagtctcttttagggtttaattcataatcattttacctgctctctgatgttacaaaaagggctaagttcttaaactggtaatggtctgaggcattcagtgcttatgggtgttcaggtgatatttgttgagtggcagaaatttcagatcattttggcttttaatgctcttaagaggaattgaggatttggacataaaagtcatacctaattagaatctgttaataacccttgaagctgttatgttttaacagtgctttctgttccacctctcagaattgcctaaggaggtgccagaaaagcttccagaggctgctgattttggaactacgtcttctctgcattttgtccacatgagaggattacctttccaagccaatgcccaagacattataaacgtgtgtggcagtaagatatccaatctcaatagatttgaacaaaagttctaaaattgaacttgtattaatttggggaaggtagagaagaaaatatagtgtttctgcgttggatagtaagatggcatcttcctggttgcaaagcttgcttctttttctgtagctgaaaagtgtggcttggtattacttttttttgtgacagagtctcgctctgtcgcccaggctggagtgcagtggagtgaacttggctcactgcaacctctgcctcccgggttcaagcatttcttccgccttggtctaccgagtagctgggattacaggcaggcgccaccatgcccggctaattttagtattttcagtagagatggggtttcaccatgttggccaggctggttttgatctcctgacctcaagcgatccactgtcctcggcctcccaaagtgttgagattacaggtgtgagcca

SEQ ID NO: 111687 - DNA, 1851 bp, Homo sapiens
taaactatggtaataaaattactcatacaggaaatattttagagacctatggagatgattttaaaggaagacacttatgtataaatttaactatattgtatttccttaagtgattgtagaaacattgcaatagaaataatgaattttgtgttgggcctatcctgatttgctatttaatgatcaggaaggagatcataagcttctgtgctaaggtttgcttatcttttctacttggaaggttttagagactaaatccttattggtgtttggatgacttcagtgatggggatttgtgtaaggaatatgacacttgtttcctgctttgttgttggaaaactgcattcttgtgacttacataattgagctaaaagtttgatttctgttttcaattgattttgctcatacacttttagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaaggtatgtgaagtcagattatggctttttgggatcattgcattaggttttatacttttcaaggtagtttttatttgatccttaataatgaagtatttagattgtatgaatgcattcttttataggatgtgaaaataaaacataaagagataaagtttcttttttttgtgggggggatggaatctcactctgtcacccaggctggagtgcagtggtgcgatttcagctcactgcaacctctgcctcctgggttcaagcaattctcctgtctcagcctcccaagtagctgggactacaggcacatgccatgatacccagctaatttttgtatttttattagagatggggttttaccatattggtcaggctggtctcaaactcctgacctcaggtaatccacccgccttggcctcccaaagttctgggattataggcgtgagccagtgtgcctggccaatgaagtatcttacaagctgtgagaaataaagaagttatgcccgcatggtaaatatgcaataaatgtcatttgttattttctctagagaagcgcataaagattaaaatagttattgaattctcagataacccagcaagttgtaatgattttttttaatgggtttgttcctttgttatgtaaatttttcatccctgttgggttttttcttcgtagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggtactttgcagttgtattatgcttgggagctcatatcttttttcccttggtatctccttctatatcttagatgagcctgtttctgggcaaaggcatgcagttatattaggttctttaggggagagctcttcacttaaatttctaatatttatagattttatatgtgtttttgttctatcaggcagattttaggagggaagtcagatttcagaataatttcatgagggttttactattgaaggaaataacttctcataatagttgctgtatttgtgtaagacaataacaatttatataatttaaaagtattttctaattcctagaaccattagcagtgaagtctgtgatttctattgtttcctagtatataattaacagcaaaaaaaaaaaaaaaaactggtggggagaattgtatgttttgggtgggcttcttggaccttacctattctggaaatacaagtatgtaggtgt

SEQ ID NO: 111688 - DNA, 1048 bp, Homo sapiens
gcagtgtaagtgtggctggggtgaatgttgaggccttgttccccgcctggcccatggtaggtttcgtgaggctgctgacgcccccacctcgcatcttcttgctttccgccggctggttgtgaagttgcgaggcccgagcccgccggagggttgggagtttccgtgcagcccgagcgctaggcctgggcggccctcggcgcctctcggtcggccgctgctgggaaggtgcgcgcacacagttgcgtgggctggcttgtagggaaggagcctgtccccatcgcgccgttccctctcctgtccccagggaaagacgagctgtcccggtttactgaaggtcacctctgcaactccactcatacagaaggtctttaaggactgtgtgtcgcctcgtctgggaaagcagtttggagatttagctgttggggggagggggtgaatgggagggagcgttgagggttgaggacacaacttggggtcccaggaatgaatttgcaatgttttcctttccattttttctttatttttttagaaaagtcggtgtgtagttagattgcaaatattttgtgctttgtagatgaacctttctcttcttggtacgtggcatctgggaagtgtctgcacactttttaactacccagcccctgattccttaggtcatatttatcttaattcaatttgtgcttctcctttaacttagggagactgggaggctaatcagcatggctgctgtctgccagtggctgagctaattgatttgaatcctggcccaatactttacgctgcctttttctgtaaaagcttgtgatgcttatggaattatggaaaaatggggaaagttgtctacaaaaaccacaacaaaaccatctccagtaaacctttgtgagctagcttctctctttttttttctatgaaattgactgcggtgatatctgtagagcatctactatgtgttagacactgcttacatttattccttaaaactaaacattaagcctttttttttttttttttttggagaccgagtctcgctctgtcgcccaggctggag

SEQ ID NO: 111689 - DNA, 1070 bp, Homo sapiens
acaggcctgtgccaccacacctggctaatttttgaatttttagtagagacggggttttactatgttggccaggctggtctcaaactcctgacctcgtgatctgcctgccttggcctcccaatatgctggaattacaggcgtgagccaccacgcccagccctgtatgattcttgtaagggtcttctgaaagtaagacttgcattaccagattactgattatctttggaaagagtgagttgacctgtcatagcctcagttttagcccatttaaaatgggagccttctatcattacatgatctctaaaatatcttccagttctaaagttctctcctgccaggggcatccttcaaatgactggcacacatttccaaactgctccctgatttggcttaggtagccttagttttggtctgacataatttagatgtatcctgtgacactgaataagggaaaactggcagaggaaagaatctgcaaaaataccttctgagtatttctttatcataccactaggagagttgcctggaattaacatccaataaaacgtaaatatactggtcctaaatgtgagggaggtgtcaggttaataatatacaatatgattccaggttagactttaaatcaaatgatgtctgtcatataaaattattcagcatatcaaaaacattgggaatttcagaatcaaagagagtttatattcaaatagatatttataattatcatctcttctgaccaaaatctaataaccttttgtttatgaagcaagattattaaaatttttgttctatccaacttttcaaagaattgaaattatactgtaacatgtacagaatagaacagaacatgagtgggcatatgctctttaaatattcatttgaataaagacacatgcacatgtttgtttattgcagcactatttaccgtagcgaagacttggaaccaacccaaatgcccatcaacgagagactggataaagaaaatgtggcacatatacaccatggaatactatgcaaccataaaaaagaattagttcatgtcctttgcagggacatggatgaagctggaaacc

SEQ ID NO: 111690 - DNA, 1031 bp, Homo sapiens
tatttaacctgttggatttgttcttttaattcccttttggtgcaaggacagagcttgccaccttgttttaacacccaaaaaatgtgggttgaatcagtacattttggaaactggcttttattattacttctactaataatagcaatgacagttaccatttatttagtggtacctaaatgtaaggcctttcatacatgttttttacatcatatgtcaacattcattataagaatattgctctatgcattgccgtagactcaaagaatttagtcaaatgatcaaagagcccgtaacagaagtataatattgtagctcaggaaaaatatggagataccatatgaagaggtaaaagaagttggcagttctcagtaaagagaaaggaagactgcactaggaaagacacaaagctgtgtttgaaccttcacttctttctagcccatggagatgagtatagctgcagagctattcaaaatctagcgtctgtcaattcccttcctccatttacacctcttcctgcagaagtatgtttgtggtttttacccgtcacgggactgtttactttggagaaacgtcttctgtggactttgtatggggtttgtagttgcaggtgcatcttttgttctctcctcaccctgtttgaacttatatgaactgtcacactccccacctcgcctttttgaaaagtctagtcaagatagtccctttaaaaaataatgtggtttaggctgggcatggtggctcacgcctataatcccagcactttgggaggctgagactggcagatcatcacctgagatcgggaggttgagagcagcctgggcaacatagtgaatctcgtctctattaataatagaaaaattagctgggcgtggtggtgtgcatctgtaatcccagccactcaggcaggagaatcacttaaacctgggaggtgggggtgaggttgcagtgagctgagatcgtgccagtgtgtgtactccagcctgaatgatagagtgagactctgtctcaaaaaaaaaaaaaaaaaagtaatt

SEQ ID NO: 111691 - DNA, 1062 bp, Homo sapiens
atataaatgctatttatggtggctatgtaaaaaaatggacatgtgaggagagcatagaaacaaaacatgagtttgttgggatctacttagtttggattgtgataaacgcaaagtagtccactgggtatttaaaaatgtatctttatttggaggagcagagtgttgaaaacatgtctgtgtgtacattagtaatatagatacataaaatatatacactgtgtataggtatatactaatcttctgtgtgctttttatctctccaatgcagatatgagtatcattgggcagatggaacgaacataaagaaacctattaagtgctctgcaccaaagtatattgattacttgatgacttgggttcaggaccagttggatgatgagacgttatttccatcaaaaattggtataattaatttttgtaagggggatccatcatgatttatcttttatatgtttatagaattttcctccctctttccactatatctagttggagagttctttatggctgtgttgatatatgtatatgttacgcagttcccaagaagaggcacaaaagtttgttaacccagtggtaaaataagcaagtgatcctgtgtgaattgagcttttcccctttaacttagtgcttttaaatgcttaattagctgaaagtataggtttattagaaaataaatgatctccctctcttaaggtaattatttttgatgatattctagattaaagtatcactgagtttattttcagacaatgatagcattttttaacactttaaaaaaattatgatcatcattgagaataaacttacttccctgaagtaagggaaaggcttaagaagccctttcagtagaaagttctagatggagggttattcctattctaggaaccatggtaaattaccatacataacatatatttttaatcttatgcacttacaggtgttctatgtttttcataccaaatttatcatgaacattaaggtaaaccctctattttattttatttattttaatctaaatttttcattttttgggagacaagagtatctctgtattgcccaggc

SEQ ID NO: 111692 - DNA, 1071 bp, Homo sapiens
aaagaatttcatgtctgtggcaaaaactatactcaaacgcctctttagggtttatgctcacatttatcatcagcattttgaccctgtgatccagcttcaggaggaagcacatctaaatacatctttcaagcactttattttttttgtccaggtaagttggattaggaggcctttggtgctcagggtaagcatttatcttcatagttctaaggtaaatactgtattcacactgtcaggatggaatttgccatatctctgtagtctgcatcctcttctacagttttccatgatgataaggactgactttttgtttctaaattttattagtttccaagttgatggtatgcaagtctaaaatggatttgaaaagttgtgccttggatttgcttcagttaacaggccatatggagggactggataatgaatctgactagtttggcagatctgtggatgaactggttctcctgggcattttagtacttctcctactgcagtctgccctggatctttattagcggactctggtgcaggaatgggttttgaatatcacatctgttttttgtccttttgttttttttaaaaccacattctaaataagttttaagttaaggactatccatcatgtctgagggaaaaatatgtcacaaagaatgtttctgtgccagagggccattagtctttggtctgacttcctagttaacttcctctttttttagtcttcaaataactggccttagaaatgcagactaagagcagtgacagtattctcaccatgctctaataataagagaaataacaggcaaaaatgaaaaagaggtggaaataaaagagctgaccagttttttattgttgctattattgttgttggaggttgagaaggggagatggtcatcaggagaataaacaattaaacatcttgaattcgtgttgtttttgtatatctacaggcatatatttataaatgcctttgccacttcccctgttctcttaagaaatttgtatccatcttccccctgtacacactcctcacactgaaggcacacattttacctatataaacatactttagga

SEQ ID NO: 111693 - DNA, 5961 bp, Homo sapiens
attcagccatattcgtgttattttcctaccatatcttttgatagcttgcagatacgttagtttgtaaccaggttttggcttttcatataatgctgaatttgcctgagatgctagtgttttgtgtgtgtgtctatgtctacttggttaactgtatttaaatggtgtccagatcattcctttcaacaggaagcagcaacttccatttattgttactttgtgtcaggcattacatgaagtagttaacatccagtatcacatttagtccccacaataattttatgagatagggggatttatcctaatgtcacagatgtaaaagcataacatcaggagtgcttaagtgatttacccaagacacagacctagtgaacaagaaaaaaataatctacttttatgtacttcaaaagctaatttccaacaaatgttcatggtaatttactttggaataagatgcaaataatgtttttgctatttattctgcctttctttatatcatgcataggaattcaaccttattgatagaagagaacttgcaccactccaagaactgattgaaaaactcacctcaaaagacagataaaaggatgcagagctgtgcaaattgttcctcaaatgaagcagtgtggagtgtattggggattttgttatattttgtttttatctggattgtttttgtcctaggtttgggggcgggggcttgtttgggttcctttttctttattctgattatgtgaaaccatattctattgctaggggaagccaagaaccattctctatacacttgataagggtaaatttatcttagtgtttttaaacttggttttggttacttgaggagttttttaataatattgtgtgctgcaagaaagtgcttgttgattgaactgccgatggattggtttctgtgtggtataaattgtggcccatttatgaagtccccaaaagagttatgtttttaagtgccttggcaggctcacttctgaggtgcaaaacatagatatagaactgaacagggcttgaaacaatattaggattactacccagggcacttactggtgcatgttgtaacatatctatgataaaagccatagtttacctaaaatggtgatttccagcctttactgctttgaagaaacagaatttgtaaaggtatgcatgtagaacataaaaaatatttcttaattattttttatattgatggtaatatattacgttcaacaatgcttaaagctctacaagcaggtcttttcccacctcttgatatctgtgatactgaaacttgaggatgttgaaatgtattacattttggcttctttctacatgttaactgcactgtagatgtaaaaattcaggttatatataggattgccatcttcagaggtgatgctgaactgtgaggtttcctagtaattgccaaatgagccgtaagtctgcagaattcccttctactttgaagagaaggggataggaatgtatatttggctgggggcatggagatgttcgtatgtatgaggagttagggatggggagtcaagttctagaaagttttgtctgaaaacctttgaatagaatggcatgaagattttaatcaattacttataaacaaagtcttagagacttccttttaggaatcaacttccatgagaagttaaaaataaattattaattttaggtacagacattaaacatggaatttaaggactgttgggggaaattgatcacttcttagcatttccattcagtgaatggagctgatgtttgcctgtcattttaagatgataccataccttctttggttattataggtccagtttgaagcattctgacttctggtttttccaccctgaaaggaaatgtttttctttgcagcagtattagataatgaaaaatgctaattcagtagttattaacttctaaattttattcgccatgactttctagtgaattattaccataaataacaatttcagaaacttagtttttagaataaatattaatttttccacttcagttttattctagaaaataccctttttagaaatccagttttagttttgtcattttcgataaatctttcttcagttagaaatatatatccttccttcagttgaaacatatacctttttcacatctaggaagaaatgcttgctctgaaatagtatagattaaaaacactcagtagaaaagaatctaaaattaaatgaatttgttttgccattaaagtagagcagtgatacaatttaatgccattacaattatgttgactagaaactgcctttttctccacttcatttctagcaattatttaccaagtaccaacagtagaagtaacaggaaagcctggcagagttaaatatcttggacatttattggtaaagcttatttataaactgcagtcagagctagttaatttccttaaatctttttgtattcagatagataatatgaatcattatgggttgattcagaaataaaatttgtgaggtgattttgaatcttgtccatataggaaaatgaagcacagaattactcagtcttccatattgtatttgacttcatatcaatctagtaaaaaaggagttgcaatagccaagtatagagagaatagtgaaaaattaatcttgccctttcaagccttatacagtagtacactgtacttgtttttagtagtaagacctactttcccactatatgtagatagtttgttttcactgtgccagaatctcaggtgcctgcttagagtatttctttaatcacagtcactgggaagtaaggagatgtatatatgtgtatatatggtaacaaagcatagcagttctctaggggagaggcctggcattgcacatggtgttacatggctacaagtaaggaaaaaatcagaaagtgaaagaactgatgtaataaaaggttgatttggttggttcccatgaaagttagtaagatgcccttttaaatataaggatcagtgctttgttctgcagcagagtttgctgataaatgtctgttggattctttttggatttctttaattaatttgtaagtaaccaagataattattttcccccttgctctctatattaatacgtagctataaagcaacagttggttttcttatcctttgataaaagcatcccataaaatataaagtagtaagttaacatagtattattgtcacacacaatgctttttttggttaaatgttgatacgaagcaatgttttggaattactttaattgatggagtagtggtggtagagagaaattaataacaaaaagagtgaaaatattttaattagcagtagatggtgctactggctttcatttgctgacttgattattccctttctcttaaaaaccatggcattagactgcactaaattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatacttttgtttacccctctctgagacaggttttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcaggaaaatcagtttcatcattttagttacactaaacacttttggcagcttaatatgacctttttaaattttttttattttttttatttttatttctttaagatggagtcttgctctgttgcccgggctggagtacaatggcatgatctcagctcactgcaacctccacctcctgggttcaagcatttctcctgcctcagcctcccaagtagctgggattacaggcagcaccacacctggctaattttcatatttttagtagagatggggtttcaacatattggccaggctggtctcaaactcctgacctcaagtgatccgccctccccagcctcccaaagtgctgggattacaggtgtgagccaccacagccagccagtatgacctatcttaatcatcagctcaactgtaatttaaatttggctgttctctggagctaaaccattagggaagttcaaaggaatgtgccatgatttccgaatttgcacaagagaatgttttaagcattggtagcataattgaataaaagaatagtttcctgatgtcactattttgaagtggaaattatcacttggatgtggaggttttactttttaaaaacattcagcttaattaccttaccttaattaccttagttagatatactaatggaaaaaaaccaagtcctttctctagaacttgttttctatttttgttccttttcatgaaaacttctcaatttaattttaactactgtaggatagtattgattgaatggatactatggaaaagtggatccaatatttaagatagaagtagtttaaggagacaacagcctttactgccatttttttttaaatgttttcactcagatgaacaatttgactttaataaaagactggagatttttgtacaaagaaataggaataagtttcatatactaattatgctgagttttaagcctacatatcacaaaatatttagaattgtataaccttttcatatatttataacttttaatgtctttttaaaagatgtgggaccaaaaatatatttataatttggaaatgtgactgcataccaataagaaaacttaccttattttgaaatttatctgggatattaaagaatctaccaattcttaaaaacacagatttatactttaagcttattttaaaattaaagaatatataccaattcttagaaacactttaaggactactcttaaataacttaaatatcagagttttgttgtaatattaaaatttaccgtggaaatcactgttgttcagctatcaccttaattgtgtatgatatgataaatgtttagcagtaaagctatcttaagatttaatggaaaagtttaatttgaagatgtaacaaaaattctgaccacagttgattctgaatttttaaggctttcctaataggctgatcacagagaataatccattttgaaggtataaaactgcactgtatgtctgtcacttgtagctgaactgattcacattttgacaaaagagagaaaatacaaaaatgagttttgcaaatgtaataactttttctgcatatagaactaaataattgaaaaatatgggctatagttctcaaaggtagatagtaaaatcactggctttttccagctgtatgtttttccactgtgcgtgtacacacacactggaaaataattaggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattt

SEQ ID NO: 111694 - DNA, 1053 bp, Homo sapiens
agttagcacagtaataatcatttgttgacctcttcaccaagctattatttaatattttgtcttcattacagatcattaaggaatattaataatattggagaatcatttaccaagttccaaaaggaaatgtgtattttattttattttatttatgagacggagtcttgctctgttgcccaggctggagtgcaatggcacgacctcagctcactgcaacttccacctcctgggttcaagtgattctcctgcctcagcctcccaagtagctgggattacaggcatatgccactatgtccggctaattttttgtatttttagtagagacagggtttcaccatgttggccaggctggtctcaaaactcctgacctaaggtgacccatgagctttggcttcccaaagtgctgggattataggcgtgagccatcgcgcctggccaaaacgtgtattttagaagtcttctcagagtatcagaagtatttatgttagaggcatttgtgtttgaatcttcaggttaagaatatttaatggtagtagccacagttgctcaaagtcactaatggtatttgggagaaagactagttgaaatgctagccaatgctgttgtggactgtgtctgcatgctttaaaaacgccctgtgggccgggcgcggtggctcacgcctgtaatcccagcacttagggaggccgaggtgggcggatcacgagctcaggagttgagacctgcctggccaatgtggggaaaccccatctctactaaaaaatacattaaaaaattagccgggcacggtggcgcttgcctgttgtcccagttactcgggaggctgaggcaggagaattgcttgaatccgagaggcggactgtgccactgcactccagcctgggcgacagagcaagactccgtctcaaaaaataaaaaaataaaaacactctgttattcatttattgtgtgtaaagaaatatatattgtaaaattacctacattttgataattaggttcatttacctctgttgtactaaatgtattataagttgttaatcccttatataacat

SEQ ID NO: 111695 - DNA, 1051 bp, Homo sapiens
tcacaggagtgaaggtgtggcctgtatgctgcctagtcttgcctagaaattgctgcacctgctgttcttttgcttatgccttaacccttggttaccctaattccctattctcttgcctcattaggtctttaccctgactaaaaatgcactcatctagctgggacaaatcctacactgcatttgtcccatctagatgagtattctagcagagtacatggcacatgagtaggcattcaaaaattcaacatacagtacattttgttacctatgtgccaggtgtcgggcaggctgagttaacagctgaacagaaacctacctacccaacgtgctaacttctatacagcatggtcgtgcatccaaatcaaatggaaagcggtatgggagatctggaaaggcctcctgtgggtggcatctgactacctaaattcccatcccagtttcacttactgactttgacacttggaacaagcagcctctcagtgcctgttttcccactggcaggtaaatgggctaatgacggtatttctggcactagacttcgttaattaatgaaaagcacatagaagaaaacagcctggctctctaagtgggcagtgcgattcccaaggacggcacttcgcctgatagtcttcctctaggctgagaagccagagtaaatccatttgattttcctaccacacagtgccttctccccagatgagttcaaagctttaagtctatccagttctgtccagacgcgtctgttcatctccaacaggcccactagagaggcgggttttccaaagcctggcacggcccactgcaggtgacgccctctgccctccagcgccctcaggcctctggggtccacccttcctccccacccgactccggaacctcttcccgcgccctgcccgggcgcctggctgcttggggtagaggccttccgccacacgcgcggccccgccccggccttcacgtgacctggcgtgcggagcgcgcacgcgggaacccgcgctggaggcgggcgagggccgaggggcagctagggagcgcggcttgaggagggcgg

SEQ ID NO: 111696 - DNA, 1088 bp, Homo sapiens
caataataaattcattacatattaatataaatacatttgacaaaaagttatattttctaaaataaaaagtagctagaagaatatcattgctttacatttttgcagatatctttaatgcctcacttattaaaagacagctggatttttatttatgcttctgtatttaatctgttatggtatgtttgtttgtttgaagtatattggtatatgaagtaatctggcctctcacagaaccccttagaagatcttggggacttaatggggtcctcactccgtattttgagaaccattggccaaaaacatgatggaaagactcttgtctttttctgctttccacggcactatgtgccactggatttaggagaatgtttcatgttcctgttctcttttttatttctttgttgtttttttttgaaatgatacatgtgttgatgaagactctcttttaggtatatttttgcatctaatttgtatgaatctgaatgcatgaatgagacagagtggacaatttatcaagactggcatgactggatgaataaccaatttggccaaagccttgaattggatggaatcatttatcttcaagccactccagaggtaaaacccaataaaaatgtgtttcactgaaaatttaaagaaatatttagaactcttttcagtggtatataatgagggcaatttagtttaactccagcctcccaacctcccactccccacctctaaattagaaacttgtaactgtgtagatagaagcattcttttttctcagcaaactggaatcccagactgggcaagttgctgttttaggctctttgtgcttcctcaattcttttttattttactcattatttctttctaacatttgcagactcttctcattcatcacagttaaagtaatgaatgtggtcaagcaactcctagaatataggcttcatgaggtgggaccttgggcattttgattactattgaatttccattgcctagaacacccagtgctgggcactgttggagcatatagtaggagctcagtaaatatttactgaatgaatggcaatgttgatggaggtccatatcaagaaatattttat

SEQ ID NO: 111697 - DNA, 1004 bp, Homo sapiens
agaaaaaaattaaataaataaaaataaaataaggatttttttttatcctttagtgcctctatctgtaggataggtaaaattataataacaaaaattctttctcaccccctttttctctgctttgtccccatttcttcctctcttccctacaccaccaatctttagatactttaataataaactgcttgtgaaattaaatttatctttttcaactaaattcaatatggaggatatttaaagttacaggatatggatctcatctatttttatgttggccaaagtcttgagattaagggattttagttttgagtttcatttgggatcatgtcaaggattaattgacattacttaatcattgagtcattgtcttaatcacagttcatttattgcccaaatcactgggagttgactatattctgttaagtgagtggtgcccatattgataaagggaatgggtgagaatttattgatgaatatttgagagagaatagtaagggaattggtataacaaatatccctatacccatgttgataactgagtgattaagctataaagaagaaagcacaatttggtttagttttgagaaaaatttgatttttcctttcttttgtggcataatgtctgctgtttaatagagacttgacattcataagggatatatcaaggattttgaaaatcttgacattttatgtaactactgtagcgtatacatgtagttgtttttcccatggtatgaactaaagcttatctggaaaattccaatgacctcttcatactactaatgatgttaaaaatataggataaattcacttacaatactattaaatgaaaagtcagcattaagtattaacagccaaccatcaatttaactgactttgtaaatcactttttaattttatctaacacttctttgttttgactaagaatcatttcacattattatatttacttttattaataatgctagcagttgactttcttattaaggtatttttacaaggca

SEQ ID NO: 111698 - DNA, 1078 bp, Homo sapiens
ttgaccagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacttttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaattt

SEQ ID NO: 111699 - DNA, 1017 bp, Homo sapiens
tgaaattaatctggttaagaagggctgttgggtgggacaagtcagcaatttggaggcagtgttgtgcagaaaggaaaaatatttggcatacttgtgtttttgatggcaatgggttggctcaacaatgttgtgttttgtgtggtacaaataattgttgtttattcctctgtgatgctgatgaatacaagaggactgtgtcatagtgcttctgcttctttagccagttaactgcataagtctcttagagagccttgagtttctgaaatgcagctctcttgaagtcaccttgaagtgcccttcaaatggcagattttacactattcatttcttgttgccactggctattctattctaatagttattccatgttatcatgccatgagatgttatgagtagtgtgtttacacgtgtcatgggagagttgatgttgttgctatttatagtgacttatgagttcaggagacctcaaagggttctagtgtactccacgtgctggggtgctcagggctaaaaagagattgtgacttagggtggaaaatggggggaaaccagaatactgtgcagaatttcagtgtgaaatttactttagtgaagtaaatggggtataaatgactgtctgccacaggcattaccacctaagcggaaggcaggtcacatcctgtggtttgggattcaaatttacaaggcaggaagcttgaatgtgtatttgtgagtttgtgtgagtgtgtgtgatttgaatgcactgaaaaaaagaaaggtattggcaagggtcttcttgaaatagtattctgtttaggaattttttcatatagaaggaaataattcttaaagaacaagggttcttaataccagggatttaaattcagggctttatgagtgtgaactcataaatgcagaagtagttggggtgagggaccacgggcctactctataaataaattctgcggaattcttccatgaccacaatctggaggcaggaatgttaggctcttttaataactttcccatggataggag

SEQ ID NO: 111700 - DNA, 1064 bp, Homo sapiens
aatccccaacatatactgagggatgacttgttctttctctttctgtcttttaagtgggtgagtttgaagattcttcttttcacactttgctgatttttttcaagaagccatattcatgatggtgttcctctttaactgacagcacttgtagtagtcatagaggtttataggccttggtgaattctagaaagtacgggaagggtgtacattccattccattctcccgtcccttcccctccccttccgtcccctcccctccgttcccctcccctcccctccccctctccctccctcccttccttccttccttccttcctccctggtagtgtcttcatcatctcagatctgaattgctagaaaagctgttggaattgatcccttgtccccattttttctcaattcaatatactttttacatagttgccctcatttttctactctagattaaaaatggttagtggcttcccatcattttaagttcaggacttcttgatgacctttatgatgctctgaaatctgatgttatccgtcttgtcttcatttattcatttgtgttccccagaagagggactctgtttaggtcaggactaatttctttacttacctcccactttacattgagataaattcttgactccttcagttgctccttcagatgctaatgtggattgtcaccttcctttcatctttctacctcttgaaatgatcaggaagaagagcatttaaatatgggtacattggtagatacatacctgtagtggaaaagggagaactcaggccactagaagttttcttaaatttatttcgcacattttgtctccactcattgcttaccaagccatgctgattatttgcaaggtttgccatgagtcttaatactggttaaggcagtgtactaattagcttaggaatatcttgttgatggagttcttgaggaagccttcttttattaagggcagctctccttttgccaggaatttggcaagaagcagctggtaaatgctgacagataaatttactaacttattgggtcttttcatatctgggcatatgcagaagaaatc

SEQ ID NO: 111701 - DNA, 1089 bp, Homo sapiens
acattgaagaatatttttcttcctagattttgttgtttaaattatggggcctaacctgccacttattttttgtcaatttttaaaacttttttttaattactgtaaagaaaatgaattttttcctgcagcaggaaacatagttttgagtagttctacctcttatttgtagctgccaggctttctgtaaaaattgtattgtatataatgtgatttttacacatacatacacacacaaatacacaatctctagggtaagccagaaggcaagatcagattaaaaacaccatgtttctaagcatccatttttccctttctttaaaagaaacttaactgttctatgaaggagattgagggagaagagacaaactcctatgtcatgagaataaccgatgttctgataatagtagcatctaggtacagatgctggttgtattaccacgtcaatgtcctatgcagtattgttagacattttctcattttgaaatatttgtgtgtttgtgtatgtgctctgtgccatggctggtgtatatatgtgcaatgttagaaggcaaaagagtgatggtaggcagagggcaaagtcattgaatctcttatgccagttttcataaaacccaaaccacatatgaaaaaatccattaagggtccaagaagtctgtccatatgaaaatgagggtaaatatagtttatttcccaggtatcagtcattataattgatataatagctctaacatgcaatataaaattcataggagtattaatagcccatttacacatctataaaatgtaatgggattgcagagctgcagagtacagtgtaacagtactctcatgcaatttttttcaggatgcaaaggcaattattctttgtaagcgggacatttagaatatatttgtgtacatattatatgtatgtatatttcaaagtaccacactgaaaattagacatttattaaccaaatttaacgtggtatttaaaggtaatatttttaatatgatacattacatattgtgaatgtatactaaaaaaacattttaaatgttaaaattataatttcagattcatataaccacaactgtgatatatcctaa

SEQ ID NO: 111702 - DNA, 1186 bp, Homo sapiens
ccgggttcaaacgattcttctgcctcagcctcctgagtagctgggattgcaggcatgtgccaccacgcctggctaattttgtattttcagtagagacggggtttctccatgttggtcaggttggtcttgaactcctaacctcaggtaatccacccgctttggcctcccaaagtgctgggattacaggtgtgcgccaccgtgcccagccatgacgtcttaacgttttatcgcccaggctgtctctccatttatttacagagcttaatatttatacagttatgctttttgatccatttagatttatctctaccatcatatattgtgatttttattttttctcttttatatttttgattgtttctgatctttttctaaatttatttccatgctcattttatttttctaataatttgtatgttaaacactttaaaaagtgtcttttgatggtgtctcatcctagtcccaaagaacatgaagtataaagatcttagaatatttggttctagtcatccctttcctagagtgcatgctgctcccccttctgccccccatttttaaatttttatcttaaaaatttaatcccatatattagatgatatcattactgtttaaaccataatttttgagaagagttttaccaataccttctttctctttgacctccattcctttctcatcttttctttccctctgagatcttttgtgcattgtaatttgggtttgtgagcttattcttgaaactctatcagagttttcagaggactgacttggaattttttctccagactggacttgtatttgcttctgccagtattcagatttaaagcaaacagaattccagcttaaattaaaatactcagtttttacactaaaagtcataaaaacaacatgaacttagtttccaaagttgtgtgagcttgttgtggggtcatattctcaaaagaaacacatttcctttctactcagaggcaatgccaagacagacaggttttcttgaaagttgcctctctgtattgtagtttgtctgactctttttataagcgggaaatattttgaagataccctggttatgtgaggcttccaatcttattcttaccccattacaagcaaggtattgtgtcatatcttcttgcatgtttgtgatcattaaaaaaaaaaaagccccctatcctacctgagccaataa

SEQ ID NO: 111703 - DNA, 1183 bp, Homo sapiens
aattttaaatgcatctccacctggaagaaaaaagagcagtaagaaagcccttcaactagatggttcttgtataacaacttcagctttagtgtatgcgtgattttaataattaccttttgtcatttttctaagtggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgtgagtatatccttgtaactcttgttatttttggagagaccagaaaatacttcaatattatgttattagtattctgttttataaagtgcatgtaaaacacagggcaggaaaataaattgttcacagttcataaaccagtctgtgtttttgatacatctccatttattaatcttgtgacaagcagtcagtgatgaagaagatcaaacgaagattgaatatttttaaagaagttgctgttcaggaatattaagaagctgaacaaggaaagtaggtcactgtgccctaagggcgtgggcatgggcactgcgagattgactgccagaaacaagagagtgtccaggaaagagcggtaccaagcatacagactctctctcttcagggagtggaatgtgattgcttcagaggaaggcaaaagaaagattgtgatagaaggccaggtgactgttgggggaaagttatctattcattcactcagactacaattactgaattccctattgtgtgctcagcaatctttacgaagaaaaaaacaactgaattctcacatttagaggattctgccttgtctagggtttaatatgtgagcagctttttctctctgtttctggcagcaggatgtctctgagcacgtcttttgtaagactatctgatgccacatacctgccttcccagtaagagatgatggtggtattagaagtaacaaagacaataaaaattaaaagatcagctaaagttcattatgagccagagttgttaggagtgctttaaataatgtcaactcatttaatcttcacagttttcctcaaaggaagatacattattatttgcattttacatatgagggaaccgagccatggagcgatgaccaaagtttctttgagctgcatctgtgtgttttatacatg

SEQ ID NO: 111704 - DNA, 1107 bp, Homo sapiens
tatacccctgcctatctcataagaatgtttactctgtcatcattaaggagtttgctttaggcagtctacttttttgggggaaggtggctgaacttgtatgacatcattcagcattttacatttttaatttaatccctaggccctaggcttctcccctcaaattacccactattcattcaccagaagctttgtgttaaagtaatttttgtaattacatcctaccagtgggaaacaaggaatagtgagcctttatctcctagcttcctttcaggattttcattttcctgcatgaacccgagtgcttgtgttgctggtgtggttgtcatggtgctgtgaaggcgtgtttttgtcccaggtgggaaacatgtagaagtcagaaatgatttgggagttgctgctggttgccagggaatgaaactatgaaacaagaactagaaaaacgagaagattatttcttattttattgctcctagggacttcctaggcccagagcccttccttgaatctgtagacatgtcagtatatactctaacctgctgtatttggaagttctcatgacctatgccctaatcaaagagaatcattggtgggctttgtaacccacacaaatattgaacaatagaaattaatttcagcagacattttttagtaaatgaagtatggaacataatattactaaattactaagatcaagtagcaatcattattttgggtaagtgttaaattacaaaatttttacacctgcatcatcttatttagcagccaatcatttgtcaaggctattactattgaattcatgtggaaatactaatcatatttatggaatctgttgtctggttagttttgtatgtttcacagttggggtatttataacaattattgacaaaatgaaggcaatatgaagattgacttattacataaaataggaatcagagtgaaggttaaagagctttcatatgtgaaacataaaggataatactttatttttttcattaaattgccttactgagtttcttctgtctctgtatgaataggttcaatgaaaagagcttatttaggagatagatagaccaggattaaagtgttacaaatgtaactctatatttt

SEQ ID NO: 111705 - DNA, 1038 bp, Homo sapiens
gttaataattttatgggctatgttttgataaaatatttttaatatttaacataatatgtactaaaagactctccttgatgtctcttcagttataccatttccataaaaatgtaagcaatagataggaaaatgttttacaagttctccaaaagagtatgtttatagttacattctgtagaacagaagtagtgacatattaaaatagaaaataatgtgctaattctactgcatactgaggccttgcttatcctgcatttttgatcacgatataaaatatattctggattttgtggtagtgtctgtatatgcatttccagaatagagatttctgtaaccttaagtgatagaataaagtacatttgcatttgttcttaagataaaatacttccaacagctttatccttccttccatcataaatttgtggattatataggaaaaaaatattctattaattagtggatatattaaacatctgataacttccctttacacaagcagagtgtgctttagattaaagcctctggcagcttccaaaggggggacctggaatgacacctggaagaaatattggatgttagaattgttattgtgcaaagtgggtgagagagaagaagttcctttaaattttgaacttcaaaaatatggtatcaaaatggaggatttttcttgatgtgcggctgaatgtttatttttataagtcagttttaagtgtatttgagttgaaatatacagaattataattatcatcttcagaaagcaaacaggagacaggtgtacaaaaggacaaaagtccatgtaaagtgaggaggccattggattaccactctcttatatcccagccgttcaaagagccttccttactatgtttactatcttccctcctagatatttcaatggaattaaaatgaatagggacagtataatcgatggcttctgacactaagctgtattggtcctggtgggctggaaaatctaagctccatagtggtcataggattgatgatactaggagtggcagacacttttatatacctatg

SEQ ID NO: 111706 - DNA, 1079 bp, Homo sapiens
atgtcaagcctttttcattttttaaaaatctgtatttctcttttgtgactaattattttatacaaagaatatccaaggatgtgatcttggaataaagtagaaaacaaacaaacaaacaaaaaaaagagttttcaaatttaaataatatttttaataatagttatttgtagttaaattaaaccattcatgtttatttattattataagtaccacctggtcacagtttgctttttatatacatcaatttgattatagtttttcccaagtatctcttctttgatataataatttttaaaaattaaatttaaagatggttaaaaattagggaaaattgcacatttctttttggatagacctggacaaacagaaaataatagaggcatgggaagtactttttctttctattgttggcctgaaaagtaatgctttctattctttttaatgccatgaaaaccatgatgtcattataactagtgtaagtttttgaagataataaagaaatgctttaagaactgtgaaaatattgcttgagcacatctgaaatattttcttctggttaaattataattaaaacaagaacaaaagcacagcacagaattgatatgatgcctttgtagtaatcatgccctgaggtcacagcctccttgaaaactaaactcagcctcaaggtttgacttaataatcttcaattctaggaatcctgatccaagttaaagcattttgaagcactagtattaagttgttgcactgattgctgtggtaagtactgagattggtcaagtgtaactcttgtcttcaaagagtactggaaataaattaagttgtatgatttaacactattagaaatatagagagattggtcataaatacaatttaaaagggagactttactgttgtcactctataacaataaaattgcaaagaaaaaaaggggttgaaaaatcaatttggctttttattaaggtaggctgaattctctgcctctaaaacaagacattttaaacactttgttttcaaaacagttgattaatttttgagcaatactagactactactaaatgtatcaagagattattatt

SEQ ID NO: 111707 - DNA, 1004 bp, Homo sapiens
ggagcaagaataaaatgtatcagaaagtataaaacagaaaatggttatggaaatttactacctctatcttcaatgtgatatgtaagttaaatgccgaaaatgcatttgccttgatgcacaatggattggtgagcttaaagcaagactaaagaatattgagaaattttataccaagcattttatcacctaacaagagaggccaaagagacttctaattatttcacaaaattatagaaatgttatataaggtggtagagaaaggaagcatggaagaagacacaagacaccagatgttgctcatcaagtgttgccggtgagcattgacagcagagggaacattagccagcctctggctgcacactggactagtgcagattatctgggtggcaaaaggaacagctgaggctcttttaaaattactagctagtgttgtacaaaaggagagaaggttagcactccccttgacaaggatggaagaggcccttgggcctgacaacatgcatatggttaaggcattgccacctacttcgtggcatccaaccatcgtttttatggaacagaacagagccctccgaaataataccacacatctacaaccatccgatctttgacaaacctgacaaaaacaagaaatggggaaaggattccctatttaataaatggtgctgggaaaactggctagccatatgtagaaagctaaaactggatcccttcctcacactttacacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaacgggatttaattaaactaaagagcttctgcacagcaaaagaaactaccatcagagtgaacaggcaacctacagaatgggaaaaaagttttgcaatctactcatctgacaaagggct

SEQ ID NO: 111708 - DNA, 1110 bp, Homo sapiens
gtaagtataggagtatttcaggaggttgtagaacttcgtattgacctaaataaatggtcacccggggccacagaccagtactggtccatagccgattaggagccggctgacagcaggaggtgagtggtgggcaagtgagccttaccacctgagctccacctcctgtcagattagcagcattagattctcatagcacgaaccctattgtgaactgcacaggtgagggatctagggtgtacactccttatgaggatctcattcctcatgatacgaggaatggaacagtttcatcccaaaatcttcctcctgtccatggaaaaattggcccctagtgtcaaaaatgttggggaccactgctcaagatggtaatacaaaagaaatttggagataatgctgaggctgtttgtctcagaagaaggcaaagaaaatgcattccttactacactgagaaactggctgttgggaaacatttggaagatagatgactgtatggggaaaattaggtgtagggaggctaagtttgccatcataagtgccacacttccagcattctaccttcagtatgtaagcagttggacaggacttttggtggggaaaaagttatgttccattgtcgaagaagggagataagatctctcttgagcctctgcctaggagcttctctctttttactttctaccctaaatacttctctttttcctttatttttgctttttggtctgtctgtaaccttttttccctgtctattaaatctatcccaggaatctagtagctgctgcaagtcttgcttagtcttggcatacttgtatttacaaagattgtcattttattttttattgtctggactgtgatgtccttgtagaattacagatgctaacatttatgtcttctctttatagtcaattgttctctactggttatgctccagcttcgtgggcctttcacagaatttgctgctgcgttctcctggatttcgccaactttgccgaataccatcgaccaagtcagattcagaaactccttataaagacatatttgctgcctttaataccaagttcatttcaagaaaatgacatattttccaataattttgaaacagttgcaggagtc

SEQ ID NO: 111709 - DNA, 1028 bp, Homo sapiens
tcagatggacagccaggaaagtgggctttccacacagatgatataatacagtacttccaaaggcatgcctatgcggaagtctgatttgttggatgaactaaagtcattcagaccagaatatgcaggtgtctagaggagtaacgagataaaattggaagaataggcaaatgtgaaattatggaggacctagaatgtctttgtgtactgtcttattatacactataatttgactaaattcagaaaaactattgaatgcctcctctgtacaaaatatatgatacaggagatttaaagatgaataaaatagaacactgtcccctaaactaagaatactttagtttttgttttttaactcctattctcttggacctgaaggaagactgtattctaaaaagtaaaatttcaggaaaaaacagtagtaactaatatggttaacagagaaacagattaaaaatatctttgtgagatagttgattgaaaaatggagactattttgacaggccaagagcatacacagtataaaaccacatagctccaaaaggtatattcagggatgaagtggttaagtttggcgggagtggagagatttgattaaagtttgcttttagcttccatatttccaatattaattgtagttataccatgtcagtagtgaaatttacctttaaagcctaatcagccaaagaccaccagagacaaagcctgtagtctgacaatttcagattgttatgtaacttgtgtaccatactgtagaagttttgataaaaggctttatttgcctgttgtttaggcaactccttaacatgcctgtgacagctgaaacccttatacaaatcctttagctaataactacagcaggcgctatttgtgctatggaaataaagcacgattcttagatgacattttctctttccccttttttccccctaacctcaatctaggctcacttatctaaagaatatgaggaggctaatttcagagctatatgtgcgagataactgccaccctttcaaagccactgtgttggt

SEQ ID NO: 111710 - DNA, 1045 bp, Homo sapiens
aagcctgagtaaagagtaaaaagatgacttctcaaacatatccagaaatttgtaaacagtacactcatatcttttagtttaagaagtggtcttaaaatatataaatttgtttttccacctatgtttaatatgcccaaatttaaagggagagctaaaagacagcctacaaataaatatagctatgaaataaaattatagcactttactaaaaaagggatgtaataatgttatttaacgaagtattttatatatgacttgccactattctatacataaaattttttttcttaattctttcctgtgttaactagggttattttctatttaaggtaatcctgctggagaacagatgctatccaatatttattacaacacatgagttgtgttgtttcacaatactgaatttcttaggtgaggtattttatttaaaaaggagggggaaaactcctatattttcttgacttcaaacctgtggggccaggggatatagattgaaatgctccgtatttagtcttggggatcaggcttgtttagtacaataccatggttttagaagtctgtactaggaacatttttaaaatacattttttatatttcagatgtaatgcagtgcacttttatttgaacaataaaaaaacccataactttttgagaccatgaaggtcttttattttttaattttgaaaatatgtggtatgtgtatatgcagactacatcattgttttaagaaatgatttaactcttggacattacacttgggttagttcacaccttaaatccccaagtagttaatatctcaattattgtataatcagtttataccatccattcccaacaaaattccacatttcatgccttttcaacatacatttcaacataatcaacatatttacaaacactgacttcactgtttataaagaagaaatttcccctcctatttcccattactgaaaagtcaagtcatttttattgatacatgaaaattaatttttttgtaaatgactacgtatagtcatttttctcctttggaaaaggtaaatagctt

SEQ ID NO: 111711 - DNA, 1254 bp, Homo sapiens
ctaaaggttatttattaaaggtactataaataactctgagaattcacataaatggttgtatattttagtttagtgtatgtttaatatctttgatttatttttcttccacaaccgtgaatctataaatgctcaggtaatgattttttttttaaaggttgtaaatcagattctgtttgagggataagaggtaggaaaataatagaaaaaaggtttttatcatttttttccattagttcctagtatattgcaaattgaagagtacctccttagttttttaaaagttttattttaataaaatatatgctagatatatattttgtaaaatgcatgctctatattcataggtgtggactggaccctgggcacctcacatgaacagtgtgcatatgaaccagcttggctgatgaggatcagcttgttagcctgcagattccttttcatttggaggaaatcacaagtggccgaaaaaaaaaattatgctcccaaatcattctactgatgtgcttgactgaagtgtgtaggctttttgcagaagatcttactaactgacctattttctgtgaacatttgtgactgcccattccccatcatcatccgttttaccttagttagcatttttcttatcatttttctttttttctttccctcttcccctttggacataactttctgttgaagctgttctttggctggttggttttagtactgtaaactgcttctgagcaaacacggaaatttagcaaaattatgtaaacttgatcctgaagttttagaatggcaaataaatgtacaattgtttacataacagaaaaggctaagcagaaagtaaatttcaatatgtcagtatagaggctctactttatgtagacttaaattaatgtgagatatgtaccttcatattcagaaatctggatgtttccttcatacattaaactattaataagcataacttttctactggtgtaatttaagtataaagtaaaataatgggcattatcattggatgtttccccacattggcttttaaaatacccatcttgctttctttttggtttatttgtagcaaggcacatatagaagaagaaatttctggcttttccatgttgttttattaccttttctcacttttaaaactaatacagacttatctcctcactcctttttctctccttacctttaccactaataccagtaaaattatctttctgatagtgaaaaggttctgtcaagattttcactgtaatggctgctaca

SEQ ID NO: 111712 - DNA, 1049 bp, Homo sapiens
acagcctcccaagtagctgggattacaggcatgcgccaccatgcccagctaattttttttttttgagacggagtctcgctctgtaacccaggccggactgcagcggcacaatctctgctcactgcaagctccgcctcccgggttcatgccattctcctgcctcatcctcccaagtagctgagactacaggcgcccgccaccacgcccggctaatttttgtatttttagtagagacggggtttcaccgtgttagccaggatggtcacgatctcctgaccttgtgatccgcccgcctcggtctcccaaagtgctgggattacaggcgtgagccactgtgccccgcctgtatttttagtagagacagggtttcaccatgttgatcaggctggtatcaaactcctgacttcaagtgactcacccacctcagcctcccaaagtgctggcattacaggcatgagccaccacgcccagcctcgtagtcatttctaaaagatctgtattcctattttttttgttatgtgaatatttaatcacttctttatgagctctgtccccatgtgacctttctcattacatgtatttattactgctttcagaaaatatctaatgcaagcatgttcttttcttcctttcatcatattaaggacataataatatttcctttcagtccctttaggttgtacttaggtttttttcttttgttttataacaccaagtttttagattatttcattaagctattatgtcactacttacaaaccatggaaatattgctgtaaatatataaaagtaggtcattatattgaaataatttacggttcaatgtggaaaatattagaaaaacaaaatatttgattttgattttaaatattatctatttttgttttgcctctttgtttgccctcagacaaagtagactggtgtaaccctgggatgggaaatcctatgatccacagaccgatgtctgacccaggagtattttcacaacatcaagcaatggagcgagatagtacaggaattgtaactccttctggtacattccatcagca

SEQ ID NO: 111713 - DNA, 4494 bp, Homo sapiens
atacatgtatatattatacgtatatacatatatatgtctatatatacatatatgtatatataatacatttgtgtgtgtgtacacacatactattgcaacactcatgacatggtggtgttttcataattagcgtgtagatagtcaatatatgtgggcagaaacccatgtctgtcttatttaccgttagtatttgcattagcacagcacgtgtctacatagtatgtgctttaccgatacaagtgaagaatgataatcaacaaagcaaacaatctttgatagtgagatgagaagctataataaagcttatctgtctgttgctcctgattgccttttctctgttcatctagagtaagagtaaatagaagaggcttattcaacaatattctgtatttatagaaagacattttagtaatactctttcctcttttaaaaattacaataactattgttaatgactaatcttaatttatatatacaacttttaaacaggtcaaagaaagtatctgttccatcaactgtgatatccagagtgattggaagaggaggctgtaatatcaatgctattcgggagtttactggtgcacacatagatattgataaacagaaagacaagactggagaccggataatcactataaggcaaaactttgtctcttacattttcttcctttattttattgcactatagcttaatgaaatacagccatatgagttttcagtggaactttgtgttacatagtatactttttaaaatgggaattttattagtgtttgagaagataaattttatagttttcttttttcctaggtaatacacttttgtgaagtgtttcagagacttttataggaatttgtatgcatgtgtagcaaaggtttaaataaataatttctgtacataaactgtttatatgacattcttaaaaatttgttctgagacttttagggagcgcatttctaacattttaagcagtgggtttttgtctttctcaaataacctttgagatttgttattctgagattgtgtctttagaatttgagttcttgggctgggcacggtggctcacgcctgtaatcccagcactttgggaggctgaggcgggcggatcacctgaggtcaggagttcgagaccagcctcaacatggggaaaccccgtctctactaaaaatacaaaattagccgggcatagtggtgcatgcttgtaatctcagctactcgggaggctgaggcaggagaattgcttgaacctgggaggcagaggttgcggtgagccgagatcgagccattggactccagcctgggcaacaagagtgaaactccctcaaaaaaaaaaaaaaaaaaaagaatttgagttcagatttgaatctgaagtgaagatataacttatcttgaataactcgtcgaatatgtctatgcctgaatattcttaaaataaaagtgatgttctaagaaatcataagaatgtaggaagctatatttaattactttaaagtaaattcatgttcctttgaaaaagagttttatattttttacatggcagatataagtttgtatgaggcagatgcccctttgcattatataggagagctaatagttacatcatacctcaaaaataagaaagcaagtagccatctctattttattcatcgtcctctccttctgactggttttcccctgggtatttgggtagtcacagcctatcttatctagaaaagagggaaccagataccctttattggtaattgctcccttgagtttccataaatatcaaatattttcctgaagatccagcactaaggttttatatggctatttttggcactatcaggattcctgcatcattttaagacatcttcccagaggagttacaataattatcctattaatagacaaactactaatgaatttttagtagacggagtcatcccagataccaagatttaaaataaaatactgttttcttactcagttgtattattttccttgtttacttctattatttttagtgttgattaactgtttcaatatttttaggattaaatgtttcaataacattgtggattacataggcttttatgtgcagtggtttttctaactgtagtgtattttacagtaggaaaatggtttcttagtctaaggaaacaatagtgaaatgtatttttgaaaaataagtcatttactattcttctgaaaaataaaagtagtaattcaggacagtttattgctttgtttgtagaatacctcaggaatggtaagaaaattgctgcccagcttttgttatctgtcctttgtttgtatgtgtgtatgtatatacacacaaaactgtgtgtgtgtttgtgtacataaatacatattaaaaacactttacatactcaaaagtagggaaaattctacctaatttttttttctcaatttataggggtggcactgaatcaacaagacaagcaactcaattgattaatgctttgatcaaggatccagacaaagaaattgatgaacttattccaaagaatcgtttgaaaagctcctcagcaaattccaaaatagggtcatcagcacctaccaccactgctgctaacacttccttaatgggaattaaaatgacaactgtagctctgtcatcaacatctcaaactgccacagcactcactgtgcctgcaatttcttctgcatccactcacaaaaccattaagaacccagtgaataatgtgaggcctggttttccagtttctcttccattagcatatcctcctccacagtttgcacatgctttgcttgctgctcagactttccagcagatccgtccaccaaggttgcccatgacccactttggaggtacttttccaccagctcaatccacttggggtccgtttcctgtcaggcctttgagccctgccagagctactaactcgcctaagcctcacatggtgcctcgccatagcaatcagaatagcagtggttctcaggtgaattcagcaggttctttaacttcaagcccaacaactacaaccagttcatcagcttcaacggtgcctggtacatctacaaatggcagtccaagttcaccttctgtccgaaggcagctttttgtcacagttgtgaagacatccaatgccaccacaacaacagtcacaaccacggcaagcaacaacaacactgcacccacaaatgccacatatcctatgcctactgccaaagaacactatccagtatcatccccatcttccccatcaccaccagcccagccaggaggggtttctagaaacagccctttggattgtggatcagcatctccaaataaagtggcatcttcctccgaacaggaagcaggtagtccaccagtagtagaaacaacaaacactagacctccaaacagcagcagttcttctgggagttcatcagctcattctaatcagcaacaacctccgggatctgtttctcaggaaccaagaccacctcttcagcagtctcaggttcctcccccggaagttagaatgactgttcctcctttagcaacaagttctgctccagtggcggtgccttctactgccccagtgacttaccctatgcctcagacaccaatgggatgcccccagcctactcctaaaatggaaacccctgctattagaccaccccctcatggcacaactgcccctcacaagaattcagcttcagtgcaaaattcatctgttgcagtcctcagtgtcaatcacattaaaagacctcacagtgttccctcttctgtccagctaccttcgaccttaagtacacaaagtgcttgtcagaattcagtacatccagcaaataagcctattgctcccaatttcagtgcccccttaccatttgggccctttagcacattgtttgaaaacagccctacttctgctcatgccttctggggaggatctgttgtttcatctcagtcaacaccagaatctatgctatcaggaaaatcctcatatttgccaaattcagatcctttacatcagtctgatacttccaaagctccaggttttagaccaccattacagagacctgctccaagtccctcaggtgagtttatattttctgagattctgcagctgttcatttgcacaagtgatgtgaaaattcttggtcattttctaatatttttattctctggacgatatagacaaagattgttggatttagttaactcagatgctgttgtttgtgtttagtatggtgttatttttaaaaatctttttaaaagctaccatagatttttatttaattttccataaataagtcttctgatcaggcggggtttttttgtttgtttgctttttgagacagagtctcgctctgtcacccaggctggagtgcagtggcatgatctcagctcaccgcaacctctgcctcccagattcaagtgattctcctgcctcagcctcccgagtagctgggattacagacgtgcaccaccatgcctggctgatttttgtatttttagtagagatggggtttcaccatgt

SEQ ID NO: 111714 - DNA, 1040 bp, Homo sapiens
tttatcttctcaaacactaataaaattcccattttaaaaagtatactatgtaacacaaagttccactgaaaactcatatggctgtatttcattaagctatagtgcaataaaataaaggaagaaaatgtaagagacaaagttttgccttatagtgattatccggtctccagtcttgtctttctgtttatcaatatctatgtgtgcaccagtaaactcccgaatagcattgatattacagcctcctcttccaatcactctggatatcacagttgatggaacagatactttctttgacctgtttaaaagttgtatatataaattaagattagtcattaacaatagttattgtaatttttaaaagaggaaagagtattactaaaatgtctttctataaatacagaatattgttgaataagcctcttctatttactcttactctagatgaacagagaaaaggcaatcaggagcaacagacagataagctttattatagcttctcatctcactatcaaagattgtttgctttgttgattatcattcttcacttgtatcggtaaagcacatactatgtagacacgtgctgtgctaatgcaaatactaacggtaaataagacagacatgggtttctgcccacatatattgactatctacacgctaattatgaaaacaccaccatgtcatgagtgttgcaatagtatgtgtgtacacacacacaaatgtattatatatacatatatgtatatatagacatatatatgtatatacgtataatatatacatgtatatatgtgtatatatatatattatatgtgtgtgtgtatatatactggttgggcatctaatctagcctcaagagtcaagaaagacttcttgtgggccccttttggtgctttactcatatgcttctttttattctctaatatacataactcaaagagtgatgttaaaaattcatgactgggagtggtggctcatgcctgtaatcccagcactttgggaggccaaggcaggcagatcactttatgtcaggagttcgagac

SEQ ID NO: 111715 - DNA, 1021 bp, Homo sapiens
gagctcaaggctgcagtgagctgtgattgcactgttgcgctccagcctgggtaacagagcaagacctgtctcaaaaagaaaaaaaaaaaaaggctctctatattatatgctaaatatgaggagaagtgaaaaataaggtcgtcatttgttatttaaaaataaatttttaaaaattgggtagtagactacctttatcatttaaaaattctacatctgttccatatttaatgtactttccctctctttgttaaagattgtcagaaactatcagtgaagggaccagtaattctctatctacttgtacaaaatctggtccatctcccctttcttctccaaatgggaagttaacagtagcaagtcctaagcgtgggcaaaagagggaagaaggatggaaagaagttgtaagaaggtgagtaattgtttttgtcattctttttatgtgctatatatcacagtcaagtgttatctaccttataattaaattcctcctactcttctaaaggttgcaaacaaactgatggttcaaggctaaatttgaccaacagagagagcctgtgccatattttagatgaaaaaaattacgtgttaatttggcccctcaaaagtattggagtttgctttgagaactattttagattgtgtctttctcagcttcgttatctcaaagccttatataatacaaagaagtattataaaagctacttgtaaacatttgatgaattagtaggtattgatgttaaactgttgatctaatcatagtaactgttgtctttaaatcataagataactttattttaagggtttcaggataaaaatattttgttttgcatgggattttaaaaataatatgtatccaagagtaaaaatacaatatctcagaaacgtaaaaggaggtaagacacctgaaatccagaaagaatgtgatccattgtcactctttgataacttattttaaagaactttccggaaatttcgtaaaaatttaaacttttggttatctgaaacaaaagctatagtgaac

SEQ ID NO: 111716 - DNA, 1050 bp, Homo sapiens
ggttggccccaaggtctcttaggtgttggcacttcactgggctccttctgactccctaccagtgctgtcccggaactcaccagaggctgcttgcggggcctgccccggccccgcttctcagtgctgtccatttcctgcttggaggccaagggctggctggacttcaagctcgactcactcatcttcccttctctaaggagcaggtggaagattgatggctggaatggccttcctggagccacgccagcaccagaaatgccccccaaaatattttttataactacctgctattctttgaacagaacgtgggtacacagagtatatcagtcctatccagctcattaccgatgaatgtgagaataacttacatggctaatagtagtagagtatctctcctgggtttttcttttcttcaagtgcttatagctaaatacattctgggaacacttagaacttgctaattcagtattgctacttttacagatgagcctgaagtcttgacagaacctccaagtgccacaaccactactaccataggtatatctgcaacctggacaactttggcaggttctcatggtaaaagaaataataccataactacaaccagttcaaagaggaaaaacaggaaaaataaaattactccagaaaacgttcaaattatatttgatgatccactaccaatttcatacagtcagccagagaaggtgaatggagagtccaagagcagcagtaccagcgagagtggggacagtgataacatgaggatttccagctgcagcgatgaaagtagtaacagcaacagcagtcgtaagagtgacaatcattcaccagctgtggtcactaccactgtgagcagcaaaaagcagccatcagttcttgttacatttccaaaggaagagagaaaatctgtttctggcaaggcttcaataaagttagttccaatttttattttcaatatttatagtgtcatcatgaaataccttattactgaatttgttggtaaagaaagtaaatttgcaacttgcaaaataggatttttctttgtgctaa

SEQ ID NO: 111717 - DNA, 1050 bp, Homo sapiens
cccttgttttttcactagagatagacattttatataataagttgttgggataagcagtttgtaatttttgttaggaagctttcaaattactttttctaaaatgtaaatattcatgcccgcagcagtacaggagagaattcagtttctcaaacttgtgctgatatctgatacctttttaaatttcgccaaattaatgatcaaaaaatggtattttgtcggttcaacttacatgtccttaatgattaaaagctatgtatctgtttattatttacccattttaaaattagtcttatattgttaatttgatcttgatattgtaaaaatattgtctctttagagtggtttgaatatgatcttgataaaacaatgaattgaactagatgactttgaattttatgatatcatggtttccttatgattaaatgattatgtgacaacttcttctccagggtaaatttcaacgttatatttctgctttattgatctttaacagttaagggaagaaagtcggaggctggctttggctgcgaaaagagaaaaaagaaaagagaagagaaggaagaaaaaggaagaacaaagaaggaaactagaagaaattgaagccaaaaataaagagaactttgaactccaagctgctcaagaaaaagaaaagcttaaagttgaaggtattttctcttaacaaccatcccatttgttttatattctagttaaaattatatttacttgattatcagtcactcttgaaaatatgctttcaagttattaaccccttaacataggccaggcacagtggctcacgcccgtaatcccagcattttatggcaggtcaaggtgagcgagtcacttgagtctaagagttcaagaccagcctgggcaacaaagtgagactgtctatacaaaaaaaggaaaaaaattttttttaattatctggacacagtagcatactcctgtagtcccagctagctactggggattggggggatggggaggtaaggtgggaggatcacttcagcctgggaggttgagactgtcatgagccatgatctggca

SEQ ID NO: 111718 - DNA, 1046 bp, Homo sapiens
gtttgataatccattgatctcttaaatccagctttagtttgttattgggaatatcagattactgttacagggattataattttgagttttgtcatttggagatatgtagataaaattccctgtagatgccaaaatgttgaaaatttttaataaataaatcacaataagctatttcttcctttttctcttattatctctgaccgctgttctttattctacctcttccctagataatctggactaccagtgactctgtatttttgactctctatatttttgtttctcagcaatccaacttattccttctcactggctagctgcctcttctccaagcaagctagcatatcattatcaagttaatctttctaaccactctactatattagagaacctcttcaagaacctttctgtgtctccccagtttctgaaatcatttgaaatccaatcttagtttggtattcacagccaccacaatttagtgcttgtagatcttatctcccattagaatccttaatgtggagaattatcttcttgcttggtcttttccttgttcctatctctcacatcacctttgttctcatctcatagaatgcccatgtctttcttcatttttccaaagttactcattctttagttatagttgaagtctctcctaccaaactcttcatcctatttgagttcacatcgagatctctaatctctagaggtcgtacaagtttgacagtgtttatcattcatttggagaaatacatatttttatatgttattactctaactattagagttgttatttttattagttattactctagtatctaacatgcatatatctttccagatagacttattgacttcagttgagcagtgcttatcttttatactcttatgtatttgttccattatttcttgagtacctaacatgtgcaactgtgggctagagtactatattatatagggtgcaacatagtatatgttgtgtatatatgtctatatacattgtctatatatgtatatacatattgtctatatatgtatatataacatat

SEQ ID NO: 111719 - DNA, 1092 bp, Homo sapiens
gtttgtgtagtataattctgagagcaagacatatttacatctttgaatattgaaaacaatttttatctttacagaatattttcacatgttgatagttgatttttgttactgtgtcatttcattctatttaagacaatgctaggctaggtgtggtgacaatgcctataattccagcactttgagaggttgaggcaggaggattacttgagcccaggagttcgagaccagcctgggtaacataggaagactccatctccacaagaaatttaaaaattagctgagcgtggtggcatgggactgtagtcccagctactctggaggctgaggtaggagaatcatatgacccctggaggtggaggctgcagtgagccatgatctcaccactgcactccagcctgtgtgacagagcaagaccctgtatcaaaaaaaaaaaaaaaaaaaaaaaagacaatgctatctgtgtcattggtttttaggggagctcatattgatgtacgtaacaagaaggggaacactccattgtggctagcagcaaatggtggacacctcgatgtggttcagttactggtgcaagcaggtgcagatgtggatgcagcagataaccgcaagataactcctcttatggcagcatttagaaaggtataagtctttcatcctcatttacctggatgtttttttacttacactaggaagtacatggcttagtgatcactaaagactcattttgtgcttttgcagctgtgatgaaagcaataatatgcaaataattactcttatggcaacattaaatgtagatatatacaggtttttcagaaaagccattaattttaaccttattggacatcagagctaagtaaacttttaaaaagctgttctaagtaatgtgttcaaaatctagttgcagtcttaatcttcacaaagtgtaaatccagttaagatacttaagtaagtacctccagttagttactcttagtgagtgttttcttgtattaccactacagagaaaaatatcacttaaactggttattttgctgggggcgggggttgtgccacgcatggtggctcatgcctgtaatctcagcactttgggag

SEQ ID NO: 111720 - DNA, 1059 bp, Homo sapiens
tcatgcattattgaagggagtgtacatagtacaaccactttaagaatagcctggcaatttcttacaaaaccatacacccagaaattctgccagtaggtgggacctaaaatctaggtagtgaatgtatataaggttttttaatgttatcttagaaaattttcataatcttgtgaaaatataggaccttttataccatgcttttaaaatacttactgattaaaaggtttaaaaatatgttaaatacattcacatgtataatacgaaaaaatcttgtcccatattactctattttaccgctttgtggtgaaataacaaatattaatttccaaagcatgtcacaaaattttcagtccagacctttcatgaacacattgtagcattttagtggatttctacatgggttttacttgagaaggtatctctttgttggcttctaagacctcctgctatcattagaggctgattttatgcagagcatgaaggaagaactttccccttcttttattgtacagtataccagaaaaagaaatttaaaaatacacactttggtaatttgtctctccataagaaaacatatttttttctattttattttcaggtggtggagctattgttagctcgaggggcaaataaagagcacaggaatgtttctgattacacacctctaagtctggctgcttctggtggctatgtgaacatcatcaaaatattactaaatgcaggagctgagattaactctaggcaagttgtattccctttctgtaagccccttatttagtaagactgttatagatatttgtagaacacctattttttagtgccaaatttagtaaatccctttattacaaatttggcattcaaagtgttagagatttttgagatgaactttatttaagtaattaaaacttgatatagagtttgaaaaatattgagtactgtttcttatgatactaaatgtaaacatcttagaagcttttattaagcaagctaatacatgctttaagattgaaagtttatcctaataacttattaatcaccttccagcctaagtcattatgt

SEQ ID NO: 111721 - DNA, 1054 bp, Homo sapiens
tgaaacctaaaaatatttagcatttatttaagtactgatgggccattcacagatcattgtccactatgccatttaatgcctaaacaatcctttgacacaatattcattctcattttataaataagatatagagaagtcaagactggctcaagatcatagctcttacccctgctcttactattaataatatatcctaaaatactaactggcaaataataaatgttaatgaatagtggtttatcttgcatctcagcaaagctatgtccaattttagatatcacattctttccatcactttttgctttcagagcgagtgacaaggttataaaaacaagaaaaaatatagcgttaggctattttataaacagtatagtagaaaactctaatcaaatttctcaagttttctcaatgccattatatttctcaattctttcagagaactcttctgctcccaaaacatccaatatacaacaaaaatgtatgatttttatagtaaaatgactttccaacattttattaatcacttcaaaatacttacctcttctattgacaccaaattaaagtaacaaagtgtttataggcaaaattgttaccctaacatacttcaacaattgttataacctaatctgttatattttaacaaaaatacataattcataaaaattacagtgccctattggctttaatactacttttaaataaagaaaatcaactaatatcttcttgactcaatattgaaaaaatctgttcttatataaagcaagtattttttcaagctaaataatgattgaaaggcaatatgattgaaaggcaaaattttgctttccgggatttatggggatttttactttttctggaatagtagaaataatttatcaaattaagtggttcatttttcactatcttaatatttggcttataatacttttaacctatctattgcccctactatgaattatagaagaaaaaagtgacacaagtagaagaaacaaaacagtagggacaggccaggctccttgtctcttgtgtggagtattctagtaataagtgtatc

SEQ ID NO: 111722 - DNA, 1142 bp, Homo sapiens
atatgcaccaacgtagagtggacataagacacatacacttaacattatattcagcacaatctgctttgccttagggcccctctgtgatatagtggggagagcaggattttgttatcaagatcttcttgggttttttaaagcacatatctaccagttgttagcttatgtggccatcggaaagttatttatcagagcctttatctccttttctctgaaatcagatataatttcttcctataaacctgaaatgaagatcaaatagtataacacagtcagagctgtcactcatttaagtttcatgtccttctccattgttgtagttggtgcatctctcccttgtggccatccctgatctctgcagtcagtagctctgctctctgccagcctcttctgcagagcagcttttgccgtctccctcttcatcactgactagtaggctttttcttttttcttaactcttactgattttgccttttgtcttttgtttttcatttcttataatggaatttggtctgtagagttatttacattctgggagaatatgcttttcctttttataattattatgtacattctacaaatacaatgtgtaaatgtaatcaatgctacatatatagtcccttgcttattatgtttattagtaacagtttttgaatctatgaccttttgcagctattgccattcattttacttaactatcatttattatttcctaagtaatttatcactacaggtagaaaatacaaacatggataagacatgttccttacctcccaggaatttatagtctctgtgggtgataaacatataaggcagattggtgataagtactataatagagatacatatgtgaaagtgagggaaatgcttagagcaacactgttcagttgaaaaatatgatgagattgtaattttaaattctctagtagtcgcattaaaaaatgtgaaaagaaacaaatgggatgaattttaaaatatatttaatttaatttaatatatccaaatattgttttaacatgtcatgcaatcaatacaccacaattgctgagataatttacatttttatttcatactaaaagtcttcaaaacttgggcatgttagacttacagctggagtgatcaaatcattttggttttcctgg

SEQ ID NO: 111723 - DNA, 1127 bp, Homo sapiens
tgttttatttctgatccttgacaaatgctgaagagtttgcattcttcataaggggcttcaactctctgctacacaactagaactcacttgccaagggtgtgccacagactttccaactctccagttttactgaatcaaatttgtctaggtattttcaaaacttttaagatgaataccacatactttgctgctatcaaaatctgttttaggaaaccaataaataatagtttgaaggaattatttgggactatttttattacaccttttgatagcattgctctgacctttgtgtttattttgcttgagtttaagttgagtttattttgcttaagtttggtataaccaaacttatttgtgggttctgtacatacagaaatgaggaattatgtagagattttttaaaaccacaggctttatgtggaacaataattctgacttgaaggttagaactgaataccacaagttaattaaatattttttgtattttattgtgtaaaatatgatcgattctaggagccactaccaatgagaaagaaccagttgttttgttcttgggctataaaaacttgttccagcctcttttttgtcacatgtcctccctatattcctaaactgcttgttgtttttattctgaggccgctgaagtcttttcttgaacttggagtaccttattctagtacatctcaaaactgaaaaaaaaaaaatagatctttatagaattttgctttctttcactttttaataattaacatatattcattattttaaagaagggtagacatcaaatttcacttgtgacgtatcaagactgaaattgttaagtatgtaaaattatattttacctttaatggtataagtattatatgaatatttttctctattcttattggttttgcaatataaagaacagtttaatcacagtgatttaacatgagaaattagagaggccagcaaaaattagttaacagtgatacatatataatatgctaccattaaagcattctgctttaaaatacatgcattctacttgttcatatgaactgcttttaataggttatttattttactgattattctcatttattgaataccttgaagtgctatcccactttttaagcttacatgta

SEQ ID NO: 111724 - DNA, 2445 bp, Homo sapiens
tcaagctttgcctctggcggcaggtcccttgcctccagggtccatcgcaaatcttacagaactgcaaggagtgatagttggacagccagtactgggccaagcacagttggcagggctggggcaaggaattctgacagaaacacaacaagggttaatggtagccagccctgctcagaccctcaatgacacgctggatgacatcatggcaggtgggtttatattgttatgagcaggtatcaaatatgatttgcttaaggcgagtaagaatgtacccaaattttttgccgttacccaacttgagaactatttttggactgactcatgtctagctttagaagtattagttcaatctcagaagttctcagatggatacaggtcaaattaaagattagctcattcagtacaaatgactgaagctttctggcttagcttggtagcttgagaatctaggtttttcagtagtggggttgatgtttgatttttgtttttgttttcatttttttcctttaagttcagaatactgagattgaattttggcattttgcttctgtattcacaccaataaactgggaaattgatagaagttgaagtgcaaaactagtaggacacatcaggaagcttatttatgaacagaaatactttatatcctaatggatcagacttcaaacctgatggatatttaaaaaaaaaaacacttttacaaaattaataaagttcaaaaccaaatagggtttaattatactgtatgtaagtgattttgtcccctgtgaatgttaatgtgtagtctctttctaactgtatcatgagaaggtgtggcccccctgaaagtatcataaatgatatatttttagatgtgtagccagataaattttattcgattataactagtttcattgacaagaagatacactttagaagactgtttttatgcttctagtttttggtacttattttttgtgttttgtaacaaagtaatgggatgaggttttatagggttgtgaaccataagaatgctgtactgagaaggataatttgcttcattaaaaaaagaaaatttgaaaaggaaggaaaacagaaaaatgaaaggaataaacagtggaattttggtgacttccatctgatctcttccccttttttattcattcatctgtacttagaggatgattgactttttctaatttaaaaactgtttcagtagcattaaatatgatgagcttatttttttttaagtttcatcttttaaatggataataggaaactaaactgtatagtgtttagatatttaggtaacgttcagacactaagaatccagctgagatagattttatacttaaaaatatctgtaaagtttgctagtccgcctttaatagcacctcagtagttataacatgtggaatgaaaatttctgctagtcttaagggttaaataaccacattggaaaaatgctagtaataattactagtaagaattgtacgactcttattgatgagtgcaaaatttttctatagatttgaaagtcactactaatcatgactagctgattataataattgagagtaaacttttaaaattattaaatatcctgtgaaagttggagcacagtaaccattaaccctaaatttgatactatgtccatatgaattcagatcataatagtgctctatcatgtgaaactactaaaggatgtatagagttaaatattacgtatccactttaatgaagaataggtattacacagtaatggttgtttaaaaaaattttttttatataatatcagagtttacctgatgtgcttgggcatgcatagttgtcaacaatgatttgctagttgtacagttttgtatgctgatcagaattatcagaagtttgtaaagtatcttttcttttgattcatacatgaaacaaaaacaattctgtgtattctcagtgttctgtataaaaaaattttaagtgcatataactttttaggaaatatgacagatgcttgtcataatacaaaaatattttacttttttattatgctcatttctatggggagagaaacatagccagaaggaggaagagtaggattgaaaacatttggctacttacctgcaactcatccctgacaacaggcatgtgcacattcacacacatgcacatatactcatgcactgacttttgcagcctcaatcttaaatttctgtggtaggatgtatcctttcagttgcttaatgatgatttccacttctttcttaggggtttaaagtatattacagcctcattagtctcatcgtcttcttttcctccctctagcacagtccctgctctttatttcttaggcttcatttattagacttctaccataaaatttgctgaccaaaatcgtctgtctttcctgttcttcacacttgccaaaccagaatcagctccctgtttaacctgtctcaacaccttgcctttgct

SEQ ID NO: 111725 - DNA, 1067 bp, Homo sapiens
atgggaaaaaaaatggtactattctttctatttagtgtttattctctacataaagcccatagagggcagtatagtttatttttattcagtcatcttttctactgaagaacttaaaatacaaataaaacttcatattttacttttaatacagttattacattaggagtaatgggtactttggtatcttttactggtgcatactcaaaccttttcaaattatatcgtgtttgtctgggatttatttactttagaataatccaagatgggagaggagaattaatgtaggatatttgtgaaatgagattggccttgtgtttataatcattaaagctcggtaatgggtatgtggagcctcataatactattttctctactcttcatgatttttaaatttaccataattttaagaaaaaccattctactaatatgattttccatgccttttctgttttaggagcgaatgtgaatagaaccacagctaataatgaccatactgtactgtccctggcttgtgcagggggtcatctggcagtggtggaactacttttggctcatggggcagatcctactcaccgtttgaaagtatgtaactcaaatgtttgtgcagaattgtgaattagtatttctctcttggtcattgttacaacatatcatgtacaagttccattcataatggcattctaagtgtaaattttctcctttttcacttgaagcgttctttaccaaacctatgattttaatgcgtctgggacctgttggctttatcttcctaagtgattctgtaaactaacttatttttcttcactttttttccccttccatattcactcttttaggatggctcaactatgttgatagaagcagcaaaaggtggccatacaagtgttgtttgctatctcttggattatcctaataacttgctttcagcccctccaccagatgtcactcagttaactcccccatcccacgatttaaatagggtaagattttaaaaattaaagcattttatggtatgtcttctttatcctaattctttcacttacagtttctgtttaaattagggtttt

SEQ ID NO: 111726 - DNA, 1136 bp, Homo sapiens
actagagataataggaagtctgtaaagagatggtaatgatgtacttactaaaattcatagagatgggatacactcataagaggaaaataacttggagtggatgaggataatgctcattatattgattgttcggagaaggccatgctagagtaccatacatgcatattcaagtaccgcaattcattgtgtagagagaaggacaaattactcagatgcgtttagatgagggcatcatgatcacgtgactataacttcaaatttaaaattatttccagtgctcactttggcagcacatatactaaaattatttccatagaacatgtttatgatttgagattttttttaaatttaaaagtatatttcttaatttgcttcaaagcattatatttaaatatttagattcagaaatcagtccaattattttccttttgatttccatgaaaaagaatacttgttcactggcaattaaatgtcaagtctttttttttttttttaaacaggaacatgaatctgaaggtggaagaactcctttaatgaaagctgcaagagctggtcatgtttgtactgttcagttcttaattagtaaaggtaggtttgtataaaacagttgtctttttttgaaaggtatctacccctgccttcatttagagatttaagggtaaaggtcttttgaaggcaagagggtatcatatgaggagggatgctactgacatttaatgattgagtggatagttgataaacatcctgccatgcacagaccagcttcaaactagaaataattgtcataccaagtagcacacttgttgtgaaacgtataaaggaaagggaaatttctctgtgtaaaaactgaggatttaggtaacaaactctgctgtgttcatgtactatagcactttcttgaaacctggaattttatgatgtttctgccactaaaaaagtttgtggcaagtaacatttctactatttccctgcttctatgtttccttttttataaaatacagggagctggttataaatatagtacaaaaaatgttcacaatagaaatgtgacaaatatagcaaattgcatgaggattttcattcatgatcagaaattttagtttgaataccaaagaccttaatgaccaaataaaata

SEQ ID NO: 111727 - DNA, 1029 bp, Homo sapiens
ataataataatacctaaataagttgtaaaatgctttgatattgcctgggaaatagagcttattgaatgttaagatttttattatcatcatcatcatcattatcaccagtatctttatcatttttgaatcactataatgagaggatgtagcttatttttttgagttcttttatcacccgacttgtaccttctggctgagtaaatattactccagctgtggtacatcaaatctgggtgtgattttaatagttttatttatttttagttttaactgccttaggagttaggagagaggcactttcttatttattatagtaatataaatgttcattttaaagattcagtttattaagaaacaatcatgtttttcatatctctggaataagttaatgactttctttaaataattagaatctttattttaggagcaaatatcaatgcacagacagaagaaactcaagaaactgccttgactctggcttgctgtggaggctttctggaagtggcagactttctaattaaggcaggagccgatatagaactagggtgttctacccctttaatggaagctgctcaagagggtcatttggagttagttaaatacttattagctgcaggtaggcatttttgcatttgggagaagttttttacatgatttgtttaagtaaaaatgtcataatgcaaatatttttatgatgctatgatacactgaatgtgtgagtttaaaaaaacgtgtgatatacctttgtatgtattctgaacagtttaccttactgctgtttgaagtatctgcagctttaatttcaaccagttttgtttgtaatttttttaatgcctacaatattctctgtttctggaaatgagtgaagtttgaatttgtttaacttgaggaggtatgacttatctagaagaagtttttattttcgtcatatatgtcttatggctcctttattaagtctatgtattatttgttgactactacaggagctaacgttcatgcaacaacagcaacaggggatacagcactaac

SEQ ID NO: 111728 - DNA, 1244 bp, Homo sapiens
atagaaagtaccatgtacgcatttgtgttcccctaacacagcatgtatccttcccccacttctccaaaaagggttccatttttttctaactaatcaaaagtttgcttatccttaaagattcttatgaaaattcttcttttcctctctaaactttatccttttaacatttaagtttgtaccatatagtgttgatgtctcactatagtctcttatttcacatacttactgtttttttttctaatggttaataagcttcttgattgaaggtatcatgtttctacttattttatattttcaatctctatttccctcttctatgttaacagaatataggcagtgcataataaatactgatttactcaactgttaaatgtagctctattcctttttgagtggagatagataaacttcattgtatagtaattgagaagtcttcaaatttttcaagatttttttaatggtgctgatttaattttttaaattgtattatcattaggatggccatgttgaagtagctaggttacttcttgacagcggtgcccaagtgaacatgcctgctgattcatttgagtcaccattaactttggctgcatgtggtgggcatgtggaacttgcggctttacttattgaaagaggagctagcctggaagaggtcaatgatgaaggttatacaccattgatggaagcagctcgagaaggacatgaagaaatggtggcattacttcttggtcaaggtaaccgtatctatcaagacactaaagtataaatgtgtaaaacctaagagtataattttataaaattggattttagtatttcacctttctagtagagttgcaatgagctattacacaaaccagtgataaagtatttactgtgaaaatggctcccatactgtgttaaaacaaaatcaaagaaacttctttcatatagagctttcagagacatcatgtgctatatgtgaacgaaaaacagaactggtgttggcaaggcttgtgagttaaataggggaatataagagccaacatttctaaaggtaatagatcaagagaatgtattcctttgggggcggaatacctactaataagtatttaatagatctaatgttttaaaaaacagtatgggaaaccacgcagtaaagactaacttgctgagagtgcaagaatgcgcacatattagaagctgccaaggggctcagtacataaacttcttttttgggaaaagtgaaacaattacttcaatatgtt

SEQ ID NO: 111729 - DNA, 1085 bp, Homo sapiens
agactccgtttctaaacaacaaaaaacaaaacaatcaaaaacaatatttatgctgtgcaattttttaatattcttatattctggtattgtgatattctttccgtaatagccgcagtttggcagaagcctgttcagaaggagatgtaaatgctgtgcgaaagttactcattgaagggcgaagtgtaaatgaacacacagaggaaggggagagcctcctttgtttagcttgttctgctggatactatgagcttgcacaggttcgtattatcaaaataaagcttatttgttgtttttttaaaaactggcttgcttactaaggaaataataaaataaatccttccaaccattaggattatttcaacaaatagttttgttagataaattttgtgtgcttatagctcttttactatgactaggtagacgttatataaatacgtgttcaaaattttttgacgattatttcctaatatctttttaaactatttttctctcataaggttttgttggcaatgcatgcaaatgtggaagataggggaatcaaaggtgacattacacctttaatggctgctgctaatggaggacatgtcaaaattgtgaagttgctgctagctcataaagcagatgttaatgcacagtcttcaacaggtcatgcctatttctttttcagttttactacatagtaacatcatttggtaataatgattttgcatgaaagtgatgtttagtgctaatttttcagttctcttattagaagtgctacatattctcacacatctgtgtatgagttttgaagtatatagaatatatttcaaatgatattcttcctgttttgtttatgagggcaattggccttttaagattctttaagataaaagtaaaacactgacccagttagatggaccactctcttggaaattgagaggtgtgggccgtagtgctcaaatccatgtttccagttttttaggagaggaatgggaagatagggagaccaaacaattgtggaacaaaaggatagttcattgtttcctactgttactaaattgtggcccacagaaaaaaatattgtgaaaacattgtgtcctgaa

SEQ ID NO: 111730 - DNA, 2119 bp, Homo sapiens
ccagagaccatttcaaggtgtccatgaggtcaaaactatttttatcataatattgagatgttacttgacttttttactatgttgacatttacgatgatggtgcaaaaacagtggtgggtaaaacttatggacccgaaggccatggaaacaaactgtactgatatgattgtattcttcactaccacgtgcttgaagttaaaaaaaaaaaattaaatgctagtttaagaatattcttgatgaagcgataaaattattcattttatgaaaactccccttttgaatgcatgttctttcaatattagtgtgtgtaacaaaatgggaagtacacataaagcacttttgctgcatataaaaagtatagtgtttgtctggaggaaaaataactgcaatttttttagatgtgaggtgaattagccttttttcccccatgaaatgtcatttttatggtaaagtacaaacgaaaaactatagttatcaaacttggatatttggcaaatgctcctctaaaaatgtttgaagtgagtctgtcactttaaggaaaacaacaatacttgttgccaatgataaagttaagctttgaagcaaaaattagaattttggaacttgtttgcctaggcttgacagctttccagtacttaaagactttttggatgaaatcagtggtgatattaatgaatgtgattttttgatagtgatatttgttacttaatttccagtatggtaaatatcaagaaatacagggtttatataaagtccttgggagttcagtacttcattgagtcctgaaagcaaaacatttaaaaactgctgatttagttaggtcttctattcacagttaaagttttcacaacctaagcatcacactcaaccctacatatacctaataaccaaattaaagtagaaaagaatattagtaaagaaaattaggctgcatatgagaaataaagttttgaattcttccacaaaaaaatttcttcttttgttaatcaacaggcttagatgtcatgttgaactttttagggttgcactgtgtttaccattgttaattatgttaacatattttttccctcccctgctttctttttatttctctcccctcttttcctttcgctgttcatttctcccttcctccctctttttgcatttgttttataggtggagtctttcattttggatcaggatgatttggaaaatccaatgctggaaacagcttccaagttgctcttatcaggtactgctgatggtgcagacctcaggacagtagatccagaaacacaggctagactggaagctttactagaagctgcaggtatgtactctacatagtaataagtctaccttgttatgtaaagttgcacatcaatctaataaaagctcttgttaaaaatgaatgatattgggtatttagaatgatactattaataaaggttaattgattactttctgctgaattacatggagcgttttactaaagcatattgtaattttcattaccagagtaaagtccatgtgctacagttgaccttacaaagagagatttttcagttgagtttgattattcgtgaattatgtatttgtgaatttgcctacctgcaaaaatgcattttaacttcaaaatcagtactagcggtctttcataggcatgtataaagtggtggaacatttgaatcaccctacatgcatgctcccagtagaagtcgaacaaagtgatgctctacattcttgtttcagctctcctgctataaataagtgtccttttgtggcctatttaatgccaggttttacacatttttgtgatttttgttggtgttaattttttaatttttaatttttgtgggtacatagtaggtgtaagtatttatgggatacatgagatattttgatacaggcatgcaatgcataataatcacatcagggtaaatgggctatccatcacctaaagcatttatcccttgtgttacaaacaacccagttatacttttttagttatttttaagtgtacaattaaattatttttgaccatagccactctgttgtgctagcacatactaggtcttattcattttttctaactttttttttttgatactcattaaccatccccactgccccaactacc

SEQ ID NO: 111731 - DNA, 1072 bp, Homo sapiens
cttatttcttattttatgtgtaaatctgcttatcagtattcaaagaactataagagcagatagccatatttttccaggcttacttgagagccagaaattattataatttcttaataaattaagaatttattcagtcactgtcataaaatgatcataaactcaagtttcttaatttttctattcactttttaatattcagtttttaaaatatgtattcatatgtaaaatgtatttcatattgataaaaccaaaattaagactgttgttgccttcaattatgttcacatagcctgtgctttgaatatcagtgaatatgttttatatgtatgagttatataattcatcccataatgatagccgtaagtcatttctaatgaacttttattttttgtagccaaagtggtgttagttatggatttatgtctgtaaacccattttatgttactgaaatgtctaaattggtcctaaaaatcaatcattgacacttactaaaagaaaaatttagaaaaaatataaaatctttttggagggatttttctgcattgactggatttattaagagatcttaaaattttaagtatggtaaatttttgactgaagataacttcttttcctggaataagtgtggggattatttgttttaaaatgcttttataatatagtcaaaatttagaacaccttttctgaaatgtagattactggtttaaaattcagattaccagcttttgagattcagtgataaatagagtattttccagaacaacaaaaacaataataaatatttttatttattaccagcttttgagattcattgataaatagggtattttccagaacaacaaaaacaataataaatattttttatttattttttaaatattttttatttattattattttttcttcggaaaacatcagatgggggatggggttagtgttgaatgtaaagaagtctaaattttgcggttgccagcattttacttttataaagtatgtttatgcttagagactggcccttttttccatcttcacctcacataatgcatttgttttacttaagttcgtaattggt

SEQ ID NO: 111732 - DNA, 1302 bp, Homo sapiens
aatctcaaccgtttgcctttacattgtatcctaataccctgttattacccatgttgtctacctgctaccctctttatcttcattattcagagctccacctagatcctacctcttctctagggttttcccaccctagtcttcttttcacattctttagctcctactattttctgctctgtaaaagtaatgtgagaccatatacatttaaaatattttatggtctgtattatgtgcttgactatatggttaatttttagcgaccctgactctttaagttaaaaaaaagtcatctatgtatttaggtaaaagatatttcatcccccaaaatgatttgaagtagtttagagtatatactctaaaaaaataaaaatacaaaggtagaattagtaaattaagaccaaaggaaaatggattatacagaaaaatgtatgtaatatacagttattaaacttagattcagttaactagcaaccagagccaaatttggaaacttgatgaattttgagatttgcatagtccatagcttcataggtatactagatgatttggaggactcatattttctgaaattgagatctgagaaaaaatttcttttgggccctcataatggagatactccaggtagtagataactttttcagcatttctaaaatatacccttcacattgtttatacagagtataaactaaagatttgctaataaaatgcaatttggttgaaaacaataatgtagtgtaagtactaggttttctgatggtcttgtttgtttcaacaataaaatttagaacatctagggcaaaggttccaaacttgtggcttcttggccatatcagacttagaactgtgttttgtgtagttcatataacattggcccacacagtgagcatgacacatatacacacacactcatttatttatattttctttaatttctctcagcactgttgtatagttttcactgttcaggtcttataaatatttcatgaaatttgttcctaggtgttttaggtttttgatattattgtaactgctaattctttttattttgcaattgtttgttgttcatatgtaggaatacagtggatatttgtgggcttaaattcacttagttctactagggttttttttatttgtttgtttttttggtagatcttaggattttctatctacttggatcatatgtacaaataaagtcagtttctaccttcatctcccatggttatgccttttaattctcttattttcaatattctaccttattgccttaagtagggcctccataaaatgttaaatagaactggt

SEQ ID NO: 111733 - DNA, 2276 bp, Homo sapiens
gatctttggctaggtgcagtgagtggctcgtgcctgtaatcacagcaattcgggaggctgaagcaagaggatcgcttgagcccaggagttcaagaccagcctaagcaacatagtgagaccctatgtctacaaaaaagtaaaaattaaaaaaaaaaagttttggattttggagcatttcagattttgaattttcagattagggatgatcaacctgtatattttgcagtgaggatactcttatttggaagtccaatttttcatgtaagggtggggttgatgttataacattgctttcatatgccaattttgggagaattaatggggaagtagtataagatacacttatgttagttaatccctgtaaagaagaatgatattttagtggaatatggaggctccaaatagcttgtggaaaggtagtataactagaagtatgtgaatcaatgtattactcttatatgaaagtaaaggcacggttgtccaatgaaccactagtttcccactgatccatcgtagtctggtaattagtgcatgttatggagcattaattagaaaaggtctacatcatatattatccatttatagaggcaacaacattggccctttactggttctgaattgtgagaggcctttgttttgacacttgataacagctcattctgatatgaagtcacttgatcactacaaagttggtgagcagcacagtcttgttaaccattggtttggtttagtatatatcttccaaatttgccaaaccaatggcttttcacaaggtgtttataattgttaaatgcctatgaggtgataactttcatgtgtggttggattaatactggccattaataatttagtcttggatggaatcagaactctaactagttggatatgtgttgtaagtaggatagcacatagttttatggtggcaacagtaattggcacattagctaccctttattgagtatttaaattatatatagagagggagtgtgccaggtactacataagcattgttttatttaatcctctgaatgattctgtgaggaggtaggtacccacttcataagcagcttataaggaataaatgaagtaatctgcataaacatttagcacagcatttagttacatagttaacccttaactgttaacccttttttaaccctcatcttctatccttatgctgtcacccccgccatttgacaggaaaatttgagcgtcagggattattagagcaatagttttaaattcttttggtcttaggtctctttttcactgttaaaaattattgagaactcaaaagttttttgtttctgagagttatatctatcactatttactatattagaaattatagtttaaagaaaattaaaattaaagttgaaagaaaaatttaaaaacatttacatatttattcatttaaaaaaatgataaaccattgcatgttaacatgcttttataaaaaaataattattttccaaaagaaaaaatttgtgagagtggcattgttttacatttttataaatatctttaacatctgacttaatggaagataactagactctcatatcttctttattaatttaatttaacttttattttagagttgaggtctcattacgttgcccaggctggagtgcagtggctgttcacaggtacagtcataatgcactttagccttgaactcctgggctgagcagtcattctgcctcagcctcctgagtagctgagactacaggtgccagccaccatgcccatcatatctgctgtcatattcagtctattgtgatacattatttggtcgaagtctctaaagaaatttagtgtcacattgttaggaggataaaaaaacaaaaactattttcatagccctttcagataattgtggataatcttctttaaaaccattcctaaactccacaagtggtagtttcttaaaggttagttgcagtgtggaatctgaaacaattaccggtgaactttctgaactttgttagattaaaactcactggcttattgtgcactttgaatttatcaaaaccatgtatgatttttataatattggtcatagtaaaatactggtttcttttattctgcaatatttttaaaaatcacattttcagccaggcgcagtggcccacacctataatcccagcactttgggaggctgagatgggtggatcacaaggtcaagagatcaaaaccatcctggccaacatggtgaaaccctgtctctactaaaaatacaaaaattagctgggtgtagtggcatgcgcctgtag

SEQ ID NO: 111734 - DNA, 1498 bp, Homo sapiens
tttgtttctattagtgagtttccttaaaaatgtgtggtaaaattatctacttagaaatagtagtataaactttcatcaaaggagtttagtaattacaagtggccacatgactttttagtggttcagtttaaataagcctaattagattacagagttctagtgttacattttaatttgcttttaaaattttttggtttggattttaaagaagtgtgctttggagattttgataaatctatttgacaatttttcttagccatttaaaacttcagcatataacagattttagaagtcttatttatgttctgaggaaatcctacttgagcactgttttgtgctttatgcataggtttttttaatgctacctgaacaactggctttttattatctcaattgtttaataccatgttaagatttcatgttaccttatttattcaatgttgctagttattaaaacaacctctgcaattttagttttcctaattctcaatttatcttaatttagtttctatgtacctgttgcatcctatcatactaaataagtagctttttctctttatttaaaatatcatttgacttaaatatttgtcaatcttggtaacattttctaagtagtaataaaagagccttatccaaagttataagtactcataatgacacagtgctaaaaatacagagtgcaaagaataaatttgctaactttgcagataaatgtaccattttctaaagcacctcatattgcaagtaaacagatatttattacataatgagctttccagaaaaatatattccctagccctctaccccccacagggataactccttgaataaatgtccagtaatggataatgaagttcatctgtataccacagtgacagttttattattgtacttaatattgagctacttgaagttcattaccgtaattttcacctttgtgattttatttattgaacatacggaattttatgtagattatgcttatttgcattgaataaatattagactctttttttcctgtctttgtaacttgatcttttgaatcataaacttcttaaaggtactcttattgaatattagttaacaaaagtcaatatcattagtgaacataacacaaatgatttctcataatactatggcttaccttttaaactgtgattactgattatatatgcccacatatatttaagttgactatttagacctttaaaatcttaagtaaaatactctctaaaatgtataataaaattagaaaaggtggatttcaacttacatcattgcttttcaacagtccaaggtaagggattaaatagagtgtcttggctatttcatttattcaaataatccaggcagtaattttcttctccaaaccaaaggcatcaaagtatttccgttccttctgcctaccttctgtaaaaggaactaatactcaggaaagtagccatatacagatggcagaaaaagggctgacagctcatataaatacctcttttcttgt

SEQ ID NO: 111735 - DNA, 1400 bp, Homo sapiens
ttaaatagctttttaaaaaatatgttatttcttttttgaaattttaggattttaaaaattgaagtggtaaaataagagactttattttgtctgttaaaattacttgacagaagtttgctttggaatagagcttctgtatctttaaaaaatacacagtgagtcaccccctgctcttttggtagatgcctggctagtgaacagctaagctgctttaggcatgtaatagaacattccatttcctgttcccttgctgacacagaggagtgttcctgctggcaatgatctaatcatagtgcagtaagaaacatggcagtttgataaaacatggtggagacagcggctgaaatggaagcatatgttctagaagacattcttgaggtagggctaggtttgtaagtgaaatgaaagttgaaatctgaacaaagaaatcttatctgccggaattattttacagatgaatagattagaggagagagcaaagagaagcagagcataaaagcaagacacggtcagacctattccgtgtgagaatgtttcagactggttcacatgattactatagacgtctataattattttgtttaaacttcatgtttcataaattgtagatatatgtttgttagggaaaaaggggagactcaggcttaataaaaagccttgtgctggtggtgacctttagattaactcattagaaggtggggtctgcaaagcagctttgagtaaggtttagtatcatatgtcttagaattcatttacatatctaagcctaaagctttgctgcagttaactattaaaaacggttattttagctttaaactaagcatgtttatatcaatctgattgcttaatttagctggtatactctggtcctagatttttcatgtgactttgattattataaaacaaattattaaattaaaaatattaaaaccctgaaatttagggcactgatgctagagagacatcaatacaaaattactataatttgaatcatgaacattttaaattatattttctcttttctggttgtaaaaattttataagatcctatttgagtataaatcagtccaaggaaatacatgtcaaagtgaaactataattgcttttggcattgaatgtagtatactattagaaatttgtatttataggtataggtatttaaatctcatattcttatctgtgggattgtgtagggtttttcttttttttcctcattagataaaacctgggtaattcagataaagaggctttatggtggtgagtggtattcctaatacttagactgttgagataatttattaactatttcacatcttcaggaagattattttactgtggggagagggcttgggagaagaagctgcaaagggaagctaggcggggttagcaggagaaaaaag

SEQ ID NO: 111736 - DNA, 1117 bp, Homo sapiens
aactcctgacctcaggtgatctgcccgcctgggcctcccagagtgctgggattacaggacaggcatgagccaccgcgcctggccaaagtattgcctgctttcaacagtgttgcctgcttttttctagtctttaagggagacagataataaatgatagccataattctgtgagaaagccataatcacatatgtattgttaaaaacaacagtaaatgtcagaaaacagaagcaccccataatcctagaatggaagagaaggggagagtgaaaggttttattaactttagtcttaggggcccccatttcttgtcagataaaggatttggaaggcctattcttggtttatggaaaaggagagtgttccagcatacgttccttgaactcaaacctatcattgcttgatagcattagaggaaaatttgaggaagggaaactttgttgacgacttgttttaagtctaaagatggagcagtttatttgaagcatagaaagaattgacctgggaggcaggaaataacaaaagccagtttgtagtttctgtttaagccaggtctcaacaatgtaaattactttgagcagcctttaaatgccaggcatacccatacctaaatgtaaacactaggtatggtatgaggtaaaacatagtgtcatttgtttgccattaattccacataccctttgcaatcagttctggatttgcatctggatttgactctgcatataactgtgtgccctgtctgatacttggttcccttattcgtaaaatgagattatcacagggaagaagtatagttgatgattctggatatggactccagtctggtgcaaactgcctgaattcagatctcaactcttcaacttaattagcttagcttgaaataattgggcaagttgcttaacctctttttgtcccatttccacatacgtaaaatggggataataataatatgttttaggattactgtgaaaattaaatgagttaatatataaaaagcatttaaaatggcatatagtaagcaaaatgtagtttaaaaatatgacatagctgggttgttatgaggataaataatatgtttatttttttaaaaaaagaaatcatatattgcttgacacagta

SEQ ID NO: 111737 - DNA, 1026 bp, Homo sapiens
tttaatatctttcacttatacttggtttaggctctttcacacttgggtttcatacttatgctttactataatttacacagtagaaaagagaaaaagagagatactataaagtaatgattaaatttaataattttaagaggtagaattgttttagttttttttctagtagtttatgtgagtgggcaaaatcattaaatttttcctaccaccagttgtcagtccttgttttgtttgaatatatagattttgaagcctcaccattccctaagttaaaaaattgataggaatgaaactcctttacaaggagttttctattaaagttttacatgaagggaacaaacaacaaagtgttaagtcatgcaaaacagagttgcttgcttgtcagcacatttctacatatttttttgttttgattttctttttccttcttcaaggaaaccaatgctggtcctaaataaaattgtcaattttggaagattctttcattcaatctaggtatttactgagcttttttgtcctttaccttctttttatgagaggtttcactcttcattttggatatttgaacattttcagtcaatattttcttttattattttaaattatttttatatgtttacatttgtttgcatagcttaatatgttaattgctatttacactttaatacttctgttggcaaaataatgaaaagtcttgtgccattgaaatccattttagataaatgggaagacaattttcttgcctataaaattaggttgaggctgggtgcggtggctcacacctgtaatcccagcactttgggaggccaaggcaggcggtcacttgaggtcaggagttcgagagcaccctggccaacatgatgaaaccccgtctctactaaaaatgcaaaaatgagccaggcgtggtggtgggcgcctgtaatcccagctactcgggaggctgaggcaggagaatcacttgaacccgggaggcagaggttgcagtgagctgaaactgcgccactgcactccaacctggagtgcaaa

SEQ ID NO: 111738 - DNA, 1028 bp, Homo sapiens
tttggtactttaaataattgcttgcaaaagttacatctttaaataattgcttgcaggcaaaccattcaaggtttgttatgaatagattaggctggaaatagcagagcgcagagtggtaacagatatcttgagaccagactgattggagcttgtcagggaccccagaccattaaggaaccagaggagagccagtgatagcaatgagattccatggttacttgggtagtttttacttcctgattattttccatgcccttgatgctatcttgagttacttggaactgtttcttcattcccccagagtggtagaaaccggtgactcaagaaaattgtctttagatttaagctttttcttgtaatttaaatttttatccccaggtcccctagacctccattttgtgtctgtgtgtgtgtggtgtgtatttctttctgttggtagatatttgctttcaagtggaggacaaatgtgttgctgacgaggttgaaagtgctgtatcatcaatagatttaacctatttaaaatcaaaaacattgaaataagtaatttctgttatgtatgcacttgtttttattttcatttgaaaatgtacaattcagacaaatgggagggttgattgtaaacaataaatattttatcagttttgtgtacatagaacctattgtgaaatgctggaaaaagaatgaattcatggtgtgacccaccatgggtagagacaacaaatgcgagtgtccaacagacacaactattactggggatgtgaaaagaggcagcattgctttgtttcttactttgtttagtacattacttacgttgggacaagactatgcttgtatttcattctgtacataggacacatctggatgaagcgttttgtatctaatataattctcttctgtacttttctaggttgaatttcagatttcatttattagttggattagagaagaatgggaaggggaccaattagagaaaaaaatcattgaagtttttagtattaaacattgtcaagaatcaggattgtgttcta

SEQ ID NO: 111739 - DNA, 1050 bp, Homo sapiens
tctacactttgtagttgaaaaaatcaaggtaaagaataagtaacttgttcaaggtcacagtaagtgatggaaatggaatataaacatgggtagtctcacatgaaagtctgctttcttaactctcatattgtactgccttcttaccatccttttatggcctccctagtaattgctcaagaaatatgttttgtatgcattgtagagttcactagccatttcatcttgcttctaagtcctctttacagatctgtatgaataccgtcttactcaaatttatgtatagtgacctatccccaagtaggataaccagagagaaatgatggagtaaggagggttatggaagacctccttactccaaaacactttacctgaatgtagctagttaatactgctctgttttatttcatcttgtttccctaactcctgtcttgggaacattcatggattaatcttgggatggatttcataggtggaataaatgggaatgtcactcttcaatatttctgaaacatcaaatcaaaatacataccttgtagattacctcttacagtaagtgctcaaaatgtgaagtgggaagaatgctgttttagaccctcctatacctcttaattcatgctgttaggtaagtgtgacatgtaaaaattaaatatctcagtctctcataaaaggggcctggtaatactttcttttgagggaggttaggtgacctaatgtttgtgaaaatatttgtgacctataaggattttcataaattaattgttaaaactgaagtatgaataaaaatagagagtcttatgaaaattctgactactgagatggttggttttttttttttttaatttaggagaatcccttattttaaatttctaattctattaaatttggttatcttattgaatttatagattgctagtaaatattttcagttctaattgtacattttggttaattgttttaggtggagctgatagtagataggttaaggggttgggattctgtaatgaacagttcacaaaataatggttgtattctgaatttgttaagttttta

SEQ ID NO: 111740 - DNA, 1056 bp, Homo sapiens
gggtcttgctctgttgcataggctggagggcagtggcatgatcatagctcactgccgcctcgaaatcctgggctcaagtgttcctcccacctcagcctcccaagtatctgggactacaggtgcatgccaccatgcctagctaatttttttttttttttttgtagagatagtcttgctgtgttgcccaagttattctagaactcctgggctcaggtgatcctcctgccttggcctctcaaagtgctagtattccaggcatgagcccatgtgcccagccaagtcagtgatcttttgaagcaatttttcttcttttattgcttaaacctctaaacaggcttgacatttttttttcttttctctttccctcccttacagattctagtacagaagtacttttatgaagaaaatataagcaatgccagcatctatatagtgttcttactgatttgatgatgcccttaggttgtctttgaacttgaaaatctctatacattattattgcaggacctataaactatgactgttgtgtagttctcttgcactatctttccaatgttctttgaagaactgtttcactgtttattttatctatttcaaatgaactaggagtaatttaaaacttacatagttgctgttcagaaaatgtcaaaaaagaagagcttgtataagatacaatgtagataaatttaattctattgagggggtaatatccttttaagatacaatgtagataaatttaattctattgagggggtaatatcctttaaaccaaacttgtctaaagttttcaccaaatgttaaactgtgagtaatgttttctttttatttatccatttgatttttttatattggaggaatcttaaaattgcagtatctttttccacttttattaaatcatatagtaactgtgaactgaaaatttaaacagtagaggaagatacagagtaagagttgaagattttttatatccctaggtgtaaattgtaagtgtatgtaatcctatgcctttttctgtgcattttcacacatatacagatatatctatgtaattttgtt

SEQ ID NO: 111741 - DNA, 1423 bp, Homo sapiens
acagttggtgtatatcaaatgtttgtttctttcttgagactgagtgcgtgtgtgtgtgtgttagagtatgttaatatttgccacattattctcatttacttatgaatgttccataatataaatgttcataatttatttgatcttttattttggtagacatttagattgttttcactacattgctattagtgaagtgaacatccttgtacagttatttttgagtatgaaactatttctttgggatggattcctggaaatggaattgttgggctagagtatgcacatgttaaatttgataaatactctcaagttttgcttgcatcagcagtgtatgagaatgttcctagatgtggttaatttacttagttttaaaaatctgttaaacaaaaaatggtgttttgttttcatttttctgattactgtcaacattgagtataagttttttaatctttgtttttcatttggatgtcttgaaaatttcctggtttatcctttacctatttttctattaggattgtcttgttgttttcttattgatttgttgatagtatttatagtattaatttttcatagtgttatgtgttacagtattctcccttgacattgttttcacaacatggaaaaatttattgtttagtaaaatgtattattcttttatgacttctggagaacttcctcactccagtatttaacaattcttagaaatttttctttgtactttgtttttcaaagatacatggatctctttttggatatagtatttaattcttgtgtctgtttcttatttactcctttttatagcagttgactgattcttgcttcttaaaatgtaatcctctcttcctcatgtaataccaccttctcctgtttgtacctcactgttttttgttggtcatcttgcttccttttaccccgcacagcaaacatactttgattatttacctcattggacccttttctgttttgtgtctggtctcatttagatgattttaactattgtgtcgttacatatctatataccagtgactatcaggtttacagctccaacctaaacctttgttttttttgagaattgggctcacccttctggccacctaccatttgtgcaaacctttcttccaacacctaattgtttctttcctcaagagaatcaattcaaagtcccatccagttactacatacagctccaagtgaaagatatatacaaaatgcttttcctcctaattcagagaattctagtgatctataaagcaataaacaactatctctccctcttttcacccaacccattgtgtagtagtgagtaggaataggataatcataatgaaaactcttctagagaagggaagaataggaagtacacagcagtcattggtacatattaataatgaaatccttcgggggaggagttgtgacaactttg

SEQ ID NO: 111742 - DNA, 1784 bp, Homo sapiens
acattgcattctattgaatgcatttttgaatatgactgaatgatcttagtattttttctttctttttttttttttggagacggagtttcgctcttgttgcccaggctggagtgcaacagtctgatctcggctcactgcaacttccacctcccgggttcaaatgattttcctgcctcagcttcccgagtagctggaattacaggcatccgccaccaggcctggctaatttttgtatttttattagagacagggtttcaccatgttggccagggtagtcttgaactcctgacctcaggtgatccactggcctcagcctcccagagtgctgagattacaggtctgagccacactgcgcactgcaatcttagtattttctaaggcagaattcaaagggggagaaacatttttgttgaagatgcttaaagtataaatacagtaggagttgatcagaatttcatctgtttttgtaagtaacctgtgactaaatcaagagataaacctagtgaagaaattttagacaaagggagccggtaaataaattagtactgacttagtattgaaaggatttgcaaggccagggaggatctgtttacagacagaaaaagagagttgaaaatgagggagaaagaaaaaatatttcagaattaggctgtgttcagcttcatttggaaatattcttgtttgttttttattggaaaagtgctatctaaattccttttttgtaatgcttagaatcctagattagcccagagaagcttgcttgtttcatctcttaattgatgtagcagtatttgtaaactagattttaagatctttgaagcagtagtctgtcttaattataatttatcttgtcttctctcctgcttaagcacagtactagaaaaaaacaaaacatttttagtgaataactagtacttagggaggattcagcattcatttagggaaagaagagaaggaatggaaattcttcccttcttggatccagggcttctgaatagctgaagttcagatttcaacattttccaatttcttaattccttttcgtagtgatgatgatcttctctaagtattaaggggagagccagttaaactaataggaattgatgaatgcctggtaagtaccttaagcctcctaaaatttttaaagagtaaataaaaatgaatacttattcagtacctactgtttgtgaagtctaggtaaaggttaaaagtatggattttggagcttggatttaaatccttgatccatcatttactagcattgtgaccttggccgagtttttaaatctctactgcaatttcctcatgtaaatggtataaatggtaatgatagtagattctaccttataacattgttatgagagttaaatgagttaatacaattttctcgtattctcattttattcttgccataaccctatgaagtaggtgctgctatatttctttcattattcaataaatgtttggagttcctactatgtgctaggtattgtgctgtactgcgtgagcaatggtgaacaaaacttgtaagtcaccttgatttaaaaatacaccaatgaataaatattataagtttggggaggtgtgagagtgagcttaagtggttaaatgtacatcttgaataatgtgtgagtttcaaagtatacaaatgttggcagggagcattcattttacaggtaaacatactggcatagaaggattttaggcaacctcatcagggtcacatagctaataaatgtcagaatgggattgaacctgggactgttagattctacgcctcctca

SEQ ID NO: 111743 - DNA, 1075 bp, Homo sapiens
ccttttgtaatataggaatggttatgttgactttcaccaactatggtagtatttctatgtttttaacataccttatcctgtcttttacatggtgttaaacaatgggtttgtcatttatgaagatgagtcaggagaaatacgtgtaagaaagtgtgcccattggccgggcgtggtagctcacgcctgtaatcccagcactttgggagaccgaggcgggcggatcacctgaggtcaggagtttgagaccagcctggccaacatggtgaaaccccatctctactaaaaatacaaaaaaattagccgagtgtggtggcagatgcctgtaatctcagctacttgggaggctgaggcaggagaattgcttgaacccgggaggtggaggttgcagtgagctgagattgcaccattgcagtccagcctgggcaacaagaacgagactctgtctcaaaaaaaaaaaagtgtacccatttaaaaaatctatacagatgagggatgagcagacaaaaaggagtacagattgtctctgccccatcttcatcttttgatcaaagtaaagacaaataaaactgtaagctaaatgggtgagttgtgtaatgtttttctcttaattaccattttactgacatgtcagcagaagcctaactttctggagctaggaagtcttgtggctaaaatcacagtgttgtcttttctctaattcattctgttataggctacacaataaaaaaaagtagataaaatgatctttaaaattatccttccagtaaaaatcatcaaaagattaaaaaggaatgtgaaaggttatggttttgtggtatttaacctgaaaggataactttaatttaacaaaaatacatagctttgctataaagaaatgctatctgaataatctctgtatctgccaaaagaggaaaaatggaaggaaacgagaatcaattcaaataagagcttcatttaattgttgaacaataagaatataatttctagacattggagtaggttattgagaataggattttactttaaagtatttcagaatagggtaatcacgtcttagataatttgcataacttcg

SEQ ID NO: 111744 - DNA, 2573 bp, Homo sapiens
aggtgagagctggcggagcggcggcggcggcggcggcagtagaggtgaccgaggcggtggcggcggaggcggcaccgattgctgtgtcggccccagtgcggccgaagtcgcggtagagcgtagccccacgcccctcccccgtccgcgccctccctctttccctggggatggagaaggcgacggttccggtggcggcggcgacggctgcagaaggagaagggagccccccggcggtggcggctgtggcgggcccccccgcggcggcggaggtcggcggcggcgttggcggcagcagcagagctcgctcggcctcgtctcctcgtgggatggtgcgagtctgcgacctgctcctgaagaagaagccgccgcagcagcagcaccacaaggccaagcgtaaccggacttgccgaccccccagcagcagcgaaagcagcagcgacagcgacaacagcggcggcggtggaggcggcggtggaggcggaggtggcggcggcggcaccagcagtaacaacagcgaggaagaagaggacgacgacgacgaggaagaggaggtttctgaggcaagggcctggtttcaaaggaaggagggaggaagggactgtaagggataggggccgaaggtgggaggggatttggagtgggacagattccagtgggttgatctcttaggggccaggctttcgactgccccctttcttccctcggcctaaatcgtgaggtgtgggaatgtgggggagggtagctgacacgtgggggtgggaggaccacggagttcacagagttggtgaacagcctgttatcatgggatggctcacttggttaaggatggagggaattggttagattccctgtttgcacgccggggggtgggggggtggtctgcctggggccagtagggccaccttagtctgaggcgggatcgggatcaaagcgggaggagtaaaataatgggtaaatgagtctcttggggaccaactaggaggttgatcaacttctcccagttgtgaggtggaggggagcagtttgaggggggacgtaaggttgtaatggactcagagctaagtgtttgtgtatgtgagggacacgtgagaagctgtacttttccatactgttctgcagggtttttcgtaactatcctggctgctgaagtaacttcatttcctcgatctcccagggattttcgatgaactgatgctgtatttgtataaatttatcagtaactttaaataattacaaatgaccatatacatttgtaagtggatgaaaaatatatttgatccttacacgtacatacatacatgccttcgaatgtttccttagtgagttagaattaagctaggacctgttgtcccgtaatatgggacagccaaagggtaggctttggagccaggcctggttgtggtgagttggaataggaaggcctctcggtttgtcctagtgatctggtttcataataactttataatttttcctgggtccacagacaggcggcgttgcaggaccttattcctcacagaagcccttacaacccaaaggctcagtaaaacataccatactgacaaccaactgagagttagctttactagttattagctgttttaccactctcttgtctccttcctgaaatagaatctagaaaaatctttatttggagagggaaatctttatcagcagagggaaaacagctttaaaggctgattttaaacttagttctaagaggagaccaagtgattcatctaaaagtaccacttactatttattctcttccacaaacatggaacttattttgatgcaagtctggttttccgaaaattggaattattgaatcctggtctctgttgaaatagagaagtaccttttaaaggatttgacacatgtctatttgtagaagaccagattctcttttatctcagactggatgaagttgtataggtagagatattaagtgctgaagtatgtatgacaaaaatatgccagtccttgtttttattcccttttagcctgttggattctgagaataggtttgtattgatagacttatattggcctacttggatgtttaggatagtgtgttgctctggcggcatttgaaacaaggaagagaaagatgtaatggggtccttatccctaataaaatttgttatggtacttagaatcattcaattgtatgattcttctcaaaggtgagaaacattttacaggtaattcagccctttattttaaaaaggaggaaaacaaggtttagaggaaagtggttgtggtgggtagtagcaaaagtacaaatcaaagttttctaatgtctcagacctgtacactttttaataataatttatttccttttatcaccctcctgatatcattcagaaaaatagttactgaatagcaaggtaacacaatcatgcagctataggcaaaataccattacttaaaattttaaattctcgtgaaactattaagctctggtttagagcaaggttatgatagttgaatgcagtacttactgggatattctgctgcaaacttaacatacctaggtagttttgtccattggaatgcggcctaataagcagaac

SEQ ID NO: 111745 - DNA, 1165 bp, Homo sapiens
tctactcatggtgagaaaaatacttctatggtatccagctaccctgtattacacagtggattacagattggaagactttctctgcgaagagccagattagaaatatttcaggctctgtaggtcatatgatttctgttacaactactcatctctgcagttataacagaaaaacagacatagacaatgagcagacaaattagtgtggtgatattccaatacaactttgtttacaaaaacaggcagcctgggaccaccatctgccaactccttatgtcatttgtagacttatttcagttgaggatttagtcaggctctattcaggttcagaaacattttccaactgcacatgatcctgaagtaaacactttaaaggctgctcatactctactatgtaatgtacttttatcagaagcagaagctgagggaataagattatgtaaggctccatttgctttcataacaactctcacagctcagcatatcaggagttgcatcccaagtgtccctgaagtttctttacagtaaaatttctttatggtgaaatttcttaatagtgttctggcactaaacaatgagtgctataaatcatgttcatgttcttggccagtagtataatttttaggaaatatcctatgacaatgaccccaggagaacaaaatcagtgtgaccaatgatatttagaagagacatgttcattaacattaaaaatggaaagtaatccatttgggaaatgaaccaacagtatggaggacttcaggaggatctttttatggcaattgtgtgaagtgtattgatccttggaaacgtacaccttgaaaattacaagtgagaaaaagccaatggcaacatacatgcttacctgatttcaaacatgtaacagtcagtatatataaattctgtcattcaatattcagtatttattgaagaagagcctactgtgagcaagtttctgctctgagaaccaggaacacaggagtgaataaagtggaccaaactccctgccctctcattttcttatgagacagagacagatattgaggatcaaagggattttagcaattgaaatacttggaattttaatatcatgacttgttgggtcttttttttttttataaaaccgcttatatgagaaagcttttcttcctttgtttattgttgtttaggc

SEQ ID NO: 111746 - DNA, 1110 bp, Homo sapiens
gatctaaggcttctcataaatgatagttctaaagaattaaccccagggccaaaaacattatgtcctgtcctaacctctccatcccttgctcctcatgacactttatttttactggttccctcttgacattagattatgcaatatatggccaacatccacagcttttcttgtacgcagcaaacagtatctcatattgctttgggaacaatagagtaagggcttaaaagctataagagtagagatgaaaactgaaactggccaagctacagcagaggctgggggctgagaggagatgaaatcatgaaaaaataagtggtactgaaacatgacccaaatcttatggggggtggaaaaaggaaaaaagccaaataaatgacagagagaaggagaagtgaatgatgcagggttgggcagtaggaaagtgaaggaaacaaatatgatcaaatatggaaataaagccacagctgaaagataaggatgaactataagcagtgggaaaaagacctgatgcaaaggataaaggatccactgacttattcctcaaacacttactgattactcactgtgagcaggtgtatttttggaccctgagcattcagtaatgaaccaaacaaaacccttactctcatggagttacatcataaagtcgggatgcagtcaatacataagataaatgctgaggaaatggagtaaagagtgctagagatagagagcggaaagggttctgattgcatataacctagttccttcctcagtgagcgggaagcactggaggaaaagcctgcagaaagggagaaagcaagccatgcagctttcgcaggtattccaggcaaggggaatggcaactccacagccctaaggcagatgcatatttgtaagggtcagggagaacagtgtggggaaatggaagtagaaagacagcaggagaagaagccaaatgggctcagaacatgtagggtttgataggccattatgaggcttgatctttcccactaaataagatgagaagctgtggaaggatattgagcacatgagtggcaatatcagtctagctgctgtgttaagaacagagtagagaggggacaagagtggaaacagagaagttaccaa

SEQ ID NO: 111747 - DNA, 1059 bp, Homo sapiens
aactacttattttaattaactaaatggatatcccaagcattccatgtttatcctgttgctcagtgaatcctcaaatcgttaatttggtagattctcttttttgtcttcatactattatttcttttagcttttaaaaaaattgtgtactgcctacaggtctttatggaagtttcacctttctttgtgtcgcactggcatcggctgtataatttttgcagctagaccacattttaaaaaaatctacatttttggaactagtaaaagatacttatttgtgttatttaagtattcacgtcttttaccgtgggtagttaagtttaataatttaaaaagacacattttatcagtaacaatgttcattttatttttcagactcttccctctactacttactctgtatttctgtctcttctaatgactaggaaaggcagtttctcaaaatcatcttctatttagttggcaaatgtgataatgtgggtagtgttcctaccttcctgctgtatgtgttctactgaaatgagatataatagccatctggctacaattttgatttctaagaagttcttatgtcattttaaattcaaaaactaagtgtttcaacatttggtctctcatatcttaagttttattttctttgttccagctgttcagagatagtgtgttctaatatctccacaatcaagatttttgactaaaatggatcagtacatgaaaaagagggactagtattaattttagatcttgttagttaatcatggtcttactaataatttggcaagttctttaatgagccaaatctttgtatttcaaatgccttgaagttgttattctttcctattagtaccctgatgggaggatgaaaacagcagaaaggagcagcaccagatgatcttttcatgggcacgtactctttcaaggaatcccatggagctcagtgaaattacactttggcttagagataattaagttgtggaaggaggtttaagagaggagcttaggtgaaatttgagctgtaaatgagtatgctaaattaaagaaatgattagtaataaatgagat

SEQ ID NO: 111748 - DNA, 1054 bp, Homo sapiens
ctgtctcccaggctggagtgcagtggcgcgatctcagctcactgcaagctccgcctcccgggttcacgccattctcctgcctcagcctcccgagtaactgggactacaggcgcccgccaccacacccgtctaattttttttgtatttttagtagagacggggtttcaccgtgttagctaggatggtctcgatctcctgacctcgtgatccaccagcctcggactcccaaagtgctaggattacaggtgtgagccaccgcgcccgggcacgttcaagttttttatggccctatttatttaaaaactccctcagtgaagtatgagatatgttagaactttcaaaggcattttctgaatactcaagaaggacaaaaaggaaggacactaggtaagagaggcacaaacctcatggtcctatttctaccgccctgggtctgctctgtttgcccctgtctcctctcaggaccttccacccattacccaggcaccctgcgcagacgtattggtcccttggtgattaagatgtagatcaccagagagctagattcccagtctgccactcagctagggatcctatttgtgttctggatctggtagatacctcttctccaggtaactaacatctaaaatgtccttatccttgaaggaagacttacttcaccctgcacatttatgactctgtacttgatatatgtcagcttagtagccttatcacacatatattaaaatacacaaaattgtgcacacacgtaaaggaacaggaaggctgatcatgatttgttgggggtggttgtgaagagtcacttgcattccttagcctgagaaactcctattcccctgaaatctgtggtcacagtcaaagatgtgacatttccttcacatgaaaactgacctgagaaggtggatgaacactctctgttgttatctgatgcatttacagaggcagtgtttcaagatgttaagtgcgtagattctgcagctagattgcctaggtaaaaatctaagttttactacttactaattatgtgattgaggacaagtacattaaccactct

SEQ ID NO: 111749 - DNA, 1040 bp, Homo sapiens
tagcaaatgctcaataagtgttagctgttgttgttgctattatttttattaatgaagtgtactatatgctgcactaattaggtcatcctctccaaaagcagagtttatgtgtttgtacttgaactatgtaaatcaaagatctcaactaatattccagtgcagtgccagctgttccagcaaaccaatgtgcaaatgaagaaaatattctgagcctactaaatgcctaatttgaaaaggttaataatgtgccaactcagatttagtgcaagagtccaaaaaatgctcagtaacaaatagatgtaaagtctcaccaaggactttatttcttccatagaaacttttgcaaactggtgtgtttcaaaaactcaactcagctaaaccttaaaggtcaggtccccagagctacaaacttgagataattcagattaataacttaggaaaaaacaggtcattttgtctgaatgctccaaaacaatagcaataatcaataattgccgtatctctaatttaacttcagcatttgaccccagtcaaattgtgcttgtgttttcatgagaaaaatattggtcaaatattatactgtttaagcagactttcttaagcaataatttaccctaaggggattataacaccccaccggaagcaatggacagcaacattttttaagtgttttcaaaatgaatttgactgtcttaaatctaaatgaaggaatcctgcaataacagttacaacagtttgcttccatttggaagtatctatcactaaaattgggcacattagtttataaatcaaacttatttgtcttgttcataagatatcaaatgaagcagtttcttggaaaaattgatgttttatgtacaagacagtggtaattctgagaagaggtgggtagatagtgaatgtctgctttatccaatgtttgctttttgcctagaaatacagagctaataggttgtcatctagttaatctgcaagccgggcaactattcagtaagattgatttgtgtatatagttcatgacatttctttttttagttaca

SEQ ID NO: 111750 - DNA, 1159 bp, Homo sapiens
gtgttagaattctttgtgggcacatgagggtactaaaaatctatttgttaaattggatgattaaaatacatttctgagggctggcaaaatgaatacttaattcagattttgccttaaatgacccaaaagtgagacattggcaaacttgcttactatcaggtgcttatgtctagtgcttccaaaaagctgtaaaaaaaaaaaaatgagtcaggcctttagtcttcattgaggattacacaagctaaacttggaaaatcagctatttttgagctatacacatacaaaatttttcttcttaaaatgtaagctttatttggtgccatagacatcatttaaaaatagctaaaactttataaactccctggacaattaagaaaatgtcacctttgagctcagctagggaagataaagataccttcaccattcgagcatttttgagaattccaaataactaaaaataacctggtgatgaaaagtgatttgagtctaagggaagcactattgaaagttacccagttaagtctgagaaatttaagtaaattaagatgatgaatggtaaagttataagttagtcactaataagctcaagaacagaatgggcatttccttgaccttagagaccctgtgctaccttcttcggttgttctgaaatatgaattgtgttttatactaagcaatggatagaagggatgcagaagtcttgcctcaaataaaacctgcaccttagctgaggtgggggaaggaagcacttgtcatctacccagcagggctgacacctcttgatgtggctggtgttaaaatccccaaggttggcatatcccccagctacatcatgaaacaaatactcatggtgcacactggcttattcaaaataataatgtttaattatttttaggctgggaaaaataatatgagcttaaaaaataacatgcttgccttgcagccttagcaatcgtggtaaaatgtaagattatatcaacttgaagagcaacctataaacaaaccaaagaagaggatgacactttgtgtttatttaaaatatttgccttgcttgttccatgatgtccatttgtccattcttgagaagggcaggctctcagccatcttgacgtcagcagccttgactgtaaacagaggtgtggccccagagagtagctct

SEQ ID NO: 111751 - DNA, 1100 bp, Homo sapiens
attttttaaaattccagagaaagtcattgttctgccaaagcaatgtggcaagacagcctgggacccaacatcggtgcccaggaggctaggagtaaagagctttagaagctttgaatctttttctaaaacaattaagattaaagaacttaatcaggaaatctgaggttatataaggggtgagcaggtcaaccagctcatatatctggtttggggcacatgctttggatgaccagacttttccatggaagattgtactttatgataattcttccagaatgaaagaactgacaagaaacattaaagtttgaaaagcgatccccaccaccaccgacatctgagaacatcctggcctctccagagacatctgactgagggaagcaggtgagccagcttgggctgcaaccccaggaagagaaagggaagtgggtcacgcctggtgaagtggcctatctctctcttggcaagtcaagctgactgatttggaggctacagactctaccttggctggcctggccacctcacaacctcctctccaaaggtgacatgtactacagcttaagacattacacggcacctgaagcaaaaactaaaagtagatatggaataaatcttctgaagctctaaggctcaatatccacagtaaattattattaagttactgagaagagaacattcactatttcagcaagagctacccaggaagaaccaaaagccttctgagatggtatatgaagggacaggaatttagggaatagacccaatttttcttttacttaatcagcgttgagtttttgggtttctaggagggcatagaaaacttgaactggagaagcaaggttcattggcatgtgccagttgatacttcactaagtctttactagtaaaaatgatgacatttatcttctttcttaagccatgtctattctgttccaactttaccaagaatgacagctaggatttgaaagtgtgcctatgttctttgctgaggacttactgcaaagtttctaacaacgtaaacttgacctgtgtttgactcataatgcccaacaaaaaaacactgctgttttgaaattatggacatagcaaagtatagattgaat

SEQ ID NO: 111752 - DNA, 1066 bp, Homo sapiens
ttatagtttaagtagagagaaaggacacaggacaagtaactcttaatatcagtacttagtttctaatatgagaatgaacctggtaggcagaaggatctttgggatgatgtgatagaacctgttcacttcaaaggtgaagaaactgtgtcccagaagtttgaagtgcctcacccaagatcacatggcccagtggcagcattgggccctgtgcccagggcccagagctctaagccaagtcaagtcctctctcaccactctgaattgctgcactcctcctttattagctagcagaccaagcaacattctgttggtttgcgcttcaggttactattttgggatgctcttatttagagattctttatgctgcctttagtagtggcagtaataacaccacattttgcatagcattttgtctcattctgtgtgggttcacgtagtatgtttctattaatccaaggattcactcactcaacaaatatctaaacacagtcaccaatgaataattctgaaacaaggtgaatattatgggagttaaatttgactatagaccttaagaaagggctccatgatggagagagcagggagctgagttgcagaaaataaaggaaatttgagcctaaagagagatgaaggggatttgggcaaagggagtttcaggtgctcatttacaaaggcaaggaaccaagagcacgatcattaagggtggacacacttgcattcagaatccacgcagaagttgtaagcacttaaactgctcttgttgaataatccagtgccctctacattgccagatctaagggtaaattcttagatcttttttttgtttgtttatcatttcaacttttattttagatcagtgggtacatgcacaggtttgttacgtgggtatattgcgtgatgctgaggtttggggtacaactgatcccatcacccaggtagtgatcacagtacccaataggtagtttttcagcccttcccccattctgcctccctgctcttgtattctctggtgcttagacctggtttgacctgacctgccagcagtgtctgactcagatgatcactg

SEQ ID NO: 111753 - DNA, 1016 bp, Homo sapiens
ggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaacaaccacatcctatccatggataggtctagtcataacactttagagagaatgtcagagcaggagggaggcaagccgcctcttctcggccat

SEQ ID NO: 111754 - DNA, 1048 bp, Homo sapiens
tctctccctccctccctcccttccttcctccccactttccttccttcctccctccctctccactttccgccttccctccctctcagtatttggattgtggtaaagactttatagaaaccattcatatacttagagttactctttttagacttaccagaccatcaatactttacagtggctcccagttgcttcctggagcggggtggagcagcagcagatgagcctgaagacataagccaacagaagatgatgtagtacttgattttcatgataagaaatttggattgtattcagaaagtaatggtaattaatgcatcacatatatttattgaacatttactatggacaagcactgttcaaggcttgaggatatagcagtgattaggtcagatgaagtccctacctttattaagggacttgtattctaatgggaggagatagataatacacacagaaataaagcagtgatatgtggtataaagaagatagagtattgtgaaggagagggtctgactggggacagttgctttagctagggtggtccactcaggcatttctgaggtgagaactgaaaatgggaaggagagaagcatgctgtcgtgggggatggggcaggctggggggcgcagagcatgccaagcacaaagaacagcagacacagagcacccgagatggaaccaagtgtggcttctttagggagaaagaaagaggccagagtggctggagcatggtgctgggtgtgagtagaacaaggcgtgctggagagtttaaaagctggtccattcacgtagatcttggaatgccgtgtcaagaagtgtagatgtttattctggtcattgggaagctctggacagttctaagaaagacagttcatctgattttacctttaaatatcattttggtagttacctggtctgtaagagacaaaacaggttttcttacacagtcgacacaaccctattcccctctggtcaccaaaatcctccagcagacaccagttgggtgtcttccaattcaattctgatgctacctggagttagaatcacat

SEQ ID NO: 111755 - DNA, 1688 bp, Homo sapiens
tcatattttttaaataattattttccaaattataatttagagcaaatttggaaattttctgcttattatagtgtgactattcaaaaactagtgcttttcttgcatagtaatgtattgattttcaggttaacacctttgttatttttcaggttcttacttagcactagaagaaattaattcttaaacggcatcttattgttattgtagggatgagcgaagagcctctctgtttactcaattttaggaacactctttttggaatttaattcattcctaaggcagagaagacagggaacagtatactaaacctaaaaaataagcaaaaatattatttgtgtaaaaattttggttttattaattgagatacatttctgactgaaaaataatgaaatcatgttgttattttgaattataagtatcaggtattcatctgattatgcctaggttaattttcttgcttgtactatttatactatttaatatttggaaactattttaaaataagctttttttttgctcaaatctgccttttcattttctgaattcagagccaccttaatagctttttagagttttcagtgaaaaaataagaagaaatttctacttttggaaatttttagacttatgtatgtattttcacatctttaatatgattttcaagggattatgagtagacaatgctacttgtatttataaggtttaaaatacttaatttgaattaatctcttttcagattctctgcaatgactgtaatggacgatccactgttcagtttcatatattaggcatgaaatgtaagatttgtgaatcctataatactgctcaagctggaggacgtagaatttcactggatcagcaatgacgagcctacacagtactggagaacttggcattttctgatatagaaaaaggctttccttggtatcgtgttatcatgtgtcgtcatctatgcattagagttgatgtgttttgtactagtgtcacagcataaaatcatattacaagtacgtaaggattcagggtctcttgatagacttatcatagctctatattgaatgaaagccactgtgcttgtgttttgattggaaattcctttagtgtcagttttttggaagccaatgatgtttgccactgatacattcatagaagtgtattatattttcatgaagctttgctttaagtgacactacgcgtgcagttcatttctagttcttgatagaactgcacttaattttcagtagtagtcttgactttttaagggctgtgttatattaagttctcccttactgttaaaacctaattaaatatgctttagaattttctaagacagtcctctggatcctctaaatgtgaattttgatgtaataactgctaataaaattatattgaaactgttttatagaaagttttttccaaagttttctatgtttggctcaattagggcagtatcatcagttctataatgtaaaagaaattttctttcttttgaggtattccataaaagtagttgggaaaattattatgtaaaataataagactcttccaaagccttaataaaaacatcaacattgaaaacagttttttttaggttgcccaaaattatttcttcaaagagtcattcattccttcatttagcaagtatttattgagcaactgctatgtggcagatatgtttctagatgctgtag

SEQ ID NO: 111756 - DNA, 1018 bp, Homo sapiens
aaatttttagaaaggaaataatatctgaataattttaaacaaatacagtctctttacatgagtgtattaagaaattaaggttgtttagataaggagtagcttaattagtttataaaaatatatgaagtgtattctacaaagaatatggactaattcctctccattttagagtactgaggaaaaagacttagttttaaataagtatacaggaattaatttaaaagttttatagtgtgaaagttcccaggttcctaagagattatcttgaaatggaggaaaatgcctgttttgaatggttcatgtggcagttagcctgcatcttcttgtatacctgaattaatatattcttgtttaatatttggaaaataacctttctatctctttcagaggctacagatgtccattatgtatgcactctgctttagatatgaccaggtattggagacagctggatgatgaagtagcacagactcctatgccatcagaatatcagaacatgactgtggatgtgagtagaatcaatacttaaaactttgtagactccttgttggcactcttatttttgccctcctgcttgaatttgccaaaaaaaaaatatatatatactggtttgacacagatgctaatgtgatgattaatggaaagcacaaaatgatttttaaattttagttaagtagctcagatcgggaaaaaaaaagtcttaagaatacctttatgtagtttttcccaacactagatggcaggcaaaaacttcattctgaattgtttacatattacttgccagagtcagtcagtaatataactgactagggttggatcactggtgggactttttaagtacattttatttttaattattttacattttatttcaggagaacatatttgctgatttttgagattacgttttggtttttagtgtttattaccctttttattccatcttagacttatttttatggagtgcacacaggagacccctttttcacttctgttgttcacagaatcataagcaagg

SEQ ID NO: 111757 - DNA, 1050 bp, Homo sapiens
ataatattagctagaacttggcctaaatagtaaagtggtgaggaaaattgagatgaataatgaacatatatgatgtggtaatggtattaaggaaaaagaatgaggcagagtaaagatgactctgaagattttcagccccagcttaaggtacttgattagtagattgtaaattttttgaagataaaagattgagtttggtttttaaacttgagtttggggtgatggcaagctatgctaatggagatagccaggagtcaatagtatcttatagattacatttctatgatgttctggtttccaaagcatgtgtagtgtgtgtgcacacactaattcattgcatcctcacctcagcatttacattccatcaactcagagatgccactgatgatcagatatgttgtaattgtggggatgttaaaatgtatgtgtgaggtgcactttagaatcaaatgaaatatgtattaattttattttataaataagaaacgttaagactaaagtggtggctagtccaaaatctcaagggctggtaaatagcagagctaggattacagtctagatttttaaacttactattaagcttattattttgagggtttttctccccactatactgtcatctttcaaaaacttacatctatttttttgttatggttttttttgttatgttgtttttcagttatcttttattgtctatattactaagtggtcctgccatctattaagtgcttccgttaaaaacctgggagtcttccatggcacagtgctttcccttacctccttggatttaatcagacattacatcttgtcaaattaagaactctggctctgaagttagcctgctggagctccagtttaattctgcctcttattaatgtgtgactttggaagttccttagcttctctaggcctccactgctttaactgtaaaatggtataacaatcatagcctatttcatctaggattgtgagatttaattgatcttatacaggtactgtgctgaacatggcatgtagtaaatttcaataatatgaactattattaccaat

SEQ ID NO: 111758 - DNA, 1573 bp, Homo sapiens
ggcataggaagccttcagaaatgagtggatctgcaaggtcacagtgtattggaaagtcactggcctggaaatctcttgatatacttgtaatggtaaagttgctgtaatgaaaaaacccaacagtgatgtagattaaagagtaaaggttttatttctttccatttaacaattccaaggcgagtgatgcaggttggtgatgaggctttgctccacatggtcactccagggatgagatttttctgttgtatcattttgtcatgttttagggcatgtggccatctgtctgatatagctgaacaattgtgcccaggaaggagaggatagattttggtggacaactggcagtctttgccgtgtttgaaaacaagggctgtctcttacatttgttgcattttgtgcaatattagatatgaggttgatgattaataaaagctagtaaaataagaatataatctttattatttttaatgtaaatgaatttatctggaaatgtctaagaagaggttgcctgtttgctgtttaggctcagaatgaaattggggtgttatattagtctgttttcacactgctgataaagacatacccaagactgggaagaaaaagaggtttaattggacttacagttccacatggctagggaggcctgagaatcatggcgggagacaaaaggcacttcttacatggtggtggcaatagaaaatgaggaagaagcaaaagtggaaactcctgataaacccatcagatctcatgagattttattcattatcacgagaatggcacgggagagtctggcccccatgattcagttacctccttctaagtccctcccacaacacgtgggaattctgggagatacatttcaagttgagatttgggtgggaacacagccaaagcatatcaggtgttgtgggattagtgtttcaatctagggatttccttcataattcttttgttttaaagttgtgttcaacttcatacagacgtagtgatgttgaagggaagaattaacataaaatatgccaagaaactagtgaaatgttatgtttaggatcagtttagcaactgatctattggttgtaatctttcagttccatccaggaggaggaggaagaaattttctttttgtattgcacacttagtttcttttgcttcttactatatctcttttttctccgtgggtgttaggcaccttgctgtgacaagctttatacttgccgcttgtgtcatgataacaatgaagatcatcaactagatcgctttaaagtgaaggaagtgcagtgcataaactgtgaaaaaattcaacatgtaagattttatgacatttctattttctttttaaaagctgtattaaggtggtttgaaaaaatttaatcaaaagtatcataaataagatttctttaacttctagaataagcaatatctttggtttaggtgtttcaaaacttataaaaataaactgcatatagttgaacataagttctagatattcaaatggtaactcaaaatgtttagtttattgcagtttttaattatgtttcttttttaggcccaacagacttgtgaagaatgtagc

SEQ ID NO: 111759 - DNA, 1049 bp, Homo sapiens
aatctcatttaccatcactaaataatatccatcatttaaagtgctgctttggattctctggagcattatgcattatagttgttatccaaagacttttttgaaaatatgcagaaatttgtggtaattatgtatttgtgtcttgtgacaattatgttttatagacctacactagtgccaggtcactattgtaagatgttaaaatctcaagaaaatttcacagagctaaagaaatgatgtcaaattagtcacattaagctatagtagaaggaattggacacttctccagatatttggcttcaaaggagtacctttacttacatgtgctttatggtaagtacattgaattttactttaaatgcattttactacaaagcacaattcatttgtaatgcatatccatcttggattcaatccaaggtgctttagctatcagtagtaccaaaggatctttttacaaggcttcctgtggtattgactctgagaataacacatagtgaagatctgtgggcttttaaaattgttcacagccaatttaagaagacccctcatgaagtctcagttttcagtacagtacatcattcctcctcactaggagcactttgatgtaaaccagaatagctttaaaaagacaaaaaggatcgtagatctgatttttaaatggttggttgctctgacagatctgaacactttgcttcatgactatttcgtcataaaggtatatgtttaaaatctgaatggcagtactagctctatacttttaatactgctttgtattttatatgtaaagtagtattgctgacattttaaaaaaatacaaaatacaaaagaaaccattagaaattaataactgtggctcttccagttgaaataggaattggagagaaaggattagaatattttaattaggggagtagattattgtccaaaggcttttatttagagaaacgggtaattaaaacagcagctttagaatagcttcttactgaatatgcaaaagaataattccttgttatttcctaattgatccaagtctcataaatttagctttt

SEQ ID NO: 111760 - DNA, 1331 bp, Homo sapiens
ctgacttactctgatgctaagagctcacatgattacactcggcccacgaagataatctatcctaattagtaacatttaacagctaattagtaacaattaacagctaattagtaacatttattccatgcacaaagtcccttcatatcggtactgaaattagtttgattaactagctagggacaggaatcttaagggcatagctttacaatcctgctgatcacagaatgtttagaccattaacatttaatgtgataattgatatttttgaatctagtcccatctttttattatttgttttctgtttgctcctctgtttttcctttccagttttcttttgtttttgaatagtttcagtattttttcggcaatatctttttatattttttttagtgattgctcgaggaattacaatatacatcactaatttttcgtagtctacattgtaccccttgaaataaaaagtacgaattgcccatccatttctccatcatccaggaaagacgttggttttgaggttgacatacctataaaggacagtaactaccatggcttccaccgctttggcaaaacctcagatgtgtggtcttctggccaaatgtctgcaatttcatattgttggagcctttattgtatccctgggggttgcagctgtctgtaagattgctgtggctgaaccaagaaagaagacatatgcagatttctacagaaattatgattccgtgaaagatttggaggagatggggaaggctggtatctttcagaatacaaagtgattttggaatgcaaaggatttctttgggttgaattacctagaagtttgtcacttacctgtgttcctgagctatgaaacatgaatatgtggtctaagaaatagtttctcttgataaataattaacaacaaaaaaagtaggaacattgctaacatattcccttcttcccagtttgcactttaagttagaacttcatatgtactacatttacatatctccagaaccccaatacgttatatgttttgttttaaacagtcataaatagtttaaacaatttatgagaaaaagttgtcttttatatttacctagctctttaccatttctgtcggtctctcttcttccctagattttcctctggtattattttccttcagcctgaaaatcttcttgttagcatttcttgcagagcaggtctgacggtgacaaatgttcttagtttttcttcatttgagaatgactttattttactttaattcttgaagtatattttattggatatggaatttgggttgacatatttttgtttttgtttttcctcccagcactataaagatgggattc

SEQ ID NO: 111761 - DNA, 1019 bp, Homo sapiens
gagatttggatacttaacttaggtttgcttttcctggtgaactacccaggatctgttcttgataaggtaattcaaatccaccaccaatccacttatatcaagtacaccaaaagaagaaagagttatcagttttgtgttccatgactctgaatatgtaagaacaaaagtggaattcttgattcctcttccatgagtttttccactgatgtgtgtgtatgtgtgtgtgtgtgtgtctgagtgagctgtgtgaattgcatttccattctttttgtattttcccaataactatctgaataagaatctggctttaattttaatcccctaggaagaataaagaaaacagtttcaaaaaggtgatacttatgatattctgctctagttgacaagtactttataagaagaggtaaattttcattctcttcagatcattaaccttattaatatttttgttaatgatcaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacaggtatgaattagtaaaataagatcaaaaaagtgtttaaggacatatttgcaaattgcaagggtttgtcaattcatccacattgtttttattctcagaattctggatgctattcattcttgtcaggtagctgtttcaaaagactttttggctgtgtgatgaagattattagcatttgatcaaaacaattcaccaaagtcctgagaaagtagggttttattgcttaaggtgaagagaatctacagctatatagtctaata

SEQ ID NO: 111762 - DNA, 1051 bp, Homo sapiens
gatccgcccaccttggcctcccaaagtgttgggattacaggcgtgagccactgcgcccggtctggaattgtgctttttaaagtgagttgtaattgttatgtgtgatagctcaagtattgctttattggaattaaaaatatatggaatttcattaacatgacatttagtaatttaaagttaatggcttcaattccatttgcgttgtctattatgaaatgtgtgtgaccattttgaaaacatagcttaatgtgtgtgaccattttgaaacatagcttacatgtagaaacactaggaaattgtgaattaatacaggacagccatgaacacagtgactaatatggaaaacaagcagggaagaattaatttgctgggaaggcggaggaaattaacgtactcaactttgttaaatctatgttttggttttcacagcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaaggtgagtaaatgcatatattgaatcaaaaaatatgagtataagtttcttttttggcaataagaagaaatacaatgattagatatgcaaattcatttatctggtgaatgtaaacctgattttaaaagtgtttgttccttctctctatatctttctgtgtatttatcaatcatctatctatagtctgtgttaggagtcccaaagaccaccccagatttgatgacttgttaggaggaatagcattaatttttgttctttattatttcattttttctacttatttgtatgggtttattttgcagcccttttccctaatttgttgagatagatgcttctctaatttccagacttttttcccctcaaatatgcatttaaggatatacattttcctgtaggaacagcttggtatgtatcctggaaattttgat

SEQ ID NO: 111763 - DNA, 7341 bp, Homo sapiens
tagctttctgagttgaggacatgttctccatatcctgttgggtgttttcagcatcctttgtaggctcatatatttgtctctccttggaccataaatatttgggtagtagaaggtctgaagaggttgggaatactgaaaatgctgttgtcttgaggaaaaggtaatagcagacgccgatgtaattttgttttaaaaataattatatgtttaattcagcagttggcagaaacttttgggaggcatcttaaactgtcctattactcccagacccctagttaaggaaaatcgttgggaccaatacttcaaatgcatatttttctcataaggaagaacagtagggagctaaaggactttaactatttgagatgctacatacaagttcctataagtttctgtcatttttttaacatgcattttaaccttacaggtagcaatttcaggtgttagagcaagctaatttttatactttgaactataaaaatactgattttaaggttatgggcagagatttaggcaatactactgagcactgttacatttgaaggatagcaaattagattttcagaaattatgtgttatgtattcttgtctaagatgaagatggcttttaattttgtttatgtatttacatggagtggttcatcttgcatttttgtgatttttttttttggtagcaataccttttatgctatttcagtgttgatataactttaatgaaaaaatgtgactgtaaaaagcaacttattgtgagttacacagcattaagtgggaaaacaaaagctacctacagtcctagattggtacagaatatcttgataaaaatttatttttctcatacataggacactatgttaaaaacattctaaacttaaaactactgttatgtctgctagtgacttgtcgttaggtgctttggttggtttttctccagtggagtgttttttataatgtttttttttctttatattttagccaagagtcgaagctaaaccagaagttcaatctcagccacctcgtgtgcgtgaacaacgacctagagaacgacctggttttcctcctagaggaccaagaccaggtgagtcagctcctttatagcctttagcatttaacatttgtaaggctgtaaaagactgaacttaaacaaaaaactatgatgcgttctatacacagacccatatagtctcaaattgcttaaagatgtgatgtgagcaacctgctaaatagtgtctggggccaaataaccaatttttagggaggattggttgacatgccatggtgacatattttgaaggtgtaaaagacttaagtcttatttggttattgtcacggttttttgttttttttttttgtttgtttgttttttttttgagacggagtcttgctctgtcgccaggctggagtacaatggcgtgatctcagctcactgcaacctctgtctcccgggttcaaatgattcccttgcctcagcctcccaagtagctgggattacaggcacacgccaccaggcccagctaattttctgtattttagtagagacagggtttcaccatgttggccaagatggtctcgatctgctgacctcatgatctgccctactcgtcctcccaaagtgctgggattacaggcatgagccactgtgcccggcctagtcactggttttaagagttcaaaaccaagctgccaataacctactctcttagcagtcttatctctttacagataaacaataagcccattttgattcttaggtattaagtaagttgccatgatttttgacttgtttaccttgttagctacacatgtaatacttttatttgaactctgtaagaatgtttagattgctttggggaggagatgggagagatggagatagtatatatcacatttacaatgtgaatttttaaagtgatatgttaccaaactagaagtcctaaatttgtcagtgattaaacttgggatcttgagtgaaacccttaaattctgagcttcttttatgtcaaatattacacaaattattcttgtattgcctattttcctcactgtgttccttgtgttattgggagaatcaaataagattttatgtatatctatatacatacacacttaatatgtatagactgcataaatgtgatgattgctgttaaaatttactgattgctgtaatgtcataaagccaaagaattttgaatttcaaaaaactaagcaaatatttagtaagctatacctcactatctgaaatctgcttggttcctgggtgatggcaacagtttggttaaggaggaatacctgtagtactaatatttgatttttgtataatccagtagatctagaagaagctattttagcaacctagtcattgtcctcactttacattttagtgtcatgctgttttctaacctactagtaataagtacttttgcctctttttcaagaagctcacctagtcttattaaactaaaacaggaatatcaatattaagtgatttttacattcactcctttgaagtagtttttatgatattgtaaactttagtatctgctctatttctattctcaggcagaggagatatggaacagaatgactctgacaaccgtagaataattcgctatccagatagtcatcaactttttgttggtaacttgccacatgatattgatgaaaatgagctaaaggaattcttcatgagtaagtgatttattttgctgttggagtttttaaattattttaaattaagcaagaggcatatggagcttttttaataactattttttttaaatgtttctctctttatactgtgtccagctaccagacccaccttaattgtgcagaagggagtagatgacttatctcacatgtttctcagtgactgcttagtgttgatttggcctggctcagtagtgtttagaagaaacagctggataaatcagtcataaattcagagataaaggattcatttggcaaatgggtcaatatattaggagaaaatacattgtctttccaaaattatgcagttaactttacttatgaaaggactaccaaagatgcagaaaggtaacacagcaggcgggcaggctacttggtatcttaggggattgcctgcttgagtaaacgtaccttggctatcactgtgtgtagaagcttgcgagttttattttaaaatggatcggggagataacgatattcatcctgaacaattagagccatcaaggtattctgttaaaaatatttaacccttgatgtaatgtatattttcacaggttttggaaacgttgtggaacttcgcatcaataccaagggtgttgggggaaagcttccaaattttggttttgtggtttttgatgactctgaaccagttcagagaatcttaattgcaaaagtaagtgatttaaagggcataattcaagactttattatttctgttgtatatattaatttggggtatttaaaaaccatagaaaatcttttaataataaagctaaaaatagttattaaatggtatttatgcaaagaataaagatttgttagtttgcagatcattttaaattttgttacttgctttgctgaagaaggtgggaaagattgcaagattgcatgttaagaattttggctgggtatagtggctcacacttgtaatcccagcactttgggaagttaaggcagaaggattgcttgagcccaggagagttcaagaccagcctgggcaacagtgagacattgtctctacaaaaaaagaaaaatagccggccatggtggtagacacctataatcccagctactcaggaggctgaggtgggagtatcacttgagcccaggatgtcaaggctgcagtgagccatgcttgtgccactggctgtcaccagcctgggtgacagctgagaccctatctctggggggtggggggctgataaaagtgttttattccttatgcttatctgactgacctgttcagagtaatcatttctattgctgtctaacctgcccatgtaaatatttttcttctcttttataaagccgattatgtttcgaggggaagtacgtttaaatgtggaagagaaaaaaacaagagctgcaagagagcgagaaaccagaggtggtggtgatgatcgcagggatattaggcgcaatgatcgaggtcccggtggtccacgtggaattgtgggtggtggaatgatgcgtgatcgtgatggaagaggacctcctccaaggggtggcatggcacagaaacttggctctggaagaggaaccgggcaaatggagggccgcttcacaggacagcgtcgctgaagctccactgttggcaaagtcttggcagtggtacattattcatcgtgtttgcattcttgttaattttttttttggctttggaatgtgacacagcctttttgatcatttctttgatgtgaaaagcatctttggttatcagttaaattgaggtggacattatttccccaatttcacaacaggattcacattgttaatttataaatctagacttggagaattaaggactgagaaatgaccatatcttaaactatctacgacaaagtgaacttaaaaggacatgcccactgaattcaggtcctttgagtaaaaaaaaaatcttctgctgcacattttgtttaagtgttactgtttctgcctgttaatgctgggaacacaaatagtgcaatttgtgcaattggagaatcttgccttttttcttggctccccccaaaaatacaaaccaacagaaacttgttatgcactcatcaaaatgtactaatgggtactctgaactcattaacattgacatctgcaacaggaggcaacagggaaaaaatctcatcttcttttccagtagaaaatagtttgtgaaatgatgagggcattttatctgcttgctgtgaccagcgtgtgtacacataaaccttaacaagactacaagtatattccagaaggaaatcattttagttatgaactaaataataaaaattagaacttcaaatgcgatggtcttgactattagaccagatttagtagctccatatctaagatttttctacctgcccctcttcagtacagggatggctggctgctcaacacactcctcctccccttttttcctttctttaagctgtgtacagtgaaaattgtctttactgtatttttgttctctggtaatgtaataagcatgatggtgccttctattaatacatcattccagtcttgctggtaattttgtacagtatagtgtatgaattgctgtgctgcaaagccaaacagctgcaaaatgttgaaaaatcatcgaaatgtataaaaattgcagtatctttaaaatcagtaaaatggactagcatattatttatcttgttcttcagttaacaactttgtgttctctgtgggagggagggagtcctgtgtgtttgtggggagagggaaggaggaagtcagttatttgagtaagcctctagttgacttttctcttagcctgaatgtggacgttgaaacatatcacttcagggcttggaaaagtcagtcaacttgacgtacatttttagtgacattttaaaagcagtcagattctataaatggcaagtaagcctgaagtgaggatactgcaattttcggagaaaagaacagcagctctttaagtgtttgcattttctatttggggggcagggaactgtcattcattttgcacaattcttgaactgatgtcagcacccgagtggctcctgaatttaagtctgggacgacatcttttatttttacatgaatctttaaacaattctgtgagcaaagtttgtagctgctggattattgtctgtctttatagcaagttccagtaaaccacaagtatggcaaagcttatccaattttatgcttggagcagtcagtacataccagtttctgatgtttcaggcaggagtggggtaaataagtgtgaccacttaaagctgctcgttagcatggaagacttctccattctatctttgtaaaacagacaagatatgcacttgacatagtagcaaattggttctgaattatgcaactgtttgctatttagtaaactagcaaatgatgcatgtattttgtttttcatgtactgggcaatatgagtaaaatctgtccctttttccccctttgaatgaggtcttccatgtttgagggaaagtcttgcactattgcatatattttggggacacagattttcatagtttccatttttggggggcttaaggattttttttttttctgtttgaaacagttttatactttctgatatagtacttgaaattcttaccagaaaattactttggagttttgaagcctttattaatactacttttaaagaagcagttgttttattgtcaatgttttttttcccccaagcatattttcttgtatttctgtttccatatatatatatatatatataatttccaattcaggatattgccctgccatccatgaaaactgttctggcaccaaaagtaatgacaaatgttaagtgtaataatagaaaagtagagcaaagagccattcagcttcagtctttacataccatgaataaaacattaaaacatcatatggagaagtttacatggtgattgttcacctgcagtactgtggagttttaacattttgtcctcttttcagtgaaacagagtaaaaatattcatctaccattactgttatttgctgattttgttttattttttgatggtaatattctatccttatgacactattgcaaccaaattggctttaccatcttggctttagtaggtatagaagacaatggattaccatctttattgctgtaatgtgttaagcattatatgctagtagaatctagtttaattgtttcaggtggaaagtattctttgagtttccatattgaatgtgtttggactaaacaaacaataaactactgatgtctgcagcatttatctatgtccctaatttaatctatagtttttattgttcccaaatgttttctcccagttgcatttcatacaaactaagtgggaataataagcagttgggttttaaaacaatttatttgtgaaatttgatacgtataaaaaaagtaaaacatttaagtaacacttgaccattgtaagagatctattccgtccagttagactgctggtatacaggttgaatgttagaataataagtagtaagaatgatgagaatgatctaaagcagattacaaccttggattttctaaagtattttctgccttgcatctcacaagaaaggagaagggaagggatgagaagattgaggttacctgaagttaatggacatgactcaagttcagaaattggaactaatttatcaagctctccaaaa

SEQ ID NO: 111764 - DNA, 1057 bp, Homo sapiens
atgtatcttatctgtatttgcatcaaagaggactcttaagacatgcctgattaaatcctagtctcttgcccagaaaaataccttcatatttatctcaagtagtttgccttaaatatattttcaaagttagttgtaggaaatgaagttgtatttcctatgccacccctttaataaaacaaaaattttaaatgtttagaatttaaactttaaaagaacgttctaatgtctttaggctatacttaaaatggattcatgatatttctacttgatttaataatccttcaattttagtttgttacttttgtgtagtattcatttccttgtactttgaacatagattattgataaaaggaagttaattccagggtattggtaggcattaacttagaagtaggtaagttaatttcttgaataaaatattttgtctggaaattgactagttcacctacaaagcttatgtttaattgaagggcttattatttgtggttatacctgcttttattgacttgatttgatggttctgtacttacttcatattctgtttgaccttcatttgtgggtttgtcatttgatcatactttctggttgcatggaattaattttaaggccctctactgtgtggcatattggccatgttatctgttcagaaaaactagttttaatcatgaaactggagacctgaagaattataagtatgcagctgacttagttaacatatgtcaatcagttactgaaagggacagtgttagctttttgttcttgtatttttcttaaactggcatcatcagatatctacttaaagtcagattcctaaatcaatggcatgaattatttgtaagatgttggaaattattaatatttaactttatctgtttttaattttcatccttaaagaataaggaagaactttattttgctacttgtagttactcgtgttttgataatctgttttgaaaagaatttaaatcagtcaagaccagggcctcaagttctttgataacatttggattgaatgagtctaaggtttttcttaaattttgtaataaaggtgcattta

SEQ ID NO: 111765 - DNA, 6120 bp, Homo sapiens
cccaagtagctgagattacaggcatgcaccaccacacccggctaattttgtatttttagtagagacggggtttctctatgttgaggctggtctcgaactcccaacctcaggtgatctgcccgcctcagcctcccaaagtgctgggattacagccgtgagccaccgcgcccggccggctttttttttttttccccaatatgattgttattggtaactgaaatttatgtttgacagtaattgtcagcataaattgtcaatagttgttcagtttgacaataattgtcaaacatgcttgagttcttaaacatcatttttgtatgaaacatggtgttatattacgatggctacaaaggagaaaatggtatgttttatatcattgatgtattttatacatgagatagttgagacagtgtattaagtttatacaaatctgagctaaaccctatgctataggaatgcacagaaatgtatgtttcctatggcctaacagggaaggaagactttgtgtagaggatgtgagaccacaagatttggccttaccaaataaggaattataagtagacaaaaaatagcatcagcaaacacacagtaaaattatgtgtaagttcaaggagccgtcaacacaatttgtgagaatgaccaaatacttactacagaaaagtgggagaaagctgtataaagcccagattactgcacaatattggagagctattgtgatttcttctttaggaacatcattctggcagtgatgcacagcatggtcgttggattcagttcaggaagattagttaatattgcagagttgtaaggaaatcaatgagggtaggtaatattattgtgtaggtaatgcagtatcacagagtttatatttttccctccctccctaataaaggatatacaccacaaagtattatctctgaacttcagtgaatgtcatactaaaattcgtcatgtggatgctcatgcaaccttgagtgatggagtagttgtccaggtcatgggtttgctgtctaacagtggacaaccagaaagaaagtttatgcaaacctttgttctggctcctgaagtaagtttctcaattcacttagttttcatttatatggttgctagttggttgaagtgtccagaggtttcttctaataggtttagatttgcatattgttatttttggggaatttgtgtttgacctgttgtttgagtgagtgcgtgtgtgtacatgtgctttgactatttggaattaaaaatcaaatactgatacaagtttgtaaatagatgattaagattacattaatacaaaaaatatattggtatatttgaaaggttacatttgaaaacaaaatagaagagttcttttggtttcttttctattaaatagctgtttcttgagttctactaggttggtgcaaaagtaattgcgagttttgctattatgtttttttgagtgacctttttattttatataaacatcatagcatgttcagcattggaaaattatattgagtcaagatctctagtattaaaatgagaaattgtgtatgccatgtaatttgctcttttatataataccagatttctggatatttatggaataaatgttgtttcctatagggatctgttccaaataaattttatgttcacaatgatatgtttcgttatgaagatgaagtgtttggtgattctgagcctgaacttgatgaaggtgaggttactttgaagatatgaagatagaagggttctgttggtactctttatggactaatttctataagtatgacatctacggaaatttgctgctttattgtaactgtgtcaaacatccttttttcatggttttgttgttgttgtcgttgttacaaaaagatgtccattgtttgaaaatatacaaaatttggatgtcaaggaaaaaggttcccctcagtctcatcctctgtagataaccaagtttggtgcctattggagaaggtttttggattctatacttggcaacatgtatttttataaatgtggaattacactgactcaaagcttccttttttttaatgtaataatatgtctttgttggctgtctatgttgtggctatgccgtaattatttaattgatcttccattgatgtacagtggttagtttctttatcattattgctctattaaatatatgttacaaaggaagctaaattgtggctttaatataacttttttccttttactgaaagatttgtttttttctaatagagtacaataaatattaaacttcatccttgctctccagtttttgagagaacaggggatattgtagttgaatgcctttgttattaaaaaaaaaaaaattggagccgagcgcggtggctcatgcccggaatcccagtgttttgggaggccagggcgggtggatcacttgaggccaggagttcgggaccagcctggccaatgcagtgaaaaccccatctctacttaaaaaaaaaaaattagctgggcatgatggtgcatacctataaccccagctactcaagaggctgaggcaggagaatcgtttgaacccagaaggcggaggttgcagtgagccaagatcacaccactgcactccagcctgggcaacagaacaagactccatctcaaaaaaaaaaaaaaaggaaagaaaattgtcaaattttcttttttgctatcataccacttccttaaacatgttaaaaatatgtccgttagaaattgtgaagcctctttaaaaaagatgtgctgtattatgtattttcagaatcagaagatgaagtagaagaggaacaagaagaaagacaaccatctcctgaacctgtgcaagaaaatgctaacagtggttactatgaagctcaccctgtgacgtaagcatactatttgcaaggttaaatttggtctgaactatgtcagcaaggtggtttctgttcctagaattattgttgaaagtaaattcttgataaaaccacctattatgtcagtatttgagtacctattgtgtatatgcaagaaatttggaaagaatggttttatttaatacaaaaattgaacatggcttgcaccaaaacagtggttccttactgataatgtagagtgttgaagacaacacagagtaagcattttatttttataaaagataaggtttatagttagcactaaagtaaacattcttagtaattcagttttgaaatggtgggattaaagaactgctacttgagagtattattccttctgtcttatagctctttttggaattttgctttgaatactttgtagatctagaacaagttattggcatataactagttacacccattggattagagagaaattgaattttttcttacttgaactcctactaaaaagtgaactaaatattttattgtagtaatggcatagaggagcctttggaagaatcctctcatgaacctgaacctgagccagaatctgaaacaaagactgaagagctgaaaccacaagtggaggagaagaacttagaagaactagaggagaaatctactactcctcctccggcagaacctgtttctctgccacaagaaccaccaaaggttagatcaaagaactctttagacttacaacatcacatgttcaaatttggtgctgttaatgaagtatgacctttttctattatgttaaattgtttagtaaattattttatgtatatgaaagaagctgtggggtttgtttgttacctgagaaaatgttattgtttccctgccccgcaaaatacccctctaagagtgaaacttataacttaagatgaatccttgtctgtatgcattgtttagtaacttatatgaaattatttggatccatgtatagagctgtcagttgttctttcattctgtattaaattctctgagcacagatgcaccaggaatcatgcagtttcccaacttaaacaagttggtctataattaaaagaagagatacctgttgtttgtggtttaaatgggatcagtttcctttctacaccaattaaactatcttggaaagatgagtgacatccttagtgtatcatgtaagcctacctgaaacttcttttatctttcttcaaagtcaaaggttaaagtatatttgagtggtgataggaggagattctttgttcaatttgtgaatgtcagagtttccagctaatactctcttctttcctatccttccctctcccgttaacaccatcacacaccctatcttacccccaaaggggaaataaattgtttctattaggttcaggtttttctagcatgtttgttagtggttttgtttgccacttgctcatctacttagagtacgtaggaacttgcttatggttttacttagtagtcagacaaaagttataaataagcttgcataatgagattttgaaagctggcacatagactggcatgtgtgtgtgtgcctttcttttaggagtcttccaatatagagcaatagtttagaaatgaaaagaaaatatatatttggaagtttccctataggaatgttggtggttttccatgattagtagtctaggtttgttgcatttcctgcaggctttctcctgggcttcagtgaccagtaaaaacctgcctcctagtggtactgtttcttcctctggaattccaccccatgttaaagcaccagtctcacaggtaaccaatctgtgaacacattggattgtatccttgttacattgccaattgcttatttttaaaatacttttaaaaatgagtcaatcagaaattatggattaaatatacaaaaaacttgtattatatgtcagtgcacccactttaaatgtcaaatctccattcatcatctacataggtggtatttggggtttgggtgtgtgaaatacagattaagttggtttttaccagtatataatattgtcatttaaaaggcttcttaaaataacaaaaagaatgttcctttttcaaaagcttcaaattctatttagcaaaaatattttaggtaagaaattcggagaggcacaaagtagtgtggcgtaataaagaatcgtttttgtttttttttttttttttaaagcaaaaaaaaaaaaaaccaggaaactttttaacatacgctgcctaagctctcagtgtgtaagtggttcacaccacttaattgaagcctgtaccaacttatgactgtagtgttcaccttaactgatcattctagtattctgctttttgtctgtttgtcatcttacccatttcagagctttcaaaaatgtgaaaataagacactgcctacctaagaagtttgttagatttagtttagaatgaactaaattctaattaagtttatcagcatataaagggtgtccaattttttccctacattttgcattaaacttcattccactagaaaatttatgtttgaaatgttagtatataaatgtatcttttatatgttctaagcagtgaaattttgaggttttaaaagtagtaatttttagttttttggtgttgggacacataatcagctacataaaagtagaatacgcccgtgatacttttttttttttttcatttgggtattcaggcaatgcgtggttacccttatgtaagatggtcacccagagttccatcttaacaaaggaaattagtttgtgcagtattgttttgtgcttttctacccatatgaagacccaataaataacttttggcccttcttttggaatcttcatttcctatcagatttggatttggaacctttggattatttcatttcagagagtttaaacagttaaaagttaaaatagctagtgcttatgcctttgatatgcgccaagcattgtgtgaagcactttttgttcattttcagtgaatcctcacaaccaccctgtcagggtgggtactattgtttctgttttagagatcaaaaaattgaggtctagagtaactcacagacatttatgtacatagtagggttgggctttgaagtcatgcagtgggacatgagtccatatgtggctcatgtaaacgtttatttttttgagacagagtctcgctctgtcgcccaggctggagtgcagtggtagtggcagtggcgttatcttagctcactgcaacctccacctccccagctcaagtgattctcctgcctcagcctcccgaatagctggga

SEQ ID NO: 111766 - DNA, 1047 bp, Homo sapiens
cgcgctgatggaagcttaatacaggaagtgtgggagcaggctttctggaggggatgttttagggtgggtagcccaccgttcctgtttccgaatcgttttcggctcttgtaccttgttccttcggagcggagaggccgtcgccaccccgcccgtggggggaggggaaaagaggttgtgtcgacggaggcagaagcgacgcagatgcgaaagtggcggcctccgggcaccatttctgtgcacggaaacagaatccgggtttgaaggcagccgccgcttcgcttacccagtacctagtgttccgtcgtgtttgaccaacccccctctccctgccaccgcgggtttaatccgaacgtgttcggatactggaactgtaacgtgcgccttcttcgtccccctcttatgcagacgatcccttattgactcgggaatggcttttgggggatgggttcccgcttttgttgggatggggggacagaaaggaacagaagcttccctagattgtgttgattttgttagtggaatctgatagaatttttcctgcgtctctaaaagcagatttcttaagatggccctttgccgctttggggcgaatatagattttcgtctataatttcctgcatagatcagcttttttccccaagacatacttaatgttctaacggatttggggggtgggaggagagtgccttttccttcataacaacaacaaaaaaaaggcacttgcacttttagctggaatagtaaagtcctgttctccctgtatgattgttgtgggatattaacttggattaagatactgtggttttaggttcaaggctctgtaccttgttctggtctttcaaacgttagtgttgcaggtacctggatctaggaaacattaactgtcgttaagagagccccggtgtactagagtgggagatgatggcaatttttctctagctccatatttggcagttaatatagccttaggcatgtgaaccaagtttctaagtaaacttttggccctgttagcatccagtggtctttttgataatccaagattcctgg

SEQ ID NO: 111767 - DNA, 1358 bp, Homo sapiens
ttttttgtaactttagtagagacagggtttcaccaggttcgccaggctggtctcaaactcctgacctcgtgatccgcccgcctcgtcctcccaaagtgctgagattacaggcgtgagccactgagcccagccaagtttttttaaagtgttgtaaattttgagcgttaagtaaccttagagttattctactttatctttccattttgcagataatgaattttactttaaaagattatatttaagggacagtccatcctcattatttgtcaatttcttacttgcaaattcacctactcactaaaatatatttgtatcgcacaaatcagtactttgagcactttatggttatttgtagatggtacagcagtgaaaaatttgattctcccaacatacacatctccaattgaggtcaaagaaggtgatgctttgccttcttgtttcagttctcatgctgtaagtgtgtcctttcatggtctgtttagtgttatgctttttgcatttttgtattttatctttttcttttttttttttttttttttgagacagagtctgactctgttgcccagggtggagtgcagtggcgtgatctcggctcactgcaagctctgcctccgcctcccgagtttaagtgattctcctgcctcaccctcctgagtagctgggtttacagtcatgctccaccacactcagctagtttttgtatttttagtagagacagggtttcaccatgttggccaggctggtctcgaactcctgacctcaagtgatccacctcagcttcccaaagtgctgggattacaggcgtgagccaccacacccagcctcatctttgtattgttttgtttgggatttccctattaaaaatagaccccgtgtagtgttgtctggtgttcctaagcacaagaaggctgtgatgttccttacagaggtgatatgtatattatgtaagcatcactgaggcatgtgttatagtgctgttggccatgagatcaatattaatggtcaaggatgtatattaaataagatgtctttggccacatgcagtagctcacacatgtaatcctagcactttggaagacagaggcaggaggaccacttgagctcattagttcaagatcagcctgggcaacatagtgacacctcatctctaaaaaaattttaaaaaggtgtctttaaacagaaatacacataaaaggttttatattgatcagttgatgaaaatgtgatcagaggcttgcgggaaactaaccctgtattttctctaggaccagtgggttttgtttttagagatggagtctcactctgttacccagtctggagttcagtggcacgactgtggctcactgcagtctcaaact

SEQ ID NO: 111768 - DNA, 1045 bp, Homo sapiens
cttcggaaatacattttttagcttctcaggattcaaagtaaaaaaacaaaatacattttttaaattgccgccttatatgtatgaatttgccatactgtgtttttttattattgagcatttaggttgcttctaaattttcacaattagaaataaaactacacattttttacagtttgcactctgatattttcttagagtatgcctttagaaatggaattttctaaaattgctaaataactaaaaatggtcataacagtttatactctcatcagcagtgtataagtgtaataatttcttttttccagttcagattctgaaataataggttatgctttggacacactatataatataatatctaatgaagaagaagaagaagtaggtaagtttccagttatttttactgtgttttctgtacttaaaaccaactgggttgtgctaattttgctggttttaaagttggacttgttttataaatgtataagtttttttacttttttcattaaaaaatttaataaacacataggcttagatctagaaaagtgtctttaggatgattgctttgtgtgtaagtcagaacattatagtgagatggaataagatccttctttttaactaatatttttgcccgcttgtgtttggttttagttaggcagtatgcatattagccagttctggattaaataattatttatggctattgattgaaaatttatattattatctagtgagcaatataaaattagagagtttttcctaataaatacttaaactttttacataggacttatgttaatttataaagtgcaacaattttttaaatttagattttttttctttacattttgtctgtttggtgaacattgctataaatcggtttgaaatccacacatttctttggcacattcattttcttttttgttttaaaatatttgcacacttaacataaagttatctgtcttatttattgtcactgtgtgaagcttgattggaagtctgtatacattttgtcctgtatacattttgttctatatgttgcaaaaca

SEQ ID NO: 111769 - DNA, 1640 bp, Homo sapiens
tattaaattgaaattctttatttttgaatattacagaagaaaattccacaagacagagtgaagatttgggaagccaatttacagaaattttcattaagcagcaggaaaatgtcactcttctgttatctttattggaggtaaatagggaaccttgatgtttttgtcatcttaataagctgcttttgttgccttttggatgttattgaggaagtaacatgtatatacctttaaaggtagtaaagtttattgtattatagcaagagatccacatggatgtttcaagaactatgtaatcacttaaagtatgctaaacttccatgttttacttgtagtttctggtaaaagttattagtggaaaaaatgtttttctcgaaaatgtgaattacagatgttaaatattttgaattcttacattgcaggagtttgatttccatgtccgctggcctggtgtgaagcttcttacttctcttttaaaacaactagggcctcaggtgcaacaaattattttagtcagtcctatgggtaagtgacttatcttttttatattattttgattcaagcatgagtatcatttcctagagaaagggactgaaatggtgtgttagtaaattgttaataatttgagtcactatttgtatttttggtctgccagcatttttcacatggttgtatgttctaggtgtttcaagattgatggacttactagcggattccagggaagttatacgtaatgatgtaagttaaatttcaaaaagaaatacaaaaatatgtggcttttttttctcttgcaaatgaaatccttgttgttgagttttaggaaattagatttagaaagctggagtaatgacctttttttaaaaaaattaaaaattagtaaacagagatgggggtctctctatgttgcccaggttggtcttgaatttctgggctcaagcaatcctcctgtcttggcctcccaagatgctgggattacagacatgagccactgagcgtggctggagtaatgaccttttaaagttgtacaaggccacattgtttcattctttcctggctatccagtattttgggttagacaaaccattttgccattcaaatttatttcttccattagtttaggatttcttatactatctgctgaaaggttgtatttgacaccaaactctacctctgcaattttcttttcctcataaagagtagcggagatacctccagacattgaactgtgtaaacccaacaaagcattatatttggaatccttgcccttatttgattgagtgtgtatttctaaggatttgccttgttaatcatggagcatgatttgctctggacttattttccattccgatttattttatatttgcatataagtttgaatattttgtatttgatgctgtatattttgttgcataagcatttttctctattgttacctacaacttgataaaaattctgtaatatttaaaatagcaattagaaaaattaaattctggagctaggagatcatatcaagctaattaaatctccatatttatagtgaaatgcccaagacccacagaaaccaagtaaagttaagtgttctttgttagccatgtcttactcatctttttatttatggtattggccgtgtgactttttcatcc

SEQ ID NO: 111770 - DNA, 1045 bp, Homo sapiens
taagagcatgtagctggtgacgctaacctagtcctgtagtcttggtaatcattcctgaagaaatgatgtttaagctgggatttgaagataaacaatgagttactaaggcgattggttacttgacatagaagtcaagagatctttggggtacctgagaaagagcatgcaggttatggcctgtggccatcaggtgtcagagcagactgtctatctgcctggccatattgaagagatgctgagcatggagatttatctttttaaaaatgtttgggagttttgcgtcaggttttacgagccttaacgcttgtgttttacattatttccccaggtatagtagttgaagattgtttgattttgctccaaaacttattaaaaaacaacaactccaatcaaaatttttttaaagaaggctcatatattcaacgtatgaaaccttggtttgaagttggagatgaaaattctggctggtctgcacagaaagtgaccaatctacatctaatgctacaggtatactatccttagacataaatgtggtaagaattttgacagtgatcttttcaaagagaagaaaatcgcttgtatttgataaatccagaatatttgatggatttcaggttggcttaaaaaaactgtaatatggaaatttgcagttatcctctagctagagatcttgcctacccattacttagctttgacagttattaacatctggcaattttgtttcatcgtttattcctctctgctgtatgattttaaagcaaattcagacatacagtttcctgatgggttttacattaaggaataataggttacattgttgatttgaatttttaaaaacctgctttcttcacttagggctctaataggataaattttaatattcaaactattaagttcaaataaattcattcagtaagcatttactgagagccaggcactggatgctaggaaataaatgatcatgtcctgcccccaaagatgattagtctgagttttaagtccaaaacatgttaaattgacagaccacctgtgatttattgatcct

SEQ ID NO: 111771 - DNA, 1061 bp, Homo sapiens
ctaggcaacatggtctttatcagcccggtgtggtggtgtccacctattgtcccaactactcaggaggctgaaggggaggatcacttaagcccaggaggttgaggctgcattgaaccataatcacgccacgcactccagcctgggaacagagtgagactctatctcaggaaaaaaaaaaaaaattaccaaaaaattattagagtacagcatgtaaacagaaaaatacagtattctcgttatataacaagttgattctttaagaattctttacttttaaaaagtgaataaactgactttctgtagcttagtaaagcttttatctcttacacttgtcgtgaagaccgtaaactccaaagcagaggaactgagtttaattcattttaatatattctccacctgcaatactgaatagtagattcactcatgactttacaggccaggagttatcttctgctattctgttagaacctgttggaatactttatgtataactttatttagagttgcttggattttaagttctctattatacactaaataaaaatgcatcattgttttcctgttgggacatacacattctgtgttggaactattcatcatcacagttatcatgattgcattctgagctactaaaaacagaattgatctgcttgctgagttttaattcaaattttgcagactatatttagggaaaacatcttttgaaaagttttttagttataaaatattttatttttttaaaaaattatagttttatggctagtctactttttatccctgcaggagtctcttctatggcattttattgggaagatactgccaatagctcccagaaagttcataaccttataagataatcattttcattctagggtagttttaattattagaaactttatatattaagtcataaactgtcctgatatgacttctgtaaatttacttttgctttctggaatgacacatgttcattccttgtgaatatttcatatatttacatgttgctattagatctctttttatcctcataaatattccctttttctttatttacatcatca

SEQ ID NO: 111772 - DNA, 1484 bp, Homo sapiens
tttgtttcccaccacaggccacctgcagaccctccattctcctactccaatctgtgctctaattcttccccatgtctcttgtcctgggaattttttttgccatcttcctaggatttcctttacttgtctcctgacttggcttccttgattatctggatcctatatctttatttatttatttatttatttttttttttttttgtacagagtctcagtctgttgcccaggctgtagtacagtggcatgatctcagctcactgcaacccccgccttccgggttcgagcaattctcctacctcagcctcctgagtagctgggattacaggcacccgccaccatgcccggctaatttttgtaattttagtagagacagggtctcaccatgttggccaagctggtctcgaactcctgacctcaaatgatccacccatcttggcctcccgaaatgttggaattacagacaggagccaatgctcctggcctggatcacatatctttttcctctatcccttggttcattaactttatttttcttaattttcttttcttttcttttcttttcttttttttttttgagatggagtttcgctcttgttgcccaggctggagtgcaatggcatgatctcggctcactgcaacctccgcttcctgggtttgagcaattcttctgcctcagcctccagagtagctgggattacaggcgactgccaccatgcccagctaattttttgtatttttagtagagacggggttccaccacattggccaggctcttgacctcaagtgatccgcccacctcagcctcgtgaagtgctaggattacaggcgtgagccactgcacccggccgttatttgtcttaattttctaaaaaaaagaataagtaacgagaaatttttttattttttgctctttcatgtctgaaaatgtcatttctctactttcagaattaatttaatgtttggctagatatggaattcagggttggaaatcactaatactcaactttccaaacatcattccagtgttgctattaggaagtttgaagtttgaagccattataatcctccttttttttttattgtaatctttttctctctagaaacttttgagatctgttatttttgattttctgaaatttactgatgatgtgctgaactgtggaccttttccccactcccttgctccccagttattatcatcattcactgagcactttcagctggaaatatacatccttcagttctgaggatgtttttggcattgcctgataattttctcttttctgttttgtgttgctgttgttgttgttttgaggcagtcttgctctatttcccaggctggagtgcagtggcactatttcggcttacttcaacctccaccttctgggttcaagcaattctcctgccttagcctcacaagtaatggggattataggcacaccaccttacccagctaattttgtatttgtagtagagacagggtt

SEQ ID NO: 111773 - DNA, 1901 bp, Homo sapiens
ttgcatgtcttagactcctaatgagaacaacaaagctttattgaagtgtagttgctaggcatttaggaatgtcactttttgttatgtgatttccccacatgtaccagccttgctattgaacagttcaagttcatgctttagcaaaactctaaagtcattgacgtttagagtcactcagggaaagtaaaaatgtgactaaatctaaaattgttctgtacactgctctagcagtagttatcctacccactccccataataatgtggttgtgtccttctttagttttaatcctgccacactcgttgaatttttccttattttgagcttttaaagaaacattagctccatccatagaaattataaatgaaagcttaaaaagtaactatagtgaaaaggaagttgaagtttaaaattggtttactttaattgaaagcttattttgtctttatcacttatctcttagagattaaaaaaactatcccaaatttttatgtctttacttattacttggcattctcatgttgctatctgttaacaacagttttattttaaagccaaacagtaattatctctctcatcaccatcaccacagacttcactttaacattgaaattacaatgaatgcctgatgagaagtgctaaagatggtggtgtcttccccactcttaagtaatcacagtgctataaaattatcctttatcttctaaaatatatagcctctaaatgtatcctctaactttttattgtataaaagaagtatcattagaaccatcctgtcccaaattattggcttgagtttgtagagagactatgaaaaagtatttgagggatttttccagatttagacttttctaaagtagtaatatgtatgaataatttgtaatgtataatttgcagggtgataagatcgacagacgggtatgtatcacttgattaagcttaggcattttcctcttatagcaaagctttttctctgtcttgggttttgctgattggtttttttttaactgcttgtttgaagttacattctactcacacttttgcgtgtcagccaatttatttctattgtaaatggctctccagtttttctccatgggatattgtattggtgttactaaacactgtgggaatgagaatctgaatctatacttgtgcttcttctggggatgcttgcactttctggatttccttggtttcggttttttgtgttttttctccaagcttgcctatttatttcctctgaagccatttcaaaggaagtagaattcaggattaagaattttgtctttaattaatcagcatatgaaagaatctgatgatgatttttatactagattatttaaaatgtgcaatagtaagtataattttataatttgaaatattttaaatgaaatattatggattattctgaatataatccatatgctacagctaccactgaggattcgtttttgttgtgtgtggggaaagtgctatttttgttttgttttgttttgttttgttttgttttgtgtgagtatttggcagaaaaggagtgtaccttaatatctatgtttgggcatgggtttcagttgaataatgtgggtagtaataaatgaggtcctgttatgaattgtatctttgtgtatgagcatgatttaacatgtgtcattaacttacacacacacatacatattttgcagctttagcctgcagaattttatattagggaaagtattttataagtatacatgtcagtcatttgaaagggaattttttttgaggtattaatttatatacaataaaatgcacagaccttctgtgtttcatgtgatgatttttggtgtttgagtgtatctctgtaaccaccacccaaaactagatgtagaacgttttcataatcccagaaagttccatcatgctc

SEQ ID NO: 111774 - DNA, 1038 bp, Homo sapiens
tggtgttttgttatggatttttttttttctcagacttatcttttatggcttctgcattttaagtcatacttagaaaaggcctttccatgttcagattttaaggaatttactaggccaggcatggtagctcacacctatatgttaacactttggaagctgaggtgggggcatcgcttgagctttggagttcaaggctgcagtgagctatgattgctgcactccagcctgatagacagagcgagacctggtctccaatccccccaaaaaagactttataaggaattatacttcaatgtttatcttatactttctggtttctttttttttcatttaattctttgttctgtttttctcagcgaactgtatgagatacagatccactgatctttttctagatagctctccagttgtcccaaaatcttttaagtctatttgtaactcactgatagttgtatgctactttttcatatattaaattctcatttgtatatgggcccatttttctggatttttgtattctgtctcttgattcctgcttgttcgtgatccattattctctcttttttctttttttttacagtgtccctagttaatctcacttttttcatatgatcttcagaatcatgttgttttgttccagaagcaaaaaaaaaaaaaaaagccttttagtaatttttatttgaatcacattaattttattcatttatttatttttaatttattttacaattattattttttttgaaatggagtctcactctgtcacccagactggagcgcagtgttgtgatctcggctcactgcaacctctacctcccagattcaagtgattcgcctgcctcagcctcctgagtagctgggactacaggcgcgcgccacctcgcctggctaatttttgtatttttagtagagacagtgtttcaccatgttcgtcaggctggtctcgaactctggacctcaggtgatccaacgcacctcagcctcccaaagtgctgggattacaggcacattaattttataaattaacttagaattaac

SEQ ID NO: 111775 - DNA, 1032 bp, Homo sapiens
tgtaaatgtgttgtattaaaattttgaaaactaattttgctggatatgctaattttcattattaactatacttggcagctgttaatggtttgggggcacttggctaatttaaatcttcctcttgattatgtttgtgatttctcatctggtgtgtgatgactgaatttgtagtatggtttatttattgttagagaatatattctctcatggaatttgactaaatgattcaggggattattttttgcatttttcttgatttttttgttttttggttttttttgaaggaagtagaattttccttttatcaggaacttgtttttaaacttgtgactgaaatatcataaatttgcttggcaaatttattgtaaagggtcttgggattaatagattattttaaagcctccacactgatttttttccttagcagacaaggtttttaaactaatcatattttaaataacccagtatatgcctctgaacatgaatcagttctaatttctgcactctgttcattttaggaagtgcagcctgtggtgcatacaataatttattctcttgtttagttttttaaaactggatttctggctcatctcttgtaagatgttaaagttcttttcatgcaaatggaagggatcttagggcaactttaagtttgaaaaatataaaatgaatggaaagatttctaccaatttatctgttgcagggaagcaaaatacaaacaagagttggattattaatgttgctttgtacctggctaagcaattgtcccattgcagtaacgcattttcttcacaattcagccaatgttccatttgtatcctttatgttttagtaacgtacatgtaagtatttatatcttttttagtttttctcctcaattagaagtagttctatgcccaaaatatttgaattctccactatcttatctgtgttgcaactttttaaactgttaaagttgttatgatgcttgtttaagttgtgtgtgtgtggtttgttttatgccgggttggaatatatatatgaaatttcttt

SEQ ID NO: 111776 - DNA, 1971 bp, Homo sapiens
ttttaatattaaaaataatatagaagcatatgtatacatacatatactaaatttcttaaatagtttgatgtaaatttttaaatggttttatgaccataaaatggagttttttcattttatttcccactataattgcaggctatgccatgatgtttattaatggagccttctttgaaatcttgtagttctgctgcatgttaattggccttgatggatatattaacacaccaagttgcttaattactgaacgattttggaagtgttaagcactttagcatactgtcccaaaatgacctctaatttttaaaatgtgttcaccttcttaatgctaacgagtatgactttaaaacacatgaattatgttttgtttcacaggatctccaacttgaggaattaaggcagcaggtttctacattaaaatgtcaaaatgaacagctccagacggcagtcacacagcaagtatcacagatccagcagcacaaagaccagtataatcttcttaaaatacagctaggtaagcatagctaagccatcactatgatagcactcaggtcattctttcctcaagagctagacaaagtaaaagattctttctgtggactagtatttttctaaccttaatcatggtgacaaaaatgtaaatcggagtttaaagcaaaatagcatgatagttaagagcagttaagactggacctttagagattgaagtccaagcttcttgctacctgtttatctggcccattgattctcaaccctggctgcatattagaatctcctgagatgcttttttaaaaaaaaataccaatgctgataccacaatagtgtttctgatttaataaatctgggattaggtccagggatcagtaactagtataagcccaccaggtgattctaatgtatagctgattaagaatgaccgctgtaatctttcagtttcctcttctgcaaaatgaagatagtaataacatttgagaactaaatgatataataaatgaaaaatttaagttgtgcctggaaaatggcaagagctccactgcttttaaatagtattatcctacggtgcttgtgaagattttttaaaaggattttattttctcatattcagttgacagaattggaattaaaattactgtaattcttaatcatagatcaccagaccatgcagtttagtcaaggctgtgctgttttttctcccagaaatctggaaaatactatcagttcactatttttatcagtataccattctgcaaagatgaaatgtgattgcaaaagtgctgccaaagtaattgaatgaagaaaattacatatttgaatcttctacttcaaaaatgaaaaactgaagtttcccgttggcttttaaaatgttatgtctgtctaacaggaaaagacaatcagcatcaaggttcttacagtgagggggctcagatgaatggcattcagccagaagaaattggtagattgcgagaagagatagaagaattaaaacgtaatcaggaacttttacaaagccagctgactgaaaaggactctatgattgaaaatatggtaaagtaaatgtttaagaagttaaaataagagttcaagagtggttctcattatcctgccttttttttttttccttggatctcttaagccagaatatcatatgttaagattttacaggatgggccaggcacagtggcttacgcctgtaatcctagcactttgggaggctgaggtgggcggatcacctgaggtcaggagttcaagactagcctggccaatatggcgaaaccctgtctctactaaaaatacaaaaattagccgggcatggtggcaggcacctgtagtcccagctacgcaggaggctgaggcaggagaatctcttaaacccaggaggtagaggttgcagtgagccgagatcaccccacttcacctcattgcctgtgcgacagagggagactttccatctaaaaaaaaaaaaaaaaagat

SEQ ID NO: 111777 - DNA, 1047 bp, Homo sapiens
tgaaaaactgttattcaggagtgtctcctctagcacttgagaaaagatttgcatttcactaataatgatatttggctcaatttatctacctatctagggtggtagtatggacttataggaaatttatgaaggaaaggctttgaaaaatattctgtgtttattaaatgctgggttacagttacattagagctgccttgctgattacttttctgggcttacctaccttgaggcaccttagcccagccttcctcgtactcttatgagatttgatgctcttccatgtgggaacagctcatctgacagtggagagcactttgttgcacataaatacataaggaattatattttctgttagtgaaagtaaaatatcaaaatggcaaaaaaattaaataaccctttgggagttcatattgattgtaatgtttaagagacatctttttttccaatttctaatttcaggcaaaatcagttgaggtacaaggagagaccgagactataatagccaccaaaactactgatgtagaaggaagactgtcagcattattacaagagaccaaagagttaaaggtttgtttttggtgcaacttttatttactgcatatgatatgaaatgaactctaggaaattttatatatctttcaaattcttagatttatgaagaaagctaatgatgtgtaattttatctcacaacattttcactcctatattgatgatttaagatggcacaaatgaaaattttttttgttttgggtttttttgttttgttttgtttttttgagatggagtttcgctctgtcaccagactggagtacagtggcgcgatctcggctcaccacaacctctgcctcccaggttcaagcaattctcccgcctcaacctactgagtagctgggactacaggcgtgcaccaccacacccagctaatttttgtatttttagtacagacagggtttcaccacgttggccaggatggtctccatctcttgacctcgtgatccacctgccttggcctcccaaagtgctggaatgctggaattacaggtgtg

SEQ ID NO: 111778 - DNA, 1038 bp, Homo sapiens
agcctggccaacatggtgaaaccccatctctactaaaaatacaaaaattagcagggcgcttggtggcaggcacctgtaatcccagctactcgggaggctgagacaggataatcgcttgaacctggcaggcagaggttgcagtgagccgagatcgcaccattgcactccagcctgggtaacgagcaaaactccatctcagaaaaaaaaaaaattatcagtagtatatattgttaaatgttgaatgtgacatgaacagattttcacaatattaaatacgtctttttcctctaggttgaagaagaggatgaacttgaatctggagaccaagaggatgaggatgatgaaagtgaagatcctggcaaggatctagatcatatctagttttcaaatctctaggaacaatagagattatatcataactctgaagatggactctaaactttggtttacctccatggaaaataaagatttagaaaccaggtggaaaacattcactattaagactattgatatatttttgtaatgttgccacccatgttgaaaaccttaaaactgaatttatgtagaacacacatcttttatttaaatccatctgaactgtcccaaaatgtaatttgcaaagagcttcaaacaccaaaaatataccattttaaggcatgtggtgacaatgctatttgccttagttcattcgttgtttactttgcaaaatttgtgacttttaagtactaacacatttgattgaatgtgtattgaattggaattattatttctaaattcagcatttgagtccttagttgatgattttcttttaaagaaattagtttatttaaaagcaagatagcctgggttgggagttagtgcatatcatcagccctccatctaatgtgattgctaagatgtgcaggataggacagcttagaatgagtgccttgacacctacatatggctgcattccatacctcagtgaagaagccgaaggatgctgacacacagtgatgtggagggcattccggagaaacttttgcaacagtgtattaa

SEQ ID NO: 111779 - DNA, 1051 bp, Homo sapiens
gttaggtaggtatctagctttactctttttgcatgtgaatatctgcttgtcccccatcattgttgaaaaaaactattctttccccattaaatgatcttgggacccttgtaaaaaaatcaattgactatagatgtatggggtccagaggattttaatggccagaataaattaggatatgtttgagatgattaaatgcagggtttctcaacagtggtactgttgataattctttgttttagggtccatcttgtgcattataagatgtttggcagcatgtctggcctttatttattagatgccagtagcacctcacctccatcttagtcataacaaacaacaatgtctccagacattgccaaatgtcccctggagggaggggagcacaattactcccagctgaaaatcattggtgagccagtgggtttgtgtgatcctcttgggagtttaaattagatactaggatttgtgtgtctctctgttgagcagtagggagcaggtgtccttgtaagaatgtcagagaaaatgaacattaaaaactagactaactcactgaagtgatttcctccctctgataagggttcatctcactggacgagttcaggcagacctggaagctgttcagctctcacatgaatatcgacattacagatgactgcatctgtgaccttgctcggagcattgatttcaacaaagatggccacattgatatcaatgagttcctggaggccttccgccttgtggagaaatcctgcccagagggcgatgcctcagaatgcccacaagctacaaatgctaaagacagtggctgcagcagtccaggtgcacactaagaacagcctggtcttcatcacccaaagtgcctcataggcaatgctcagcttctcactagactatctcccttattctccatgtgaaactttatgctgaaaatttacctatccatatgcatcagaatcacctgtgtatttcagtgtggaggggtgggttggggtgttgtgtatgtatgtgttttaagtatatgagtgccccaaccccacctcacaatcttcac

SEQ ID NO: 111780 - DNA, 1040 bp, Homo sapiens
aatcacccaccttggcctcccaaagtgctgggattacagacgtgagccactgcacccagcctgagctgctgtgcctggcctgtagtagtgttaacagaattataggaacttgctggtattcaaccatttctgacccattagaatggcaatctcatacagttcacccaataaagaaatgaattcagccgggcgcagtggctcatgcctataatcccagcactttgggaggctgagacaggcggatcacgaggtcaggagatagagaccatccttggctaacacggtgaaaccccgtctctactaaaaatacaaaaaaaaattagccaggcatggtggtgggtgcctgtagtcccagctattcgggaggctgaggcaggagaatgtcacgcacccaggaggcagagcttgcagtgagccgagatcgtgccactgcacttcatcctgggcgacagagcgagactccgtctcaaaaaaaaaaaaaaaaagaaagaaagaaattcagaattatttaagagctaaaattagcagaacttgctgattgattggatggagggtagtgagaaagagaagttgcagctgactctgagtctagaagcctcggagaaagagatggtgagtttagttaatgttctgtcagttattgatctgggcttcaacaccaatttagaattgaaattataaagtataggtctttccttttgcaaactgactcagtgttaatgtcttgatctttacaaatcgaatgaagtttttcttttacaaaagtacttttagaaagcattaaatgttggctaagtgtggtggctcacgcctgtaatcccagcactttgggaggctgaggtgggaggatcatctgaggttaggaattcgagaacagactctggttaacatggtgaaatcctgtctctactaaaaaatacaaaaattagctgggcatggtggcacacgcctgtaatctcagctactcgagagactgaggcaggagaatcgcttgaacctgggaggcagaggttgcagtgagccgagattgcaccactgca

SEQ ID NO: 111781 - DNA, 1065 bp, Homo sapiens
agtttttcctcttcctatttctcacctatatactttgattctttttctttgttttagcatctgtggaatgacaggaaagtcaatgaggactggcctgagacagagttgccctttcctatccttgtctaaaaaagtcactggtctcccagacagaaacgatgaactaggttagtgtttctcgaaattatatgtgaaggaccaggttttataaacttccaatttgttgcagatcaatactttcgtaaaatacaataaatatgaattattagaaaaatgatgaaataatatgtaaaacaaccccctgtgacatgtgtgtacctatgtaaaaaaccttcgcatatacccccaaacctaaaataaaagttaaaaaaaaaaaagagaaaggaaatacaaacaaaagatacaagcccactgatcatgtgcttgactgtcatgacaatgtcatattgctgtcaatgtttctcagacttactctcaagggctgtacttaccttgtcccaggccaggaacagtgaaccgaccagcacttgtctgtgggcaccagtgtttaggactgacctgggtgtcaaagtggtactctcaaaggacctacagttccttccttccttccttcccttctttccttcctttctctctctttctttctttttcttcctcttctttctttctctctttctttctctctctcttttttattgtttattttttttttgagatggagtttcactcttgttgcccaggctggagtgcaatggtgcaatcttggctcaccgcaacctccgcctcccgggttcaagcaattcccctgcctcagcctcccaagtagctgggattacaggcatgcaccaccacgtccagctaattttgtatttttaggagagatggggtttctccatgttggtcaggctggtctcgaactcccaattcaggcaggtgatcagcctgcctcgggctcccaatgtgctgggattacaggcgtgagccaccgcacctggcttctctgtttcttttctttctttctttctttctttctttctttcttttttcagggtctccctctgttgc

SEQ ID NO: 111782 - DNA, 1168 bp, Homo sapiens
acatgactaagtgactacagcacacttgccccctagcccaactgcaggttctcaatcttttttttttttttagaaacaggttctcactgtgtccctgcaagatggagtgcaatggcaatcagagctcactgcagcctcccaagtagataagactacaggcccatgccaccactcccagctaagtttttaatttttttatagagacaaagttttgctatgttgcccagactggtctcaaactcctggtctcaagcaatcttcctgtcttctaaagtgctgagtttataggtgtgagacactgtgcccagcctccatactcttaatggcctccacactcttaacagccataatcagttgactgcagtcagcatgtaagatgacatttatattggcaatgaaactgggcattatggtgaaatttgtattatttcattaaccactaccttgctcctctctattttgtccaaaagctccagatcagttatgtctgacaccccaccatgaagaattagaactttctcatctatcagagtggccagtggaagccaacagaaaacatcttgcagggttcttagtatttccttcccgtgtacctggaaaaaatgatataaacaaaatgttatcaaataattcactcaacttatctgaactgagagaaacttttgtctttaaaggcagcgcaccttgtatttattcatcacttccttggtgaagccatatctagatttagaagcacaaatagatattagagtaaactgggtgacaataatcagggcataatcacatttttagaagaatgcatattctgggtatatgtacttaaatacatagaaaagagactgaggaataatcaccaaaatgtttaaaactatgtcattatccctgggtagagaaattatgggatattttaattttcttccttttacttatctgtatttcctgctttactatcatgaatctctattatttatatgatagagtatgtgtatgcaaaaacaaattcaatggtttcattggaatagtaaaataatgtgtaaattaaaaaaaaaatctgggctgggcatggtggctcacgcctgtagtcccagcactttgggaggctgagatgggcggatcgcgaggtcaggagatcgagaccaccctgactaacacggtgaaaccccgtctc

SEQ ID NO: 111783 - DNA, 1063 bp, Homo sapiens
ccattaaaaaaaaaaaaaaaatcagtctttgaattaaatgcgtttttttcttcccttacagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaacttagcgttatgctctccctgctttctttacctccgaagtcttatggttctgaactgctgtcctgagaaagcaactctcttagttgtgatgttatttaagtgtcagcattcaagggaatgaacagctgcttggtagagtttgatttttcacatgtgcatgaaagaaatgtccttgaggatgaagtcagaaaaggttaaaagtgtaaacgaaaatgtgcctgaagcagcactcagtccatgagagagttattttgccaaggctaaggatgtgcccgggaaaaagaaacaccagtcacaggaggacctgtcctgtgcttttccca

SEQ ID NO: 111784 - DNA, 1051 bp, Homo sapiens
ataatccacccgcctcggcctcccaaagtgctgggattacaggtttgagccaccgcaccaggcaccaggctgtaacttaaaattccctgctaagggtttgtttatgttaactgactaggcagaaacaactgggaagtacaaacagaagtaaagacagattttcagagctgcaagataaaatatcttacaaattatatctcaaaattatttataattatgtatcgtaattgaaaactacgatgtgacttttgatctcataacttcaattttctcagccctccaagagtgaccctgacgatcacggtgtcacgcaaatgaggtggccatataattactttttattttccatataattacatttgagtagtaaggaagacttatttctgctttaccaccatgcgtggagatgagacattcatggaggtcctcagtaagtctgagggctgaggtcatttataaagctaaggacactgcattctcccttgtaattcagccaccttaaattatttttacaagcagataaggtaaaaataaataattaaatgaaaaacattactgacctaatttttctaaggaaaatatcaatctaggactatctatttcttaaaacataatggtattagttaacttttattgaacagtatgagtcagatactgttttaagtactttttttttttttttttgagacagagtcttgttctgtcacaggctggagtgcaatggtgcaatcttggctcacggcaacctctacctcctgggttcaagcgattctcctgccttagcctcccgagtagctgggaccacaggtgcgtgccaccacacccagctaatttttgtatttttggtagagttggagtttcaccgtgttggccaggctggtcttaaattcctggcctcaagtgatccgcctaccttggcctcccaaagtgctgggattacaggtgtgagccaccatgccttgccaaagtacttctttgaaaaataaaatttggtatcagaaataactgataaaggctagctgtggtggctcacacctgtaatcccagcact

SEQ ID NO: 111785 - DNA, 1378 bp, Homo sapiens
agtattatttattatccctggagacagggataataaatagtagtctctgcattccatagctgctcctgttttgagcttatgcctccatgagttgggaacagcagtcaagagttttgcatatttcctagcagtaatatgccccatcctcgattcagatgtgatctgttttggaatattttatcatttatagtttttcaggatggtgtattgacttggtgattcctttttagtaaactttcatgtaaccaaattcgtataatagggtacccaagagttatcatgtttcaatacttttttatcttacagttggcactacgagatgcacttttgaaaaagagaaaaagaatgaagtaacttcctggcaagttttccattcctagaagaatgctaagtttgtgtccttgctctgaaaattggtaaatcaagcatgtttgtttacattaaaaagtccagacacactgtattgtgaaaactgctgaacatgtggcagcaattttgtgtttttattttggagacggctaatggtaggaatgttaatgtaaatagtggtggtaatgtaaaatcatttcatttatcattcatgcaaaaaaaagtatgtattgagtgcctattcattgtcactgtagatgcaaaacgaatgagctgtaaccccttcactcaaggcattgacagcttagctgtgagggtggacacacatatgtgtatttacagtgcagtgtaaatagttctgtagtagaggttaactccatatttctgtgaggtcactgaggccttatggactaactctgtgaggataggagttatatattcttataagacaaaacaaaacaggacaatgttacaagagtaagaggttcttacttgtacataggctttcctgctgaaaacaggcccctgctgtacagattttgggtacataatttagctcttttagtcaatccaagagatttaagtgacccccccccccccgtgttttttttgtttttgtttttgttttgaatgccatgtaaaggctttttggttaagacctcacttttaaaactgccttaagtataaatagtacctttggaatatatttagttcatcatttgagctgccttcatactggtttcctcagccttccttcagcctgtaatattttcagcccactgtttaccttgtctcaataaaaggtttctaatgccaaatacgtacctttgtatgtggagtggtgtgtggtgttctacgttccacaggcgtgctacatccatttcaggggacagtctgtttgcatgcaattttttgcatttggaaatagtttggtgccttttgcttcagctttctcagataatgttgtggtagatgttacctcaagttagagtaaagggcaattttctgc

SEQ ID NO: 111786 - DNA, 1870 bp, Homo sapiens
ttagggaactaactattagaatgtaggatacaagatggaacatagaaagacaggaggcttgagatagagtttggtgaccttttcatacttggttatgtatatgccagacaaaagagctggcacgttctcttaaagatcatagggagtcatggaaagattgcagtgtctgtgatttagaaaatttaaactgtggtggctccattaagaagcctgatacctttttattgaggtgtcttcaggattctttaacatcccaaatattctacctcagttgtctgaatgactaactagattctcatacgtgggtaacacgcataggacaaattagatgcctgctgcgtggccaggataaatgtacaagtgcagttttgatggacacagttggtttagttgaaagaacatgaccctaaaggtagacatgattttcatgatttcagtgtaggatgcctttttagcggtgtggcttggggcacattactaaactctgagcatctgttccttttctttggagttatgagggttagagagagtgattgtaaggttttgactcatggtagatacttgatcagtgcctatttcctattccttagattaactaaaggcacattgtttatttaacaataaatattgctcagttcttggttaataatgtatctgttcaaggttcattacttttctgttgcttgcttcatctcaactttatgttgaatgtgcaacataaaatggcagtagtgggtttgcttttttcacgcagatggatgggaaagtaccagtctcagtgaggaggaggatgctgatggtgaatggattgatgtgcaacactcttccgatgaagaacagcaagaaatcgtaagtctgaaaatttcatcttataacctggtgtttattaagacgtaatttattctgggccttgttgggaggctacaatttaaatggctgagctctcacttgagctggtagccatttaagcccttgtgtggtttcaagtccaagaagctgaacagcatgcccatggaggagcggaaggccaaagctgcagccatcagcactagccgagttttaactcaggaagacttccagaaaatccgcatggcccaaatgagaaaagaacttgatgctgcccccgggaaatcccagaagaggaaatacattgaaatagacagtgatgaagagcccaggtaaaatggcacatccactttagtacttcagtcagctcatgtggtaatgaaagcatcaggaaacagaattccattcttgtttcatgtgttatttttccctcaccccaggggtgaattactttctcttcgggacattgaacgccttcataaaaagccaaagtctgacaaagagacaagactagcaactgcaatggtgagtgagcatatcattcctagttttttaaacagaaagcaaataaaatgaaacataagccagaacttgtatagccacagaatggcaatttttaaaaatgttttaaataaaggtataattaacacagaaattaaaatgcacagatattagatgttcagttagatgaggggttttgtttgggtttgcttttgttagtatgtttgtttgtttgttttttgcgacagtctctctctgtcacccaggctgtagtgcagtggcacaatctcagctcactgcaacctctgcctcctaggttcaagcgattctcctgcttcagcctcctaagtagctggggtaacaggtgtctgctaccacgcccagctaatttttgtatttttagtagagtcaaggtttcgccatgttggccaggctggtctcaaactcctggcctcatgcgatccacccgcctcagcctcccaaagtgctgggagtataggcatgagccattgcgcccagccag

SEQ ID NO: 111787 - DNA, 1064 bp, Homo sapiens
gaggtggggcctgagcttctgcatttccaatgagcctccccggtggaccagcagctgctgggtctgtggactacccctttaagaagcaaggatctagagagctattaagtgaagcgagcacctgtcaaacagtcactctagatgttgatgctaaaaaacttgggaattattaagacttaactttgggcaccattacatatattgacatattcacctgtttgtcagtctattcactgatctaactattgtcttttcctacgcctgttacataaatgtcacatagaccatagactcacaatgtacttctttcatcctctccttgccagattttgcggaaaaactactaaagcagcttgagtgctgtaaggagaggtttgaagtgaagatgatgctcatgaaccttatctccagattggtgggaattcatgaggtttgaattatattatgtttctcttggtgaatatttgaagtagaatttaccatggtaaaagaaaagccattaggtagagcagtggcttaattttatccctcatacatttaaacacataaaatttacagaagagtaacatctctgaaaataactatttttatcacttcattttctttgcagtaatgtggatgttaatttgtacatatattccatttatggacaggctattttattctctgctttttttttttttttttttttttttgagacagagtctccctctattgcccaggctggagtgcagtggcgcaatctcggctcactgcaacctccacctcctgggttcaagtgagtctcctgcctcagcctcccaagtagctgggacacaggcgcatgccaccacacctggctagtttttttgtatttttagtagagacggggtttcaccatattggccaggctggtctcaaactcctgacctcatgatctgaccaccttggcctcccaaagtgctgggattataggcatgagccaccgcacctggcctgttctgcttttttactttctttttgttcactttgttacgcatacacattttcttgagccaatataatgcacatattttaattgactt

SEQ ID NO: 111788 - DNA, 1044 bp, Homo sapiens
gtaataaatgatagcctcagtggttttttactgttttctcctgtgattcttgacttccgttgggcttcggcactgctaaaagaaatttaaggtcaatgtttgacttttgtctgttagaagaactgcaatgtcacttttcttataggggatgtagaaattctcgacagtcttgaaggataactatatagagcctagcagtttttatctagtttttaaaattatttattagagaaataacataaaacaacttttaattaagaaaaaatgaacaaaaatcccaccactctttgaatttgttcttcagatcttagttcatgcacatgtataaagcatactcaaaaggatttattctttattttaagctgaatcaagtagctgacttttttctcattggtgtttagatattagttgccgctttgacattctttcttgggaaagatgaagatgaaaaacaggacagtgactccgaatctgaggttagtttaatcatagctgcttctgaatcttaccttttattattgctctgagtacacattgtaaagtctatgactgctgaagttagaaagaaacttagatgacacctttgccctgttattgaattctgccatgctattttactctacttggaatttgtcacttgtattcagtaagattatcttggttatataattaataaaacagatttattcaaccttgatcttagttctaaagttatacctatatctcactatgtaaatttaggatgaaaattgtcaccaacatttttttttttaagacggagtctcgctctgttgcccaggctggagggcagtggtgtggtctcagctcactgcaagctctgcctcccgggttcatgccgttctcctgcctcagcctcccgagtagctgggactacaggcacccgccaccacgcctggctaattttttgtatttttggtagagatggggtttcaccgtgttagccaggatggtcttgatctcctgacctcacgatccacccgcctcggcctcccaaagtgctgggataacagacgtgagccaccg

SEQ ID NO: 111789 - DNA, 1550 bp, Homo sapiens
acttcttggtctaatttgtggaataaaagtggtccatgggagcatggtgtgggcaccagtgatatatgcattcacagtattttcctgcatgcagttaggtgcttggtaaattggagcattttttttttaataacacttttattgagatataatttatgtaaaattcatccacttaaagtgtacaattcagtgttttttagtgtattcacagcgtggtacaaccatcactgcaaacaatttttgaacattttgtcacccccaaaagaaactctattccaattagtagttaatcctgttcctcatcccttttagctctaggtaatcaccagtctactttgggtcactatagatttgtgtgttttggaaattttatataagtggaatcataacaatatgtggtctttagtgactagattctttcacttagcataatgtttccaagattcattcatgttgtagcacgtatcagtactttattcctttttgttgccaaataatattccattgtatggatataccacattttgtttatccattcatcagttagtggaaatttaagttatttccactttttggccactatgaataaggctgctatgaatgtttgtgtgaacactgatgttttcattttctaggatatatacctaggagaattgtgccgtattacattaaactccatgtttaacttcttgaggacaactttgctttgctttgtagttgcttttttgtttgtttgcttggtttgggtttcttttgggatagaatgaaaaataggtaaaattaagtcatcctgtacattcatactgttctccaaatttagcaaggttaaaaatgttggttaggtttaatgtatatatttttgtttcttttcctcagactttatacacacatattgtgactgatatcaagaatataaatgcaaaacacaagaacaataaagtgaatgtagtaagtactcttctgtcttccatgtttgcagcattgtaccatcagtgcattaagtcttctttctcctccttttctgcaggtattgcaaaatttcatgtacaccatgttaagagatagcaatgcaaccgcagccaagatgtctttagatgtaatgattgaactctacagaaggaacatctggtagtgtatatatatttgtctcttgagaagtagactcttttttcatttgtaattaatacagagcacatatacaaatacttttcttgagcttgagctctttaatatacttatgtcatagatttaagttggaagtaaaaatagaggcaattcaaatgactaatgacattggttatcatttcttgagcagctactgaggtcgggcactttgacatgacctcacttagaacaacttgagaacagaagatgtagcttatctggaattatccccattttataagtaatgacatggaagttcttagagttagtaaaagtttagctattaagaggcagagctgaaattcagacccagatctaactgactccaaaatctgtgctctctcttctgccgctctgaagattttcaagtcaattcatcctattta

SEQ ID NO: 111790 - DNA, 1071 bp, Homo sapiens
agcgattctcctgcctcagcctccctagtagctgggattacaggcatgcgccaccacgctcgactaattttgtaattttagtagagacggggtttctccatgtggatcaggccggtctcgaactcccgacctcaggcccgccttggcctcccaaagtgctgggattacaggcgtcagtttctaattttagactgcgggattaaaaataaacgattaatcctcatttatgtgcttcatatgggtgtcggaatgacgatacatgctaacacacgtgaaaaaatttacatttcagatcctttcagaaacgcaaggcaatattaagtagtagcatatgcccaagggcgaggggcgggtcggcggtggctggctctccaatacaccacagagtattttggcaacgagagtaattttgacactctgaggcttccgtagcatagctcgctttaggaaccgctaaggtgtcgcctgcctagagtcccatgcgctatttccggtcatacccggaaacacgagtccaagctgcagctggcagggattgcggggtgccggccgtctgagtttttttaaaactgctcgccgcgaagtctgtctgcagccaaaatgtccaacagaaacaacaacaagcttcccagcaacctgccgcagttacagaatctaatcaagcgagacccgccggcctacatcgaggaggtgggagtgcggcgcggcagacgctagaggccggatagtggatggttgagacgccggtgcgggaaagcatggagtggggctgggatccaggctcgccgcctattcttctgttaggttcaggggtccctccagaggagagaaggggttggggacgggacatgccttagggttcgttccccacctcttgaaaatctgttgcccctttggattttctacctgccctgctgccgctgaaacacctttaaaacctcattttgttttaagatatttttcttcgtccgcacggaagtggagagagaaatgggccgcacccaaccaccaacttccacgcggatttctcagcctcttttcagaaatcccaaacttgaattagtcggtaac

SEQ ID NO: 111791 - DNA, 1047 bp, Homo sapiens
attatctcacttttgcttttcagtccaaactcttataatagataaggcctatattatttgacaccagatgacctttattcaatttcatatttttacctgtaaatgagtgcctaaagaagtttccctgtgtttctgtatttatgtccatattgttttgcattttcaacaatttttactttatatattttattttgttttgctttattttatttttaaatttaatttaattttattactttattttatatttattttattctgcaaagctttcattataggcagatggcagggggctcagtccttcttggcagctgctttcctcatggcagccaggacgttgctcagctcctcctgccttctcttggtgcagatgtttgtccctacccttttcttgatgaatttgagggcctgtttgaccttggagaccttcagtaactccatgccacgccactcgttaggggtgaagccacacacctctgggatcatgtcccacacaaatttagtgagtttggtcaggcgcccacagtggctgtgcctgggcttgctcacattcttggtcaccttgtggcccttgttgaggcccacagctatagggtagtgcagtgtcatggctgctgccctccaatggtggccatggtggaaagctactttatatatattttagcactgttacttagtacatgaagttgtatgagttgtattagggatcataaaaaaaagtgatcctctttgctcatgtgatagttttacctctgagattctactttgatgtaattcctatttttttgtctttatcttttcctcttaagcttcctaaatctttgttttaagtgtgtcacttgtagatgtttaagaaaatcatatcaaaggagctttctaatgggtaagcttaataaaatatatttactgtataactggtaatctgtaatttttaaaatgcttccttgctgattctttatgttttctttgatttctttctaactttaaatatattttatttaactttttgaagccatttttgttttttttaatgagatgggtctcact

SEQ ID NO: 111792 - DNA, 1033 bp, Homo sapiens
atcatactgctctatgataagctctttaggcctgctgaacatcctgaaatctctcattaccattctgagatattgcttcttccctatgagagatctcctatttcttggatttgcaactctttcttggattactactttgtttggtgtggtggggatgggggttctgcagaagtttcggagaaatggtccactaaagaaaattttctaagtctctgcatctctgagagatctgcctttaagcttgattaatagtttatgtagatttgcatttctattttagaaactatttttccttggaattttgaagatattcctccagtgacttctaggttctgtagctgttgttgaaaggtatgaagccattctaattactaaaactttgaataagactttttaaaaacaaaaatctggaaggttttaggttgttttctttattcccaacattctgaaattttatggtgttgtgccttagtgtgtgtgagcaaagggttagtaaactccttctcctgtcttctgtgaaaatggcctcctggtgatcttccagcactctctctgcaatctatgaaaggtggaatgacagctgtgtgaccttacagcattgcctgtggtaaacataacccttgattggtaaagtgcatctgagctgggaggattgtgaatgaactataaatacttgaggagaagccatagctttgggctttcctgaatgtggtgtgacatacccaggtgttcttcttgttgagtcctggaaggacagcagtactctcgtaccaatcctgcataggttcaaaatatattgtattttatatgtggcatgaggctactaagctagagaggctcctacacccacctgtgtaatcttgtttccttgaacctgagctgtaatttggaagcaaaagaacagccctggactcctgtgaagacttgcattaaaggaacacatctgatgctgctctgctgctagacagtatgctttattcactgctgtatattcttctgcaaaactgagtaaactggtgaggggttggccttt

SEQ ID NO: 111793 - DNA, 1248 bp, Homo sapiens
taaatagagttgatatatgcaataaaactgggaataatttaaacacctgtcttttttaaaattatgagcagtgtattgttttgggattgaatcatggttcaccatctactttatgaccttgggcaggttatttacctgtagtttctttaactgtcgagatgataatggtaccccaaagggggctcaaaaggattttaaatgagttaagtgagtgaataccagtactgttaaaacagcaccttaacccatgaggaggagtcttaaaaaaatgttagcatctgtagtcatcaccaccattatcactatgtactttgtacttcaaaacatgaatattctcagttttcagaatgttattttgctagtcatctatatttgaatacctcctttgagttctgttttattatcatgcctttatcaaaagttggtaaaaggaatagctatctaaaaaacatttttgttggaagatattgttcattatatatttgtttgattttattgttctttagagtttgtctttcactgttagcaaaagatgtagtacaaatgtttaaatatgcatgccctctatatttagagcacttactaggtactgtgttgctagtaaaatagtcaaagtggagtcttttttcctgtgactagcttgcagttttaagaaattaatacattaatatgttgtttcttaatttgttctagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaaccgaccacatggagggaaaaagaaaacaattctttcttggattggttttttgagaagtttactgacaaattactgttcatcaaatctgaaatagtcacctcacagctcttcaaagaaaacctttgaaagatttatatctaaaagctgtatttactttaaaagaagtgcataattaccaaaattgtatgtactattgtacatttttacaacagcattttcttaaacataatctgtgtttaatgattattgtccattgagcctgtactctgctttccataccaagtaaatatgaaataatctactttgcacataacagaacaaactataattacttggctgttggagatttgtact

SEQ ID NO: 111794 - DNA, 1100 bp, Homo sapiens
atgattctgttgttattggtggtttttatttgtataggtcctaatcaaacaggaaattcaaaggaagagtggttatgccattcaggctgatgaagagcagttgcgagttcagctggatacgattcagggtgaactaaatgcacctactcagttcaaggtaaccacttctaagaccataattctaaaatttgtttcaggtggatctgcagacaaaaagttatgtaatcttcaagcaggaattttgtatacttgtgtttcttatctccaattagaacttcctttctaaagtaaactcagtcatggttcttttggctagtattagtgtttcgaatataatgtacagagagagaaatagaaatttttaatagatggttttgaaaccatcctttcagaagaaaacattgtcttttacaagtcttcgtcggcagttgtaatttgactcagtcttaacttttagggccgactaaatgaattgatgtctcaaatcaggatgcagaatcattttggagcagtcagatctgaagaaaggtattacatagatgcagatctgttacgagaaatcaagcaggtaagtgttgcatgaggctgcattatttaaagtgtgagctcaccacttcacacctattaggatggctattatcctaataagaaaagtgttagtgagaatgtggagaaattggaactttcttgcactgttgggggaatgtaaaatggttcagcctctatggaaaacagtgtagtgtttactcaaaaaattaaagatagaattacgatatgatctagcaggtctacttctggatatatacccaagtacgttggaagcagggactcaaaacatatttgtacacccatgttcatagcatctttattcacaatagtcaaaatgtggagataacccaagaatcaatcaaagaatagagaaacaaaatgtagtatatagacacacaatggaatattattcagccttgaaaaaagaatgaaattctgacacatgctacaatgcaatttgaccttgaagaagttatgcttcatgaaataagccactcataaaagggaaatatttatgatttcacttatgaaaagtacctagtagtccaatt

SEQ ID NO: 111795 - DNA, 1020 bp, Homo sapiens
gaaaagaggcatcaccgtagatatacaaaacagaataagaagatactgcatgggccgggcacagtgtctcactcttgtaatcctagaactttgggaggccgaggtgagtggattgcctgagctcaggagttcaagaccagcctgggcaacacggtgaaaccccatctctactaaaatacaaaaaaatcagccaggcatggttgcttgtgcctgtagttccagttacttgggaggctgaggcacgagaattgcttgaacctgggaggcggaggttgcagtgagccgagatcacgccactgcactccagcctaggctacagagcaagactccatctcagaaaaaaggagaaaaaaaaaagaagatgctgcatgtactttagggtaacagatttggaactcagaggaagttttattttgatttttctatgaaaatgaaaattaccaaaatctacagagaagtaagaaaacaaataccacagaaacagttggaaaaatgaaagatgaaacatgaaaaaggccttagggacagatagtttcattgccaaattttgtctaaccacaaaagagctaatccagtgttattttgattattctagacaattgaggaataatttatacagcttcatttgttcttttttcacagcttaagataatttgcataccatactatttactcatttaaagtgtacaattcaatggcttttagtatattcagagacttgtataaccgttattaccacaatcaattttagaacatttctgtcaccctacagacaaatcccgtacccattgtcagtcacttccccgtttcactgcaaatctgtcagtcctatgcaaccagttttgcctatatgggtttgcctgttctggaaacctcatataaatggaatcataacgatatatggtcttttgtgactggcttttacttagcataatgttttcaaagttcaactgtgttgtaccatgtaatagtacttcaggtactaataaatgattattattcatttattgctgaatattc

SEQ ID NO: 111796 - DNA, 1011 bp, Homo sapiens
gaattgaattttaatattaaatcatttcatccatgaatgtggtatgtctctttaatccttgcagtcttttatgtcctttaaaataattttaaaatattcccttttaaaatctcatgcgttctttcttggatcaattcctagatggctttcttggatcaattcctagatggttttagtatttgttaataaatactgtggctgataacatgtctaatttttttagttattactggtagaaaataatgttgtaagtactcttgtatctaaaaaccctggtgatttttcaaaattgggatggggagattgcctaggttttgtaatataaaacatggccacctaattttgtcctttcagcatggcctggcattggaaagtttctgtaaaaggtgatgtgtgcaggtggatgtgctaaaatatgtcttgcacaatcttaacctctttcttgtaacatgtaaatgtaagccagtggcatagaatgattaattatgatagagacaattatgggattaattctgattgggatgctttaataaaatagtgagattttaacctaccctgtaaggttaagacttcctaaggcagaatagtgggatttcagtcaggtaaaacagcaagtcaaagatccagaggcataaaaatgtatcctgctgcataattaatatcattccttttcctctgcactctgattactccctccaagtattctgtaacagttaatgttgaaatgtactgtacttgctgtcagtagttagatacagggctaattgtctattaagacaccccctagatatcatcttacacatcttaactttttccactcagacctggttgttggctgtattccatgttacttcagattccttaattatttctgaagtatgtgttttctttttttccttttgagataggtctctccctctctctctgtctctctctctccctccccctccccctctctccctctctccctctctccccctttctccctcttctccctctctctccctctcc

SEQ ID NO: 111797 - DNA, 1042 bp, Homo sapiens
tgaaatgtaagcatatttacatgtagatcttttaaaaaaggattctccatatacaccttcagcttgcctttttacagtattccttagcacttttcatgtcaatacatgaagataaatcttactgtatttaaacattgcatagtattccatggatacacctttacttaacacctctaagttgttttctttttactattataaactgtacagtaattaacaatatccttgtaaacatgtcttagaacacattggtatatatttctttagaatagatctctggtaatgaaatttttgagtcaatattatgtatgttagatattgccaaattgccctccagggaaagttctaccgtttatattcataacaggaatgttattttttctggccactgatggcaaaataattaatttaaaaattaatacttatttttaatatgtttattagctacatttatattttttgtgagttacctatttgtgtcctttgcccattttctagatttttttgtcttcctttttgatgtataggaactctttctatattctggaggttaatctattatcctataggttatagatagttcctttcaatctgtgctttttttgaactttatttattctgcaaaaatttgtatttttaccatgattatatttgacagtcacttttcattatagcttctaggtatagggtcttgctttaggaaagcctttgtcatacacatattataaaaatagaaaattgttttagaaaaaatattttttatttgtggtaggtgttgatcctattatctgggaacaggccaaggtagataaccctgattctgaaaagtaagtatgtcttcatcttgtttcatttaagaactaatatttgctactaggaaagcaaacatgggagctattaattataattcttacatatgagacaagtttattttcattttcctggcctttaaaaaatattgattattgtccagctaaagcttcagccaaaacaaaaagaaaaaaataagaaaaaaaaagattatggtaaggcagcatagcat

SEQ ID NO: 111798 - DNA, 1411 bp, Homo sapiens
ttgcagtcacttttataatgacatgcagatggttcagaaacaaccaacaataatgaatatcaaaattttttaggggagaaagctgtttagttactctctcaaagaggaaatgttaatcttactctataggttaatgttattcctgggtaaaatagtttttctttataattttgtgacctcctagggcacaaaatggtgggaagaatcattattcccttaattaccagacattaagttgtttttcccattttagcagatattaagctattaatattaaacacctgatttaagatctgtacatattttttatattgtttattttgtcattccacaggcagtaggttatagttgcatgcccagtaataaagatgaagatgggctagtggttttagttttcaacaaaaaagaaacagagattcgaagccaacaacaacagttggtagaatcattgcataaagttttgggaggaaaccagacccttactgtaaatgtagagggcactaaaacattgccagatgatcagtaagtatacataaatatactgtttatttctgtgtatttatttctggtcctaagggagtgatcaataatgtttttgttgctaaagcacaaattaactctcagagcagaatgccttttctcagctagtgattattcagtattgataaaaacatttatttaaaagtttttttaaaattttggattttttaacttactagatgctaataattttctagattttcattcaggccaggaagggaccatttgtcatagatgcgtgcaaattgagggccataaagatgttattggaaaatgttattaactcattactgttcatgttcattcatgaataaatattattgctttacttcccttgacctaagtataattctcagtgttagtggcaagacatttattttaggatatttggaggaatgattattaatgagatgcaataattgaacagattttacttgtggttgtaattgcagagaagcagcccataaatttcaacagaatttcctatagtaaataacatttacataggattttgcaactaagcaaacccttttataaatattatcttattggccgggcacggtggctcacgcctgtaatcccagcactttgggaggccgagacgggcggatcatgaggtcaggagatcgaggccatcctggctgacacggtgaaaccctgtctctactaaaaatacaaaaaaaatcagccgggcgtggtggcaggtgcctgtagtcccagctacgagggaggctgaggcaggagagtggcatgaacccaggaggcggagcttgcagtgagccaagattgagccactgaactccagcctgagggacagagagagactccgtctcaaaaaaaaaaacaaatactatcttatttacctggttct

SEQ ID NO: 111799 - DNA, 1173 bp, Homo sapiens
tgcattcagcttttctgccccaactaacacaggcactactggtaagaggccatcttaagtcattcatagaagtaaatgaagtagaggtcagatttttttttttttttaacttacgaagttccaatttttcattcaaaggactctttggtggtactcagaacaaaggttttggatttggtactggttttggcacaacaacgggaactagtactggtttaggtactggtttgggaactggactgggatttggaggatttaatacacagcagcagcagcaaactagtaagtatgaggttttcagcttcaaatacaaaaccgtgatgatactagctgacattattgagtgcattcagaatactttagtggactttttataagaattattaatatattccaaaggattaggaatgttacttttcatgtttaaatatgatagcaactggggagaacactgattggcacagttaggattataaggtccctgtgtttaggatcattccatttaaatttttgttgttaaaaataacaaatagagaaactgcacaaaagtacagcttaatgaattatatataagtttacaaaggttaacacccttgtaatcactgcccatgtcaggagatggttcctggccagccagttcagaagcctaccacatttccctaccaattgcttccccatcagaggacctgcagtcttggcttttatggtgatcattttcttactttatattttgtcattcaagtatgtaaacagtatttggttttgcctgtcttaaatctccataggctcctcttttatctctcttttttatttattttttattttttgagacggagtcttgctctgtcgcccaggctggagtgcagtggcacgacctcggctcactgcaacctccgcctcccaggttcaagcgatacttctgcctcagcctcctgagtagctgggactacaggcgcacaccaccacgcccagctaatttttgtatttttagtagagacggagttttaccatattggccaggctggtctggaactcctgacctcgtgatctgcctgcctcggcctcccaaagtgctgggattacaggtgtgcgccaccgcgcctggcctctcttttttattttttaatttgttgaagaaaacagatcatttatcctatagagttttttagtcaa

SEQ ID NO: 111800 - DNA, 1051 bp, Homo sapiens
tgttaacctttgtaaacttatatataattcattaagctgtacttttgtgcagtttctctatttgttatttttaacaacaaaaatttaaatggaatgatcctaaacacagggaccttataatcctaactgtgccaatcagtgttctccccagttgctatcatatttaaacatgaaaagtaacattcctaatcctttggaatatattaataattcttataaaaagtccactaaagtattctgaatgcactcaataatgtcagctagtatcatcacggttttgtatttgaagctgaaaacctcatacttactagtttgctgctgctgctgtgtattaaatcctccaaatcccagtccagttcccaaaccagtacctaaaccagtactagttcccgttgttgtgccaaaaccagtaccaaatccaaaacctttgttctgagtaccaccaaagagtcctttgaatgaaaaattggaacttcgtaagttaaaaaaaaaaaaaaatctgacctctacttcatttacttctatgaatgacttaagatggcctcttaccagtagtgcctgtgttagttggggcagaaaagctgaatgcagaacctgcagttgtagatgttgtcccaaatcctccaaacccacctaattaaaaaagaacaaaaatagaaaggaagaatcttttgtatatataaaggcaacttctttttaaaattattttataattgctacatataaaatcaaaatatattgatctaatttttcctttccctactttcaagatcaattttttaaaaaactatactaccaatcaagaagtcaaaatgttacaagaaatgaactaagcatttaaaatagaaatatcacaatgtaatatatacccttcaattaaaggggtggttaacagttacagctgagaaaacacattaagcctattgccataattctaaaatgactatgtatgtacttttagaggaggtgttgcaaattcatatgcctagaagatttagactgataacagtaaagagtaaagtagactatgtgtttactgataggtggaact

SEQ ID NO: 111801 - DNA, 1033 bp, Homo sapiens
ttgctctgtcgcccaggctggagtgcagtcgtgcaatcacggctcactgcagtctcgacctcttggactcaagttattatcctacctcagcctccctagtggctgggactacaggtgtgcaccaccacacctggataatttttgtatattttgttgagacaaggttttgccatgttgcccaggctggtcttgaactcctgggctcaagcagtctgcccacctcagcctcccaaagtgctgaggcttttgtttctagggatatttatctatggtactatctagggtactaaagttattagttctaaaattcagattacctttaaaacctttctcatcccaatattgcaacttatttttgaaatcagcaaatctagatcagtcttaaaatatctggctcagtgttacaaatgtcatgtatcaaggacacttgatccctaagatacatacttcctaggaatcctaactctgcagctggtttatgtcacagggaagctccttgtacctatttcttcttactcaaggtagttagagacacctggaactttgtaacatgccaagcctagttatttcaaatcagggagtaagaaaaatccagaaaaaaaaatttaaaacaataaggtatgttaaaacatatatccattagcaataagaaaatagtataggatgagtggtatagaatacaaagtataaaaagatgtatacacattcagcacaagataaagatctcatttccaataactatattttttcatttagtcaagtttttaaacacctttattgaggtataatttacataccataaaagtcacccattttaaatgtacaatgatttttagtaaatttactgagttgtgcagttttagaacatttccataacctcaataaaattcctcatgccagtttatagccactcagcgttgccaaccctagcccctggcaaaccactaatcatctgtcggtctttatagatttgccttctcgagacattttatataatcatacagtatgtggtatttggatcctggcttctttc

SEQ ID NO: 111802 - DNA, 1188 bp, Homo sapiens
tcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaattgctctagaagtcatatgtcattggatgtcctgttgtttatggagtttccctggaaagatgttccttgacagatgcagccctgagtcacacacttgggccatgtctgatttcagcttcgctgtagtggacagttacaatcagcctgacaagtttcactccaagcagtcccacattctgcttttctgtcttaagtctttctcaagagccctcaaagcaccataggagtatcagggagttaataacccaaggcaaccctcaactaaatggggcaggagtcagtcagctgatagatgtttcaatcctcagaggaccagttctcaggcttattccacatgggtcctcaattagggttgcccacagtggtaactactttctatcagtgtttctttattccctgtctt

SEQ ID NO: 111803 - DNA, 2241 bp, Homo sapiens
aagttgaatagagtctaagttttataatccagatcaacacagagaagggtactgctctggtattgagggtgggagtggtcagagaaggcctcctggaaaggttaggcctgctgaatcttcaagaacaagcagcagcccaagaggggaggtgagtgagatgagccaccttcctataggtctctcctccttccatgcccccactccccacccaaacttttcacactggggagaagtttctgacatgaacatctaacttgttttctctcttctgtgtttcagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccgccttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacattta

SEQ ID NO: 111804 - DNA, 1060 bp, Homo sapiens
atgacaagtgctgcagctgtgccccatggctacgctaggcgggccctatactaggatgccactctctggcagtgaccaccaccctcttcttagctctctggacaactgcctggaaatccagacctgacaggctatcttttaggcctccttcctgttggatcccttctaaggctgtgctattcagagtggcagcatcctgggagcttgttagaaatggccagtctactgaatcagagcctgcattttaacaggattcccaaggacctacattcatactcatgtttgagacacactggtctatcagccacctaatacaacccatggttctcattctgttctggggatcacttttacttgtttccactctgcctgtcacacatggtaatggtcaccttgtttatgaggactacacagaaatggtgctctattgaaaaagttgtttgcagtttaataaatcctaatgtttccttttcacttctctgatttgcagttgactggaataatcctaaaagcagccaagaggttccaaatcaacatttatgtcaaaaaattagatgactttgtgtaagttttgcttctttctatggaggggacagcagttttgctccattgcccgtctggtggggttgatgtcaggaggagtacagcctacttcatctaagcctgctcacccctgcccttcagggatggggcatgatcagcattttcatgggtgccttggtcttggaatttacttgttttatttaatcatacacttacagagtacttcccatggatcaggtattgttctcagcaccttatgtggattcacatataaccttgtattatccccattttacagatgaggaaacagaagcagagtgtttaggtaacttggctaagccttactatctagtcaacttttatccactccactaagcctttccctcatgcaccttgactctcttggtgtattagactgttcttgtgttgctataaagaaatacctggctgggtacagtggctcatgcctgtaatccagcactttgggaggccaaggtgggtggatcacaaggtcagg

SEQ ID NO: 111805 - DNA, 1107 bp, Homo sapiens
tggagggggggattgagtatcaaagtgtgtattccaataaagtatctgtccaatgtgacacttttcaagtgcctaagaccctacgaggccacggccatcgctgcctgttctaccttagctttggctctgccgtgccctggcttccctggctttgccggtggcccgtccacactggcatatgtccatgcaggtctagagaggcctcttatttcttttttatgtgagtctccattctaaatgttatcatcttaattttgtaccacatattgttttttcttgtttggatgatatcaccgttgctacaataaacaccttccactacaattcatcttctgctttattacacgttgagttgacagaatgccttccaaacattcctttctacttaccctgtgagcttttggccatgttgtacctgagaactgttgctaacttgcggatttcgggcagattacactgaccagagtccacattcactttttattcttacatcctaacaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtaagaactcagagaggggacatgataggggtgtcaagaatgcagaaggattggagttcaacaaagaatatgtagctgggcgtagtggcgcacacctacagtcccagctactaaggatgctgaggtgggatgatcacttgagcccaggagttctcaagtccatcctgggcaacatggcgagaccactgtctctaaaaaacaaaacaaacaaaaaagaatatattgtcagcccaatagaaagatcagtttctttcaagaacaatgtttcataacatggctattgaatggtaaaaaaaaatcatggcttttctgtgatgctttttatttctagaatgccatgttgtgtttttttttctggacagtggtttagaagtcttaacagtaataatagctcatgtttactaagcacctgatgtatgccagtcactgtcctaagt

SEQ ID NO: 111806 - DNA, 1020 bp, Homo sapiens
tcttgtaattattattctacaaatcaagatggtggtaaaacatcttacagattaaatattagtgatttgtagatttatcatggccaggcatgaattacaggccagtgaaaagtcccactcttgcttagtagtcattgagtgatgtgtagtagctacagcacaaatacttttcaaaccaccacatgttttgggctatttggccattgcctctatgaaagctgatttgggccagggacctactttttctcccccttgatctaattaaaactgttgtgtctgtgtatgaataagatactgtggatagacagctccagttaaatcttgcaaagtcctgaccatttaagagaatctaaactcaaatgtgatcatctttactctttcttgtgcttatcaattataggtcacttgactggtggataacagacaagtgcaatatgattaatggaacagatggagattcttttcacccactaataaccaaagatgaggtcctttatgtcttcccatctgacttttgcaggtaaaagctttaaagataagttctttttcaaaaataaggtctttcactgcaagaccaccaaaagcatgaggaatatatgcagacacacttattatgcatggatatttatgcataatcagtgataaatgctgatggcacatcgagacagtatagtgtactggttcacagcacagacttctgactgttggtttgaatcttggctctaccacttatagctgtgtgaccttgggcaaattacttaaccactctgtacctcactttccttatttgtaaaacaaagatagaaattgttaactatgttagaggttgttatgaggacaaatgagttagtattagtcaaatacttagcccagggcccatcacacagtaaccaatattaagtgttggctcttagttactatgatatgctctgtcaagcatcaactgacctggtctacttccagtcaataggtagtctctacatggaagccaaataaaagatactgttgtccatatttcag

SEQ ID NO: 111807 - DNA, 1135 bp, Homo sapiens
taaacattctaattcacctacaccaacccctgccgactctcccaccctaacccctaggtgaccgctccatatgcagctggacactgatgatggacccaggacctagacagtatgaggtccctgccacctagtcccaggggtgtaggtcgggtttataatgagcctctggccctgcttaggcggaaggtagcgccaccttgtggccaaagatgcccacatgtttacaagagcttttccccttttgtggtgtctggataactcagagcctgcaaatggtctctttgtaaatattacacttacaaaatgcagtactgggaaaggacagagaagaggctttgtcttccatatgcagccagaaaggagctcactgcctgatttttcagctatttaatctcaacctttacatttatatttccaaccccctttgctatggggtagtaggagagagtggatggaggtgctttggaggggatgctgctgtcttaatatacctctgctccgcagactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgaggtaagtagatttttcttttcagaacctctttttttagctgacagtgggttggggcaccccaagccagattaactttgagtttcttctagaaattgcctagagttaagttatcttatagagtgtgtgaaaaatggagtgttttttggaaagaaaaaaaacttgaggccgggtgcggtggctaatgcctgtaattccaggactttgggagaccgaggtgggtggatcatttgaggttaagactttgagaccagcctggccaacatggcaaaactctatctctactaaaaatacaaaaattagccagctgtggtgatgtacacctgtaatctcacctactcaggagactgaggcaggtaagttgcatgaacccaggaggcagaggttgcagtgagctgaaattacaccactgtactccagccagggtgacagagcaagactctgt

SEQ ID NO: 111808 - DNA, 1095 bp, Homo sapiens
ccaccgaatgccagcctgggcgaccgagcaagactttgtctcaaacaacaacaacaacaacaacaacagacaaacaaaaacccttttgctgggcacttctccttgctgctgccacgtgaaaaaggacgtgtttgtgtccccttctgccatgactgtaagtttcctgaggcctccccagccatgctgagctgtgagtcaattaaacctctttcctttataaatgactcagtctcaggtatgtccttattagcagcatgagaacagactaataaatatgtgcatccattatgacagtgactaattgcattttaataattggcttaggtatctgtctttcttcccaatgtactggaagctccatggggtgcagtgaccaagtcctttggtctctgactgtctactatttaatgaatatttgtggaatatgtaaattaaacatcttcaactgtggtttaaattcataggacacatggaaaaactaacactataggacacaattattaaaaagtatttaaaagtaatgacaaaaaacgcagttactttgcacccacctaatagccggaaccataggacttagttcaggaaacccaaatataggttcaagaaaggggaatcaggccctgaaaatgaatggctttgttaggaatatgcatatgtgcagtgcaggctgctaagagctccttacagggctgagtgggtcgtgagatctgggatttgtagaaaaacatggctttttagggagctgtccaaaccttctatggggcctgttagtctctacatgtgccttttgcggtcattcactggatttgatttctgtcacttgtggctttatgatgctattgtttaggctggataagacagaacattccagaagcttctgctccagtgttttctcccaactgagtcagctgactccatcaattgtatgccagggggcctggggcaaaggaaggggagggcatgtagcccctttcgccagttagtacagattggtgtggtggtgggaaacctctgagatggggaagggccaagcaagactgtggagggcctaactcatctgacacaggatttacagtggcacatttcccaaacctt

SEQ ID NO: 111809 - DNA, 1075 bp, Homo sapiens
ccagcttctcttgaaacatgtggatgttctttggtactcgtcataccaagttctgtgtggtagctgtctcggcagaaaagaggctgacccttagaagagacctgccttccctgtttcccactgtcttagtccattcaggctgctgtcacaaaatagcatagactgggtggcttataaacaacagaaatttatttcttacagttctggaggctaggaagtccaagatcaaggccccggcagatttggggtatggtgagggtccactgcctcatagattatggtcttctcactctaacctcacatggcaaatgagctctctggggtaccttttatgagaactaatcccattcgagagggttctacgctcgtgacctaatcacctccaaaggccccacctcctaatctcaccaccttgggggtaaggatatcaacaaaggagttttgaggggacataaacattcagaccacagcacccaccgtcctttgcgcccttattggctcccaaggcccagtgaaggtatccgttgttgtgcatgtgctgttgtgtttcttagagtagagaaatgtttctctatatctgacactccttaccaaaagaaggaaaatgaaagatagcttgagaggatcatgtgtttaacagaaatgggggagggcatgtttctctgtagaaatgaatattgctgctggggtttgacatgcaaacaaatgtacaaacccatggcctgtgtcactcatttgccctagccatctggccccttcagcatctgaattttacacactttccagagacagtgtgaggcagagtgccattgttacactaatgtaatcactcatcacaagtcccattttttaaaattcattttttaattgacaagtcaaaattgtacatatttagggcatgcaacatgatgttttgagagagatatacatatagatatacatagtgaaatggctaaatcaagctgtttaacatacaccttacctcaattacttatctttgttttgtggtaagaacacaaaatctaatctcagcatttttcaaatatacaatattttggggttttattttatttta

SEQ ID NO: 111810 - DNA, 1618 bp, Homo sapiens
aggcacagatgcatttagataccctacaagaatctgaacttgtctcttcctctagatgattgggctggagagccagtcctttaagaagacttcatcttttgatttcactggtcatttcatctgccctttcccccacatccaccaagctgtgtcaaaagaggaacaaaagagaattactgggatcattttttccttaaaaaagaaaaataatcactggagcagcagcctttcttgttagcatccataactgcacgcttcatttctcccactggtctgcacttgctgcggccagataaaaaagcccaggcctagtctactttgaatcactgcactctccagtcagtaaagctattttattccaggtggcaatggatatcttcctttaactgagtttccaaaagtaattaagtgagtacctgaaatctggcagttaaaggcagtttttcaaaaagcaccatggcaaagcataatgtaatttttaaagttcacattgccaagggaagacaaggcccactgtctgagcgtctcgagggtcagtttcctttgagcaatcatgttcaaggaaaaaagaaactgaatcctttctccactcctgtccatgtccaaatccatggtgagctgtgtttgaggatgtaaactcttgctttgggtgactagagtaaagcaatccaattatagtaaatatgtgagttttcttatatggccttgaaaggctgtttcaaggagccctataggatgagtgatcttccccgtggttcccatatagccagcccttagattctctgtgtgtctccatttctctgggtgagggggtggctgtaaggcaacttggctggggcctgagtttgtgttgatatttccaagtgtttttctccatgaggaatggactctgttctgataagtaatagtacagggaagtggactttcagagctgctcaatcccagctaaggaggactgcacggtgtattgtatgaaactaaaggacagggctagtttcagtgggcaggtgtggaaatactgttgtcattagaggtaagtcacacatcgctattctgctttttcctggattacctgtagggtggtaggtagcatgggacagtgggaaagattgaggatgttacactcctgggcatgaaacctagcttccactatgtcccagctcggtgaccgtgggctgtttaatcttacttgattcatgttttccccatctgtaaatagggataataaggactaacgatcacatctgctttgtcaaataattcttataaccttaaggtgtgatctttctgggatatagttagtgcttaataggtgatagcaactttatttttattagaagccacacaaagaaaatacgtgagatttggagtcagattccatatgttcaaatcctatccttgccagtataagctttatgacttacgtcaaataacttacttggtcctcaatttcattgcttgtaaaactggggatatgagctgttagctaacttgggcacagtgatgcatttaccatgaaactcgcaaagttaagctttgggtctctcacttgcacagacccttgcgaagccctgtacctcattctatatcccaaattttcttttttcttaagaaggac

SEQ ID NO: 111811 - DNA, 1378 bp, Homo sapiens
cccgctaacttgcgagcgcctctagagcaggggaatgtcccagccaccttgaatccccagcgcgtggcccatgggaggccctcagacctatctgcggaatgagtaaatgagtgtgtgaaccaggttcggcaatttcggtggggcgagcgctgggcctgcggtgcagggcgctgggagcggccaggccgggcctggctcaggcgccgcagccactcagggccaccggggaccggccggggagggcgcgggccgaatcactgccgccgccgcagggcacatgactgcggcctccgcccccgcccgcctccccgcgcagtcgccggcggttgcctcgcggggttgcggcgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaaggtgaggcggggcgggctgtgtgtgtgttgtggagtcgtccagctcaccctcccatccctgctgctacatcttgtatgggaaagaccagcactcaggcagaccctccgcgctagagctcttcttgcgtccctgtcttccagggcttggtaggcgagggttaaagaaggatgaggaaggatggagccgactctgttccctttacagtgataagtaaggctatggatcctgacttttaaaaaggccttcggttgtgttctgtcgtttgcatctctccccactccttccgtctacaccccaatctcaggtgggcccaaacttgtttccttcccacttcatgaagaaacagaactgaatgaaagacaccgcagaagaggcaggttatgttgtctgcttgctgtagcctttgaagtggtgtgcgcctggggatgagacgtgggtgtgcggtctattgtgttcttgccctcttgggctgggcaggggcagttggtagctgggccagtcctttaggctgggtgacaattcatccatcagtctttgctgaacgctgacttagtggctttgtatcttgtaccaacagtctgtgttgctttgtc

SEQ ID NO: 111812 - DNA, 1054 bp, Homo sapiens
taaaaataaaagaaaaagaaaaaatctttaatacatctcagatgtcaatatttattctggatattttaaaaggcttttctttatagtgttttttacagctgtttatatcaactcagctgctacttcaatggttttccctttcactctctatttatctttttgattgattaatataaatgtttttactctaaaaagtgaaaggtaaaagcagacctatagcagctgagtcagtactgacaactacaaaacaaatgttcctgcagggggctggaggaacttcttatacttaatagacagatggaaagataagacttggctcgtttctttttctttctttttttaatttggtctcatgtcaagtttgatgttatgaaatgattatccagaagttttttttttttaagtgaaagcagacaaaagagaaaatcttaatttaagcttttaaagcatatatacaaattattttctttgctcaaggatagaaatggtttatgccaggctaggagtagaaaacatttattttaatcatatgattaattcaaattggaaatgttcttgttaaatttatagctcaaaagacaggtggagaataaattgtttcagctttattaatactgttcttgtggaataaagtattagaattgaaaggaacatgagagatcgtctagaatactctttccaattacagatgaaaaaaatggaaacacagggaagttatgtaacagaaactagacaagaacctaaggtgtttggctcttcgcctgatcatattgcccctcggatcatgttcatgtacccattccttgccaggcaaacataattgtgtaacagtaaagtttgtgtttcttccccttactgtatttactaagtgtgtactgatttagtctttcctgataataacaaaagtgaagagattttatcaattgatattgttcattcatttttcttaggaagtaacctgtgttacagagcttgaatttttatgggactttttcatttcttttcctgtatatgccccaaaaggagcacaagaagtacttttttgtttttttaa

SEQ ID NO: 111813 - DNA, 1031 bp, Homo sapiens
gaaaaacctagcgttaaaaactcccaaagcattctcactgtacaattctacacaattataattaataggattcaaactacacatcagagattatgttaccattttacccagtttgatggccacggatgcttctttcctttactggttatgttcaaagagatttgggcctgttataatcaaatgtaggaaaaaacatccctattcttcctggattctatggaggtagcaggaataagagaataaaagaaaagccaattttaaactcccaaatgaaccgcagctgctccaggccctttccaatccccgcccccctgctgctgttgacctgttaatagattcctgctctttagcttaactcaactttcacagggagctggacctaaaaccagttttgaacagtttttgaaggtacacagagctcctgtccaaatacaggatgcaggtttatggtaggtaaaattcacatatcattattcctctataatttgtctccaataaattcaagaacattcacttccaacgttgtactttctgcctggtaaaaatgcttccatcaaacaaacaaacaaactacaaagagggtcacagaacttccaaagtatgtgtgtgacaggataattgtatggcatttgatttatatctcaataaaactgttcttttcttaaaagtatatgtgtagttgggaagggggaaaaaataaaattattaaatgtagaattttcttgatttaaagctattatcactagaggaggggcaaaggggaattactgtttaatgagtgcagagtttcagtatgggaagatgaaaaagttccggaaccagatagtggtgatggttgcacaacaatgtactcaacgctactgaaaaagtaatattatcatttaacaaaaccattactctaacaagattacatgttcattgtagagacttcagaaaaagatacaaaagaggaaaatatgaatcacttaaaatcccactacaaagacacaatcagttttaatacttttatatacatattctcccaaattttg

SEQ ID NO: 111814 - DNA, 1050 bp, Homo sapiens
ctggaggcagcagcaattttttagaataatttgaaaaccctttgttttgaaggatttggttacctaattaggttagagaagcttgtgtgctttgtacacaaggagagatgatctctatgcttttcctagactctcaaagccatttgtgttaattatatgacctccactaagcactcaaggtctggcctatgatatgttttctgtactcttccaaatgctcatacattcattattaagaaacttggcttcagagcatcagattactgcatttcttgtaaaccagcttagtggcaacaaaatccaattcatctctagacattgggttttcttagatgagctcttctatttttctgtcccttggttaaagaagagctgcaaataggtctgcagagctacttggttatcagttttacttactatcaaaagatctgactgtataacctttgttcttagatatttgctgtgtgtaatttattttattttttggttactaaaacattttcctttttcttaagcagaaatagcacatgactaagaattagaatatgcagtctctcctttcatctcttaatccctcacatataacctgatgcattaagataatgcttttgggaatgtgctatgggtttcaacaacatgtgtgactgctaatgagctgggataggcttggctatgatttctctaaggctggagttcctacgagtgtggagaaatacatattaaaggattaaagatataagagaatgttcatgaactatatcttaactagttcttgtttttaatttatttattttttgagacagagtctcactctgttgcccaggctggagtgcagcggcctcatctcggctcactgcaagctctgcctcctgggttcacgccattctcctgcctcagcctcccaagtagctgggactacaggtgcccaccaccacgcccggctaatttttaatatttttagtagagatggggtttcaccgtgttagccaggatggtctcgatcttctgacctcgtgatccaccccccactcggcctcccaaagtgctagg

SEQ ID NO: 111815 - DNA, 1034 bp, Homo sapiens
ccaagtcaggagtgacctgagagtttgcagatgactacaacaaggaagcatggcaggtaggaatctgatagcaggatgttccaactgggtgtgggtagaaaaaatgttctgaaatttgaatattggtgaaggacttaaaaaaaacttcaagtattaagggcctactctacttttcctttattaattaattcattcatgcaacatgtatttgttcttttggggacaccattatctactcatttggccatatctgcagatgctcccaaacatggtggagctggcttttgatggccagaatcccagattctgttataataatctcctttcaatgagttccccaaggacctattacccactagtatagtggagggctgttctgatcagtatgcagcctttccttgatcactgtcatcatattggccatcattgtttagttacactaatatagtatatggctttatgtttcttaggctgtagggagctgcctgttttagaattagatggaagaagttgtgataagctttgcctttggacagatctgggtttaaatcttagctctgctatttataacttcataacttcgggaaacttaatattgctgagtcttagtttcttatctacaaaatatttacctcataaatattggtgagaattaaataacatgtgtgtgtcaaactccaaacagatagtaggcacaaccagagatgttagttctctttcctttcccttgttttccttccttcacctttatgttaatgttgcttctgctattttatttctagcttctatcatgtccagggtctgggttctgatcagaagccttcctctagggatggttgaaattatcaagccaacttccagattggcatagagtcactctgattgtttactttagtgtgccatgttatgcttctcaaggtgttttataaaatgtttctaatcttactctttaatactgtgaggtatataagtgaggcattagtattcctaatttatggaagagaatataagatactgaaagtagctaacattta

SEQ ID NO: 111816 - DNA, 1044 bp, Homo sapiens
tctgaagaagttgagatttgtctttgtgctctgctattaacagcatcctaatgaagcactcaagctactcccatcttctctctgcttcctccatactgcgccccccagcccaatctccctaaaatctttccttcctgagaattgttcctccatatctgcctctttcctggatcctcatccaaacttgcctttgcatttcttactccctcagagccttgctaggagatgatttgctaatctttgacatggctaagaatagtaaatgtcctttgagaacaatacaatcttgcactaacatacaacgggaataataaagttactattcatattttaaagggcaattttgcaggttgtcaacatcttaccctaaaggagtgagttcccaatggtgtaatctcagtgacaaactgtataccgtgataggtgacaggaccttcaggtcatgggcagaaagtgatcttaataaaggctgaccttggccactgcagcctgcatgttctggggcatcctgaggtctccctgtgtgactgacacttcccctgaggactattcccagtgcagtcagtaggaaaccttagtggtcaatgatggtgggccagggaggtgagggacagaggatgtgtcagatatcctaatagtatatacagtttaaagactcatttcataattttgggagttgttttctagggatattgtgatcgttcaaatgtaaatatctgcatcttgaatatactggaaaaaagtgattggcatgttttaggggcagctctagcagtataacagtgtacgggtttgcccctttatggtttgtgggtaggaagagatttattctgaactagttttctctgctacccaactgcttatgaaatatgaacacaggctgggttcagtggctcaagcctgtaatcccagcgctttgggaggccaaagcaggtggatcacttgaggtcaggagttcgagaccagcctggtcaacacggttaaaccctgtctctactaaaaatacaaaagattagccaggtgtggtagcacacgcctgtagtc

SEQ ID NO: 111817 - DNA, 1207 bp, Homo sapiens
aatctgtgctaatcatcctcaagtgtgttttttcttccaatgattacagccagttggagttttccatttttttcagcagttagctaaagtgtctttataaaaacattttcctataataaaataacacattagtgacatttaatataaacataaaaattactgctttgatgaataaaagcaccagaaatggcattacccatcagatgaaatatgatcatcacacaagtctacagcaatcacttaaaaatatagtgtatatgcaagtgattttaaaatatggatccataggtaggtagacacaaagtgaatttataaatgttgaagttgttaaagagaaatgaacattggaaagctaaatagatattgaacatttttatatttcaaaaatctaccttcggttatgaattacaacctagagaatatataaatcaaaggtaatttcctgagttaagtgtaaatcattttttgtatggagagggataaataccctcatcttattccctaatcttagccctaatcattgtcttccataaaaaccccagtatcctaaaaaggtacagaaaggaagaggagagagctggttgaaaaacttcttaacaatacttaaaagtaaacaaagtcacaaaccccacgtttcatattaagagtgtagaaagcccttgttcaggtctgcagagtaccagggcactccaaatatgtaatttaacacattcattaataactatgataaatagatattttattccaagaacaatatcattagagagttagattggagggcaaggggattaagtatcttaagtttattgtttcccgagtgaccatttttaaaagcctccttccaggaactgtggaatgcctgccaggctccctgactgctgtctggtgagggtccctactggtgctgtggacagcacaatacacaatggggcacaagaaagccacgcagcctccccctcctagacacatgctgtgcacccccttggctctgcttggaaggttcagctctgcaaatggaaggttgcaaacatcagacaccttctttctgtttctgtctctctccccttcttctccccacagtgtccagccttggcccctgacttttcctggggttggggaggcctgtaggttcagaagctgagcagctgggtgaagacctcccttagctcaatgtgctctggccatagggagcagacaagcaagctga

SEQ ID NO: 111818 - DNA, 1979 bp, Homo sapiens
gtgagggcagagaacataacctattgataccagtgcctagtgtagcgcctggtgcatgcagatactcaaatatttgttgactgagtgagggagtgagggtgtgacatgaataaacaatagtaaggccatagaaatgccatcctagtctcaagagtcacagagatgtatgtaatcgcaggatgtcacttacataaaaactttaactttgaaaagttaaaaaacataaaattagaggtgaggacatcatgggacaattacagtgtttgaaccagtgtcaacaatttcatcccttgttaggcactcattcatagtttaattaataaatcacattgcattggaagtgtagctccaaaggaccctgatgtcagactaacacctgctatgtgacaattggggagggaacagggaaccattggaacgccatgaattccactaaatcagtgcaaatctggatttggtgcatttaacaaatggacattgagactcacagatttgttatggagtagagaaaggaagcctgaatcttgacaatgccagtatctaagggaacatttgggtgtattgaacataaacccactaagaccaactcaaataaaaagagatgaagatatcaagatatgaaggaagcttgtgaaatccaactataggaagccaggaacacctcaacattaacttagtggtgaaaagctcttagagtcagaaggcctgcatgtgagttccaaccttggcattgctgaatttgtgaccttggataagttacctcatatttctgaacctcatttacttgtctaaaaagaaggaataatcaaagtttctaccttgttgtgttgttgtgtagtttcagtgagataatacatataaagcacttggaacactgcctgacacgtaataggaactcagtaaccattaactcttattattatttagaaagtaggcagctattcactttctttttggattacatagttgttcatttcagctgactttgaacgtcagttccattgctctgtctgcagactggctttctgacagacatggtgccagggttaatttaatggcatggtgatgtcatcaaagctccaggtttgtctgtgttttcattctgccacccttagcatgatgattttcttccttacatttgttcctcatggttgcaaggtgtttgctgcagctccaggcatcacgtcctcacagagtcttgtccaaacaagggaaggagttctagttttgtgtatttcatcaagaatgagaaatactttttcaaaaatcctcctgcaaactctctttttttaggagtcagatctcattagttaggcttatgtcctatatccttgcctacactagtaactggcagggagtcagattaccaagaatagtatagaccaggcatggttaatcccttagggtgatgaaggagctgcctttctgagcacatcattatctgatcctgcaatggaatcaaaattatacttgtggagtaaaacaggggacagtaaccattgagtaaacaattatgagggcctgttttagataagcaagtttctaagccaggcaaatcagagtgtttctttgtaattttatctttttgtacatggagtctaagaggaggcagaactcttgcagttgttaatctgggataaggtaaacctgaagttctctgctccatggttgttttctgtgtactttacccctgcatgcacacacactgaatcctattgcaaagataaaagtgaggtcttttttttcaccttgctctctctgtctatatactgtcatgcaccccataataatttgggtcaatgatggaccccatgcatgacagtggttccataaactgataatggagcatacacagaagtgatatatagtacttgatattatccctgcagatcaagtaggggaaatgtttgatattcagtaatgtgctgggacattttcatatgaaaaaatagagagccaggtgtggtggcttgtgccta

SEQ ID NO: 111819 - DNA, 1003 bp, Homo sapiens
ccttctcacccaaatacccaatagtatgtttaaataatagcattgggattggaacccaggcagtctgggagctccaggcccctagtctcaaccaatatgctatcctttaataccaggcaaatggaagggagactccggaaaggaaaagcagatgacattttatcaaatcagtattggtatagaatgacatagatgttataatgcattgagctagaatggaaaattttatcctggagaacccttcttaatggtgtttttaaatctgtgtgccagtagagcccatactaatggagtgctagtcctcaatattctcccctaacacccattctcactctgctaataaactgtccctcaaaatcaaaatgaaagtgtcacgtatgtacactttccttttggaaagcattttggtatttttctacctgacagctaggaaaacagataattgattgatttgttgcctttattgtttttaagtgcctcttacttcgtgcatagaatttggggcatttcctgaggagtaataagccctcaggaggagaccttatcctccaaggtatagaaagtcctagcagacgttggtggccaggaagtgccctagactggaattatttttgttgttctaatctgaaaatgacaacatagaacacagccaacagcatgcagcattttattatggtgatgcagctttaattggtatgtagagggcatgcctgtgaaattagtccttagtgtattggccaatcagatcactttcaacgtttcccaatgtttagtttcatcttataattaagtaataatgatcatttcctggcagctaatgactagctagaggagttagaagcctcattaggtttataatttatcaaactctaagcttttcatcagtagtgttgcaaaaagagaaagcatcttcaaattccaaaatgattcaaaacaatctctaaccgtatttcatatatgtattcacttgttctttgaagggtgactttatttttaaactttt

SEQ ID NO: 111820 - DNA, 1250 bp, Homo sapiens
gagttcctaatggttggggtatttattaaataagtacagcctgatggagggacagccagacctaccattcaggttgtagaattctagaaatgtggaactcagggactcttccaaagaaattctgtcctgcctaaatcaggtctgaaaggcctctggagaaatggaacaacagcctatgtgtactcactctcttggtctttcattggagtcactcctgggaatccctcaaagatattttctgtccacacactcatgagttccttgaagcagagtaatcttaggtgctcagagaaactccgtagttccttcaccataggagccacttgagatgtgaggtcctctggatcatcagggttggcaaaagcacgcagcagaactccagggaaactgctggcatttggtttgtgctgtcagatcaatcctaggatttcaacatcagaaatacccattattgtcctctctgaaatctgtgggcattagccctggtgcctcatgtaaaagttagccttctggtttccaaaccaattctcttcgtggtagactcttcatgaccaagaattgggacttcccagctctcatgttaccaagtccagttctccaagatggttcctgggaatgcttcttcacgtctgagtaccttgtcctgagcatgtttcataaatgggtaaaatgtgtgattgatgtctcttttattttattgaaagcttgttttcttctgtagcagttctgaaatttcaagatgttcttcattactttgttttaattgccatgtgacaaatatttcaagaaacacccagctattttaaaatttttgacagacttcatgatggaaagacatacacacagccctacttgtttaataaatactccaaccattaggaactctaagggaaagaagttggtaattatttaatgaaccttctgtgtagtcactttcacataaagtatagctaaggactcagaagcagccttttacttcagccctgaaattactactattagtaatttaaaatcacttttcctaatgtgcctagcagtctcatttacctataccacaggtcctcaaataacattgttttgttcaacactgtttcactataaattgatgaggaaaaaaaattgatttccagctggggtcactatctgtgtagaatttgcactttcttcccatgtctgtgtgggttttccccagggactctgttttcccccacatcccagggatatgcatgttagatgagttggcgtgtcta

SEQ ID NO: 111821 - DNA, 1113 bp, Homo sapiens
gccctcctctcccatgccaatctcattgctggcctgttgtggatatggtggtaagcaagggcggctgcctggctctgatgcttcccagacttgggacccaaaactcaagaagacaacgaaacatgtaagtgagggcttcatgggcctgtgtttcctattagccagtattcctgggtaaagttttctggggagaaggggcaaatgtgaagacaccactacagcgttactcttccttcccccgttaagtaaatgggaagttcttacttggcacacaagaataaaatgaatgttgactgcctcttccagtcacctttgggctgattttaggttagacgacgttttccctaaaggaatcttatttctgcaaacttcttttttaaaactcaaaataatgtctgcttgttcacttttatgttagaaagttataatacgagagtaattatggttactcttgtaaccataattttgcttatacattggttttgctattttcctttctgaatggtgtttattttagattttagctcctctcttgtgttatgttgctaacatttttgtcagctgccagattattacaagcagataaagggggagttttcttctaaagagacccccatagttcacgctcaaagaatttgttttgtataccctgtgagggggtgagggaaataattcattggtgtctttgtgtgtgtgtctacgtgtgtcgttagctgtaatctgcaaagatttctgcatctttaagcataaagatcgctttctcattttgtaacatgatttcttttcaaacttgtcatgtaattgaatccagctttgagtgacactttaaaatatgctctcccgcgtcagaagtgcttctttaagccaggtgctcttcacgctcacctgctggcgtgtttgattagcagccagccacagccaggtgccaaatccattctaaatatgggagcctgtgcttgagaagactagtcatactaattattcagacctcctccttggaagtaatgtggcaaaatcacagaagcagaaaagccagaaacagtatgagacttgctattgagggaccataaaatcagaattttgcctcataatattgttttgttcttgggtaca

SEQ ID NO: 111822 - DNA, 1034 bp, Homo sapiens
caaaattttttaagacaaatgaactttaaataaaggccactaattatagcagagaatgtgttggataagagtaggtatatgtaattatatagtaattatgctgaaaatgtaatcacatgccaccggctagctagttaaccattttgctgggggatgaatccacccccagcaaccatctccttctgatctcagagacccacattgactttgttagaatgtgtgatatggtttcttcttagaagggtgaccttttcctggccaattaaaaggtgctgctttgaggatattggaacccatactcaaagggataaaaggaaattgaaacttctattaaaaggagctaatgatgcctggagcagtggggattaaaaaagaacaaagtcagtcttaaaaagatcccccaaatcaaagagctgcttctctcatcaaataccagaagaaagcaaaatgatttttaatgaaaagtggggcaatggattcagccttttccctggatcctagggcttcaatcaaaaccagtgagtagttttaagcaaaattctttgaacatttgggataattatgctacataaatttgacatggtgttgtaaaaggtaaactagcttttcttccaaattagagaaataataaagacaaatatcagaaggataactctaaaaaatcatacagataagagtgctttataactgattccccatctgatacaaaataattcctgggttaaaatctagcattttgatgataaaagtataggaaatcactgtcaaaattgtcctgtggtggacaattgttaggtgattgctgtgattgtaattagcacaaccttggtaggttgtacattccttaatacactttcttatcaccatctgcattagtctacttgggcagccataacaaaataccacagaccatgtggcttaagcaacagaaatgtatttttgacagctctggtggctgtaaagtccaagatcaaggtgcttgcagaattcaatttctggtgagggcattcttcctggctcgcaggtggcttcct

SEQ ID NO: 111823 - DNA, 1064 bp, Homo sapiens
agctgggactacaggcgcccaccaccacgcccggctaattttttgtattttagtagacacggggtttcactgtgttagccaggttggtcttgatctcctgacctcacgatctgcccgcctcggcctcccaaagtactgggattacaggcgtaagccactgtacctggcccgacctataccttttacaagtgaatttacaaagtggattttcttctctgaaattttgctcggggaccaaaatttaaataaataccataagtgaaagacattaccctatttctcccacataatcgtcactcacccccatacatgttaagtgctgcctgattaataagagctaaaattcaataagcacttcctttatagcagggactatcctaagtgcttcatataaagtattacatctagaacttcagcaactctgtgattcagattcaatgtttagctaccattttgtaggtgagaaactgcttcatggggtaagtggtcatcacaagatcacatcataagcgctgcagccaggactcaaatttacctattctgcttcagagactacacttttaaccattaattccatgatgcaatactgtctcaactgaaatgggattccaccttggtggcaaagtcattatgatcaaaatcaatgagcccggcacctcccattcaatatcctccccatgctgtcagcatgacttcttgaacagtgcagatctgatcatgacactggtataaaagttgtagtgatttctctttgcctacaaaataaagtacagatcttgaagatggcctaaagggccattatcttccaccatctgcctctccatctatatcaactgccacctgcccatgccctagtgatgtcacttgcagttccacaactggcctgtgctgtttgatgctttgagatcttcaaactttctgccctgaactattcctcccctcctcttagttagcaagttcatgcacatccttcagaacctctcccaagcatgtcctgtgcatccttccctgacataaatatcctctcctctgtttgctaccaacacatagaactatttatcaaa

SEQ ID NO: 111824 - DNA, 1135 bp, Homo sapiens
aatgtacaaattacaagttccagactggccatgcacaccctttctaagacaggctgtgcacctttttcctatgtgtaactttctcacaaaatattttcgcatttttaaagctttatttcttcattaatatatttgattttaataaaaagtaaaatgctttcgattctaatgtgatgcattatttctgaaagcagtcttaagacaggaactaaagggcagtgtgattttacagagaacatctttaatagtggctgggagtttacacatacacacacttgatatgtgtaactatttcaggtcattctttcgtcttgtggaggaagggacagacaaggagaacggaggtaccagttgagcaaactaacccccagctcatgcagagagacattagcataattttgtattgttgctgaaatttcttcatgtcttacttttgatcccatgagacaagttgtttgcttccatctaaaaatatcggatgatgcctctacattgcagatacaagttaaaagtgtttttccagaatctatgttacaaaggaagcccagggacctctggtcatagtgatgaatttcactggtgtaacatccatgctgtgtgggaggtgagatttggacccaaactgtgtttttaatcaccaatttacagtgatgtttcacacagaagtagagggatctgttccacccttatgagatttcacctgacccagagcacttagaaaacaagataaagcagcagcaggagaggaggccttatctgttctgcccacagagctcctggctgtgttctccagctaatacttcttactcccccccacgcgcaatggcagcggcaatgtgcgttataaactgcaagggctgaccacttcttcaaagcttaagttctggacatcacctccctctcccccaaacaagattgccacaggacacgaggacacagaacaaaccatattaacctctctgcttccaatgcctagcaacaatgtttgtggttaccccatgactgtgtgacagctgtgtatgtgttgatacctgcttgtgataccataggtaaaacaaaatacaattttaaggaggataatactttatggcagggaggagcctgtccatgaaggtttcagtaaagaggtttattc

SEQ ID NO: 111825 - DNA, 1053 bp, Homo sapiens
ttgccagcagaagtaaactccaaagagaggaactacgcactaggcaaactcctttttttttttttttttttcctgaggactgatctgaggactgatttaatgatgattgtcgaagctgagctcccagatgaggctcacaacatcttctgggaatccaaatgaaaggttaacatactatattctcttcccaaagatgtaggtagaaaaaaaaaacaaaactcgatctctctatcaaaattaacgtcatgcttttcagtaaaatgctttggacagagtggtaaatttataatagtttatttaatctattaagcttcagtgatttaatttaagttcaacaaagcatttgggaaagatgttatatattttgccaactccaagtgaggcattttgttgttgggttggtttaattcattcagtaaacatttgtcaaacatttactgagaacgcattagcctctgggaattcaatgatgaataataagacattgtaccctcaagggttcatagacactccagccacaagtgtgaatgtgtacacatttcttttggaatttttctcagagcagagaggtctgtctcaggctagtctttttgtttgtttttttttgtgttttgttgtttgttttaaaagctcctgcttacagtggaggtttaaaatcctagttcttttaattgatgttattttcttaaacattggcatttctcattaaggcttcacttgttattccttactaaaaatagcaaaaacaaaatggtcttatataaaggcaattgagtacagtggaaaggtcagagactgtgcaagtagaatgacctacgtttgaatctgagctctgctacactagtaatttggagagtcctttaagcagctgtttcctcatctgcaagatggtgataatgataccttaagagaggtattaatatttattaggttaaggctgttataaggattaagtgacagaatacatgtaaatataactaggctggcacctgataggtgttaattcctaacatttattgagtacttactaggagtcaagcactgtctaatacg

SEQ ID NO: 111826 - DNA, 1299 bp, Homo sapiens
ggaagaagaacctacaaggatcttagctgtctgcttgtctctgacactctcgaggccttgtgccaggctgctttgctgtgcaaaagctccacttcagtcttttagtctgactcacaatagacgcacatggttgaagttaggagaattgcaggactgtcacttgaagtccctctcagcctcttcaccatcgcccccagcctctttccctctaacattaagccctttgtgtcggttcccatggttacctcctcactactggcagctggaatgtgatagtgagaggaggctgcctcccctactgagccaggtctggctggggcggaggccattgatccgcagctggatttgtgaaatggggtcacagtccagtaccttctctttgtcgtgggttctatacctttcccaggcttgacatatcagggttgcagtgggaggggacatggtgggtgatggactgctcacaggacatgtcctgtcataggctggcctggcctggcgtccctgacctgccaaactcctccctgaggtcacccttccatgtgtgaatgcccattgagggggaaggggctgctctgcttggtcaaataaaaatgatgactcacttctctacctgctttctgctcagattctgttcccaataccatctgttcttaagttagtcaacattaacaagggtgggctccagtctggaaagaatttgcatcaaaggcatgttttcacatccagcttggaagaccaggcaggctctgggaactgggggatagcatagggattcaaggttcaagatgaaaacaaaactagccgagaggtttttgttgttgtttttataagagacagggtcttgttctgttgcccaagtggggtgcagtggtgcaatcatatctcactgcaacctcgaactcctgggctcaaacaatcctcccatctcagcttcctgagtaactaggaccacaggcacatgccaccgcacccagctaattaatttttttttttttttttttggtaagagatgaggtctcactgtgttgcccaggctggtctcaaattcctggcctcaagtgatcctcccaccttgacctcccaaaacactgggattaaggtgtcagccactgtactctgccccgagagtttgtcttgaagctatttcctgacatactatttggaggcttcttaaattccttctcatttagagtctggtgggccccagagttgaggcaggacttggaattacaggtggaaattaagcagccctggtggtgagggtgaggggaggtagtttctagtagaaagcaccaaaaa

SEQ ID NO: 111827 - DNA, 1079 bp, Homo sapiens
gtttgatatgtggttgatacctaccaaagtatacaaagcccagtaatcctaaaaggaatctaatggggtaggtagtggagagggtgaggcctttagccatagctctttctactttttaatttaatttttcttttcttctttacaataaggatgattattgcctcaaatgataagaagattaactgaattactgtttttaaagcacaaataatctggtacataccatgtgcccagtaaatgtaagtttcagttctacgggtaaaaatttaataattattgccaggcactgttctgattgctttatacatattaattcattcaagcctcacatctaccctttgatgaaggtgctattagtattcttattttataggggaaaaaacaggcataagaggttaagtgacctgctcaaacaccttcctaggtgacagagccagaacaggaccccaggcagctggctccggaatccacatcgtccatatacattacacagcctgctgcttgttggagttgtcttaagatctaggctctgagtgcttgtagctaggggcacaccgcttccatgaagatatcatctgttcactataaagcccttgtgagagcccttggttttcttatgcacttgtcctgggctactagctgtgtcaaagggctcagtgggtagagggactgatgtcagcagtaaactgaagcagattaatatttattaggcaggttaaaagatttggcaggtcatttggctttttctcctatccaccctttcctcatctttctgcaaggttgacatagaggtcattggctaagatctggagataattaagcttacggtttcagaaagagtcagaaatatgctgaatgttactggggtatattgtacacctggatttgtttggcaagtttcagggggaaatcaagtgaaaaaaagcagcagccagagcaggaggtgcaaatggacagaggtttgagacatacaaagtgcatctctgcagagctgaagggttatgtgtggccctcctgtaataaaacaagctgtagaccagggtaggtaagcagaaagacaggaggaggctttaagtaca

SEQ ID NO: 111828 - DNA, 1046 bp, Homo sapiens
tatggaaccaccgtcataatgtgcactccattgttggctgaaatgtcattatgtggcacatgactgtaaattgtaagccctatgttagtgtacctcctaattttcctgtcccccaagaagtctctctgcaacccaactgttactgatatgggactaacctaggaaatcagagtcattctcatctagttacgctcagatcctacatcctgtttgttttgctttttacttttttgttttgaaatcattgtagactcacagaaaagttgtaaaaatagtacagagatttcctgtatacctgtcacccagctttctctaatgttaacaccctttataaccgtagtacaaatatcaaaactaagaaatcagcactggtgtaatactattagctaacagacttaactttatataaactataaactttactcagatctcaccattctttcccattaatgtcctgtttctgttctaggatcccacattgtgttcccttagcctcctctgatctgtgatatttcctcagtctttccttggcttttgtgaccttgacacttttgaagagctctgggcagatattttgtagaatgcttactatttgggtgtgtctgatgtgttctcatggttacattgaggtgatggcttttgacaataccacagaagtgatgttgttttcttctgtctcatataagggttacatgatgtcaatatgtctcattactggtgatgattaaccttgattacttggttatggtgaagtccgccaggtttttctattttaaagttactatttgtccctttgtaattaataaataaccttggaaagataattttcaggctatggaaatatcctgtttctcctcaaactttcttcactgatcttggcatctatcagtgttgcctgtgacaactattactataatgttctaaatttgattctttatttctttcattttttctacatttattaattagaatttttaaaaaagcctatttctctcctctacttatttattcattattcattcatgtcagtaaggactcttccatat

SEQ ID NO: 111829 - DNA, 1051 bp, Homo sapiens
actccttcaattcagtaaatctttgttgactgactgtttgaaaaaaaaaaatttgtgtatttgtttcccttgcttcacacaagaacattttcctatcaccctaatctctaaggagttgaagtatatgtttgtgttttgttttgtttttaagtcatcatctattttgggaagctcttcagtgtctgctatatttttaaagttattttagattaagatgcagttaatccagcctctgattaatcttctgactttctagatgagcaaaggcttagctaagaaggggaagtaactcacataaggtcagacagcaagttaataacgaagtcagggcaagagcccaggtctcctgacacctggtctagtatttttctgatgtcctaatacattaaattttattagcttcaggggaattatttttcatttatattacaaaaactaatttattttttcacagaaaagagataggtgcatttttagctacaaggccaagtacaatgagttggaataatttacagctattattttcaccatatccagatggattcctggatcccataaaagtgtttctaaactgcagaaaaatccccctacagtcttacagttcaagaattttcagcatgaaatgcctggtagattacctgactttttttgccaaaaataaggcacagcagctctctcctgactctgactttctatagtccttactgaattatagtccttactgaattcattcttcagtgttgcagtctgaaggacacccacattttctctttgtctttgtcaattctttgtgttgtaagggcaggatgtttaaaagttgaagtcattgacttgcaaaatgagaaatttcagagggcattttgttctctagaccatgtagcttagagcagtgttcacactgaggttgctgctaatgtttctgcagttcttaccaatagtatcatttacccagcaacaggatatgatagaggacttcgaaaaccccagaaaatgttttgccatatatccaaagccctttgggaaatggaaaggaattgcgggctcccatttt

SEQ ID NO: 111830 - DNA, 1050 bp, Homo sapiens
acaaaaaaaaagtcaagtgcctaatattccaggcatataatttgttggtgcaaggtacttagcagagtgtctggcacacagtaaatacccagtaccggtagctgcaattattaataatgttcaggggtttgtttcttctgcctgctcccacctttgaccctttctattgcttattagtttctcaaccactaaacaaaaacaatgaggaacggggtgaagagcagttaacccattgggcagggttaaatggcaaaataaattactgaaattaagttagagattatatatggatttaatttttctggtttttgcctgtctcctgtcataaataattgggagtttaatatattatcatcaatggcaacatcatcatcttcatcatggacctgatcacagggaccaaactgtatactatcaaaaactgacaaccctttcaggactccagtatataccctcattaaaacaaaaacaactacccctgaaaaggccccagagttattgatctcacatgtgagtgaactttttcctagaatttattgcacccgattacaatccaaattcatatcttcactaattgtaactaggaacatttgagatttttgcaaaatgtaatagactgtcctttcccgtcatctctcatatttccctattgccatttgaaaagtttggcccattgaattcattgtcttcgttatcctatttcaagtttagcagttgttttgaactccagagataatcgttaggagacttctcttagttaggaaacatccttgttagaggaggcacctggtgagacagactgaagttcaaattctgactctgctttttttttttttttttttttttaaatcttcggcttatctcctgcatcgatgccatgggattatgtaagagtgccaccacgtggcctgacaatagtaggttgccagtaaataggtgttccttctcctttttacctccaccctcttggtaaatttaaacacccgtttattggcagtaatgctgtgcctttcttgtgtttcaaggatgtgcttttggggcaagacagtg

SEQ ID NO: 111831 - DNA, 1038 bp, Homo sapiens
tgggagctatttcctgaagtagtcctaaaaggggctgaagaaatgtactgtttgtttttatagcctgaagcctgtcctcaaaagctgccttatgttgcatggtgtgtacaggatgtgggggcggtgagagggttaataaaagaaaatgccttgtgaacccagtcattccatgtgacattttcctgtaggaatttatgcctgcctagtactggtttaacttgggtcttcctgtgagcagccagggaagacagtgtgcagtttctgggggaaggaaaagaggtcctccttcctcttaaatgcttttctcatctatgtaaggagcattgggctgcatgtttgcccctttcttcagagctgtaaccctcctgtctgtgtgccgttccaggtcactcagttgttcagaaagaggccaagaagagatgctgccgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcc

SEQ ID NO: 111832 - DNA, 1039 bp, Homo sapiens
gagcttttgcagcactgagaccttcctggggatttaaaaaaaaaaaaaaaaaggcatgcgccatctcctggtggaaataagcattgtcctgttgggcatgagatggccagtagccattgtgagggttggtcagatgccagagaatcccatttgtaatgcggtggacatatctgaaaacaaaaacaaacaaaaatgtatcagaaaatcttttccctgtctttcaattaactggattaaatgtggtcattgttgcttactgggacagttatcaagcaggaaactagtaaagatgattttttgtgtgtgtggttcctaatttcatagtaaaatgatgggctagatgttaaataatatcacaagattaaataaagttcctctccaagagaatcgtacttccatagagtcatttattcagtgggtaggatatgaattataggctgaaaggcaactcaaatgtggtaaaacagagaactactagatagcaggtttctcaattctgagttttttcttcagccttaaaacatccctattatattatcaatgagtagattttatatcttgtattagttcactgcggaccagcaaactgcagatttcccaggattatatgggatagcaggcacacttgagaaggaaaaattttgtgtgttcaagcaacagtgcatagtaggcactagaaagattacatgtaaccaaaggagtataggaaataattgacctaaaacctgaggtttgtgcagcaccttgaaaatactttcacattgattgagtcatggttccacactgcctttctctgaaataaggagtcagtgtcgttcttatatgaatcacaaaagcagagaggttaaatgtcttctccagagtcagctggcgaggccatagccttgactcccactgtcatccctaatgctgcttttggtggttttccatcccaagtttgcctggcttcaacagccctgtacatagtaatcactcattagttaacagttactagtttatcctaatttctgggaaagaaattaaatagaattgttacgca

SEQ ID NO: 111833 - DNA, 1042 bp, Homo sapiens
gcagtgctggaatctagttgttagcatttgatactcctacagagatttcaaatgttaagacacttaaaaaatgaccgtgatgctgctgctgtcttcccacatgccatggagatctaaactgggctgtgtctgcaggggagaaagttctcgccttccactttctctatagcaccagaggggctgccttctgctgtgcttgcagctctctatgcagctcaggcatgtgtgctgcaaaggaaagcttgcttgcttcttgctgagcctggaaggtaagtggttttcagtgatcctgattccaggagaaactttctagggtgattttatttcatttgatctacaatgtgtcccaagctgtcttgtctgttggaatgaaaccacaggatatagaccctaggagcagagggtaactggacaggagggatctttgcagcacctctgggtcatggctaacatgctgatgcaaccattgtagtagcaagctccctgctagcccaaagttttcctatttacatacttgtcattgtatacccctgatatatatacctaccccagcactgctgagcacttcatttaacgggtcccctgattgcaaataagaccacttggcttttggtctgtctatatttatcccaaagagagagctatgtatacacccttacatgtatcacgttgccatggcatctttaactgaacgttttacacaatttttttgttattttgttttctgcctttgggcatacctgctttacagttgcagtgtggcaaatactcattgcttttcctccctatcttaatttttaagtgtttttttttctaagttttattttagaatcggggcataggcaggtttgttacaaaggtatattgcatgatcctgaggcttgctgtatgattgtatgcatcaaccaggtagcgagcatagtacccaataggtagttttttaacctttgtcccctttccttccaaccctcttttattccccagtgtctgctggtcccatatttatgtccatgtgtacccaattaactgttttcccatcact

SEQ ID NO: 111834 - DNA, 1903 bp, Homo sapiens
tagctggtattacaggcatgcatcaccatgcctaggtgatttttgtatttttagtagagacggggtttcaccatgttggccaggctgggtttgaactcctggcctcaagtgatccatccatcccggcctcccaaagtgctggaattataggcgtgagccaccaagcccagctgatgattggtttttaaagtcaagaatctgaaagcaattttatctccagccaatttaatgtaacagctctcaaactgaagctatcctatgatgttacaatttagagaatgctgtaatatgtaatataaggataatctgattttcaaaaagttagcctccttacttaggagtgacaataggaatagagcttagatatttcccagtcctgtcagaggtgtccttgcagggagtctggctcttttctccctttccctggccttcattgatctgtccaattttccctggcagagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagatagtcacgttgagcgtgaagactttttttcttacattcctgtcttatttttaccaacacgagcaggcattctgcgcttccactggactgagtatgggggagtcctgctcccctcctgtctcacaccttccccaggaggaaggcctcatgcactgcggttattgcatcatttcctagtgcttcatgtcattatcactggtggggaaacaaagctaaattttattaacaaagacaactctcagacctatataataggaggaggacgtccagaatccaacaaaattcaaacggagcccatgctgttctcctgaacaagatttgggctaaatacggcctgtttattgaggctgttttaatgatgctttaaaaaaaaaaaatgttttctaaaatgtcaaacctgttgaccacactttgattaaaaactgcctccttaacctctgaagactgattttgctttatcatgtt

SEQ ID NO: 111835 - DNA, 1002 bp, Homo sapiens
aatgagccctcacaagccaagccaggtggaagacagccagcaaacgtctacagttattcttagtgaaattcctcagaggaatccagggggctcccagttcccaacactcttcgagatgaccatttttcgggatttgactggggaacattttacatattcagtctttctcaaaaatttttatttattttcttgagaaagggtcttactatgttgcccaggctggagtgcagagtggtgcgataacagctcattgcagtctgaacctctgaggctcaagccatcctcccatctcagcctcccaagtagctgggaccacaggtgtgcaccactatgcttggctaattttttgattttttatagagacgggggtctcgctatgttgcccaggctggtttcaaactcctgggctcaagggatccttccgctttggtcccagaagtgctgggattacaggcatgagccacttcacccagccacttttctaatttatagacataaaagtaattgactcccacagcacagtaacaggcaatgctgcttggcatgccacaaacatctgaaagcttgtgacactcctaggattgtgtccattctttcattatgtggaaactttgttctgttatgtgaaatgggtaaggcaccaagtgagactttgaaatctaatttttaggtggatgtgatatttattgtaataggacttgacctctgtactttaaagaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtaaggagcatgttgttggtcagggtttcagaatacgcgtgatgtcactgagaatgtttgctcacagtcaataattgtctttgtggatgtgataattttggagatacacttct

SEQ ID NO: 111836 - DNA, 1077 bp, Homo sapiens
ttcctggggaagcgaatggtcccttccaggcgggtggccatgttgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctgtgagtgctggggcctcgcctgctgctcctcgggcgccgggtggtctctgctctggggcgggtgcggtgaggaccacaggggagccgggcgggtgctcggccccgcggcggcggcgacggctgtgggtgtgtgcacgaatttgggcgcgcgtctggggtcggggttaggagcccaggggctcagttacgtgatgcaacagtggatcgcctcgtcgcgcccctcttctgggaatgcgaaagaaaaaggacccctctcctgttccctttaaaataattctttgaggcgcggcgtgtctcagccgcctccctctgcccgcgcacctcttccctcgtgacagccagaagggcgccgggttcggggctttcctccagtctcccccgcgccgagggggcgctcagggcatgggaattgcgagctgaagtgctgcgtgtggcactgctgtagaagcaggtcagaggggtgggatttccgtggtggcctccccagcgcattgtgagatcccggacaccctcgggcatccacccggctgagcgggccctgcccaggatgtggacaaagccccagataacacacacaaagttttctggaggctcccttgtggtgtgggtggaaggactgaaatgttctgcggctgaaaggccgggggcggcgggctgaggaggctgggacgcgaggaagaggaagggcgggcgggtgcgtgaagaatcgagtgccccacggcgggagggaggagagtaggagggaggagatacctttgccccgagtgtgtgggccaaggcgccgcgcctactgggttgcaagactcggtccgcgccccg

SEQ ID NO: 111837 - DNA, 2146 bp, Homo sapiens
gcggcggcggcctttccttttttttgaaaggagcggagctgggtgggaaaggcggagtcctcctgttttccctttccccttttcatcgtcgatgttcacagtccactcgccttactggctttgggggcgcctcgggcgatgtctttccctgtctatcacctcctcttccctttttcttcttccctttcccacagctgtgcagctgcaggtggtggctcgggagattttgtagttacagacgaaagacttactgagatactggaagctcggaaatcccagaaatgcaaggctgtgctctcaggctcccggctcttccccctctccccgcctaactcctccccagatacgcgcgccttttgcaccctaccccctcgggagaagttcatgggtccctttgcggattctaattcgatttggtggttcggctgcccgcggtgctttcaaagacgttttctgcagtcagaaaacacagcggtcatatcgaatcatgactgtcttttaggccttttcaactctacgatttaatgacatggctcttttaagaattctggtcttcttttgcacataaattgtgctcttgataattagtggtcacatgtaggttattgttactgagggaatttgcatagtctctgggctagtcgttttatttttggtgagaaaattgaggtctatagaggtgaaatttatctggttaaattactcctccccctgccccccattatacttattagcaggcatagattcagagaactaaaataacaatatctgctttagataaattggcaaacgtttaggattgcaaatattcagtgggggtgtttggctttttcagtaacacgtattattgctggtgcattcttgagggatggaggaggtggaagaaataattagctgcacattttctataaattagttcatatatgtcagttaaataggaacagtatgtggatttaaggtttagttgtgtggccgtaatcacatccaacaccaagtcggccaaccatatgtgagcttaatcccacagaattcttatgttagacctccctcttcagataatagaggagattttttttaagtatacgtgcacagaggaagtgacttctttctgcgcactctgttgtcactggaattaaaattaaattacaatctaaagacagaagacttttcttttggaaacctaatgtacgagtgattaggaattgactataaagttagaaagtctacagaaaatatgtgatcacatttcacagataattgttgaatcctttcactttgttcattgggctattgtcttaagtgtggtctctgcagttatggctttaaaacaaagtcaatgaatggggaagactcttgagacacagctccatggaatctacactgcacctttaaagttaagagttctctggccctcccatttcttatctagtctgtgatttcaccaaaagaaaggaagggtgcgctgagggaaaagaaccactccgaagttgatttatgtgtgaatggaatttccctaggtatttaattagattttttaaaaagttatttaggacatatatctccttttgcgataactacctctccccgccagactgaagaaaaatgcaatctgaataacttaccctaaatttttgatattcttgaatgggaacatctgagtgtgatatcccaggtaaatatgacattttagtgggcaaaaatgcttacatgtcaaatgcactattttctatcttatgaaatggttatattctgttacaaaccattcaaacctcaaggctaaattcaggtaagtttcttaagtggatttgttgttgactgcaaaacaaagcttcaatttagtgtgatactgtttatttcagttttaattttgatccctagcttctccatttccccactgatggtttttgggcttagccctaagaagaccctgaagcacatctgctgtttgcctagtataactgatgattagcaagaacattttactcccaagggatgtgtctgcattttggatgaattagcatttttgcgtccaaatcccggggcagctattatctttattttaaacagaacatggcaatttactctacttgggaatcaggctttatgtagctgatggcctctcctaagctgtggtgttcatcagttt

SEQ ID NO: 111838 - DNA, 1138 bp, Homo sapiens
agatttccctatgatatccttcaagaaatgcacttaattgctgttttatctgttgagctgaaggaaatggaaaaccaagtttccatttgctcatttaacaccatttattaagcacctgctatgtgtcaggaacttgttctaggtgttggggatatagcagtggacaagttttcttcttaccaggagctttattgtttgagagatttggtgtattaaagtgacagacttcagtgtaaatgtgtaaatcatttagggagaaaaggaattatatgcctattgctgactcagcaaatatgattcaggtgaaggatcatatctgtctggggataattataggcaattcttaaagatgagggcagggagtgtgggaagtggaggagtactgccaataaaatgttactttcccttgttataaaattgccatttttgtgacttgaaaatgtggccccagatggatggctgtggtcggtgtgcctggagaaacatgaatggagccaagaaaggtccaggggagggccacctaaacaataaagggactgtcatctcaggtcagttttcaaaaattagaactttttagtcagtgatataaattatacatactgaggctctataagcagttattaaggaatgcaagaagtttctgaggtacaataatctctccttttaaaatctttcgaaagttatagattaatttatcttttaaattatcatctttaaaaatgatgtgtctacattacagtgaaaaggagacccaaggaattgattaaaagaacaaaactgcccataacccactatcctgatataatagttcttaggtgtttagtctatttcaccacttttttgagcagacataacccatcttgtataaactgccacctagaaaccaaactgtgtgcctgaatgagtcctgtgtgaccatttgaataatactcttaaaatgaaggaagtggatgcttagtgtttgggcatgggccatcctatgtctgcaaaaggaacaaatgattgtgggactctgctgtttccttgatttggatggcctacttgattgattgccagcagaccaagtgtttatattctacccaatgatgatgtcacactgatcatgatcatcggatttagactgtggcgcagcccacag

SEQ ID NO: 111839 - DNA, 4325 bp, Homo sapiens
gctgctcttggattttatcattttattgggatccatctttcatagtcttagctagacctgtctcaaatggggttagcaaagctgaaccattatttaaatgaaacccaacacatctaaagcttctatacttttttccaaggagatctactttacaatataattgataacctcccccgccccctttttaaaaatctggattgacagaaaactctcaaataacaatacttcccctgacccactcatgcctgctggcagcccatcaatgcagcagctgttgaacataaaaacaatacttgggctaaggtaatagagacagacttctaaaaggaatttgctgggcgatctaaaatgaaattcacattgttccaggcttgacctgagatagaaatcaggagtctgttccctgatatgacaaagccaaggcaccagagccacctctttttaggatcgacgccaatgagtgtgagcacatcgctcaagccaaatggcacaggaagtccagttctgtggacacattctgcccacctgctgaactgtgactgggtaggatggagtgtgaaacattgagagaggggtaggctgaggtggtgaggtgggaaagagaccatattctaaaaggaccatttttctgacaagtgggagctttgtttgttcttgtctgtgtgtgatttcttttttatttatttatttatttttttttgcatttttattgtacaaaaaggaaatgaaaatatatatagcataacattaaaatttacctacttgtttttgataataacattcctttgggaagaattgattttttttctcttatagaagttgaggcacaataatgtggataggttagagattgaaaaacaaaataatcctcaacaccctaacacatcagtactcattcttgcctttccaacccacctgttttatcagacatttcttgtgtaccttctatatgcaggtgctgaaattatgttggtgagtacttgactgcagtctttgctgctctcatgaaatctctctataggctgagtaagcaataggatttagcaaggaaagggagatggggaggtggttgtggaagtgttccaagcccaggaaacagcatgtgccaagctctggaagtgagggagagactcttaagaaatccaatgtagcaggaacgtcagccttagggttgggtagggagagtggacagacaagaggctgaggaggtgggaagagactcagttgtgcagtgcattctttataggcatgtatttactgtgtagctctttaaatgctttatattccatccaccctttgcccataacttaagatatctcagatccttgaaattggttgaaggaagacaaagaaaatctgcagactactaattcttcaggattcaataggagagttgagaaacgatcaggggagttgattcctttcatgcccaaattgaacccttaaagaatagaggaaatgaagactgacagaggacacagagaaggagagtccagtgacaacatatgacaacgacaatgctagatcttcctctgcccagttttatgcattgagcctttcctcaggattcagaactagaagttattattttcttagacctaagcaactgagtcctgaagagtgtggtggggctgggggggaagatggtaggactctttccaccttggacttcaagtggcaatcagtgttctccaaaaaggaaattaaaaactcattggattttatgaaaacaggagaagagtctgttaaaagccagggtttacttaagacttcatgctgttttagttatctcatctctttgagtactgtcttcataccagtataaattttgtgaatctcattaaggtactcattaaacttactctgacctgctgttggagggcaaaaggcttgaccaaaaacttctgtgcacgggaagcttgttcagcatcttgattttcaaatttattcaattcaaattactgtcaagacaattatctcaccttatactcacaaaatacctgagaagtaatatagagaaggaaaatgagacaggaagaagttgtcagttaatctgctacagcaaatttgtgggagagctaggctttggaaccaaaggcttttagaccaacatgcatacagacctcccatctgattcagtcagttaagctaaattatgttgcggtaacaaattggccccatgttttggtggcttacatagcaagggtttatttctcatgcagctgttccaccctcggaggtctgctgcatactgcattgcctccaggacccaggctgagggagtatcctctatctgggcattgccagcctggtggcagaggacaaagagacatgctgaaccctggcttctcaagagctggcttctcaagctcttagatgggtcacttccatgcagattgtattggccaaagtaaatggtcattcctaaattcaaaagaatgaggatagagaatcctcctgtaaagagtggctctgaaagacccttgggctggggaagtaaatccccctctagggagggcagtgaatattttgaataacagttggctagattcctagtcaaggaatctactatgaagccaagtctttatttttaaaattgtatccctgtctgtaaggatttttctccctctatttggcctgctctgattctagctgggcatagtagaatgatgtgtgtgtgtgtgtgtgtgtgtgtgtgtgtgagagagagagagacagagacagagacagagagagataagagttaggcagccacaatgaattgaagtcagagtgaattctcctactcactggtgatgagcttccagggacatcaccatcaagtaagtcatgggtggtaaccttctgaaaggccttctgtgctgctctctgatgacctcagctgtggaagtgtactctctgggaaatggttctgaggccattaggacttccagctgcttgacagaatgatttcccttgggacctcggccctttggacctttcccagccatatgtccctaaatgcagatgaatcagatggcacccttctttcccttgctctgtttttctctctactgagaggccatagtgtatagcgtttgggtgaaaaatgtgggctctggagccaggttgctccggttctagagtatcggttttaccatttaacaagctttgtgtccttaggcaagttacttccctcatctgtaaaacactaacagtacttccctcaaagagttacagattaagccagttagtacacacacagtgcttacactgctgcctggaacattcatcctcaataaaagttggttatctgaggaaaatggtgctgaaatagtaatggctttatactgaagactgggctcaaaccagaactgccactccactccaccccaccccagtgggaactgagcaattgccccttctcttgcacacctgaaccacacaggcttcccattttctaatcatagcacaccttagaggcacggatcaagcataccctccatgaagcctccacccatgaatcaccaaaattttggcgatttttatttatttgaattgctggcaacacttatgtgtcatccacatagtgctctggagtccccaccccacctttccttaagttaccttttttaaaaaaagtgactgtcaaatataattgtgaacataaaaacacaaaacaaaaaaaccttattacctaccataagcaatatgttccactagcccttgaccacattcttgcattcttagtctagatagccagacttaagggaaaggactatatgtcctataccccccaccaataaacatttgactcaataagtgaaaattcacccttcagataaattggataagacgtattgtctaagacgtgtgcctacctggctgttgctgtgtcaacccccggtaggtgtagacctcgcaagtccactttctgccccaggcttctctgccatcgccacctgggttctgcttagctattctgacctttgtgcacttctggacatccaaaggagttgccatcccagggggcaacccccttgagatggtggatctacatggctcctcaattgacctggctccttagaagttcccctctgggccccagcctcagccctcaggggtgattactctacagtccccttagggtggccttccctcttcccctgtttcacttttccctgtcccccattctgttcccctgggtcacttcccaggactcacatgcatgcaagtccctgtctcaagtccttgcattttggggaaacctagatgaaaacgccttgtttactagtgtggggctcgtcttttccttatacaaataagggagtatgaatgttaatttt

SEQ ID NO: 111840 - DNA, 2169 bp, Homo sapiens
cttttgaaaaaaaataatcaaagttttgggcttatattgtctgcataaattggaaaaatggggtaataagaaacaactttaattagctaacattgaacagttttaaggatggggattaatgtagtatttccctaagagtgtttattttattttattttgaattttttatttttgtgggtacatagtaggtatatatatttatgggttacattaggtattttgatgcaggcatgcaatgtgtaataatcacatcagggtaaatggggtgtccatcacctcaagcatttatcctttgtgtttccaacaatctaattgtactcttttagttatttttaaatgtaccccaagagtttttaagagaattgttcaaatgatcactgcacttcgtgtaagccattctcagaggcagtttctgagaatgtcatggaaactacgtaaaccaagctgattcatttttagattctcctcacgtttgtcacctttgctctcattctttgaggtgtttggtttgacttacgtgggtaggcagtctaagactagtactttggcctgataatttgattgtttgtcacatgcctctttgttttcaaagccttttccaatccttagtcaacctcttaaccactgggaatgttggattgtctgaagttgaagcacagttttctctctgagccctctaaagaagtcttttagttgttgataatcaaatttgctccttcagaaactaaaattccaaggtattttatgaacttaaggcagataagatgaggtctcaggtatcaaaatcactaataattaatttgctgccactagctgctgctccaaagctgacatttaagctatgtgaagaggaccaagtctaaactggattttataacccagtcaaagctgggggtgatgaagactctcattgactttatgtaatggagatttatatagggatattggagagttggggatactgctgaatatttctaaatctcctctttcttgaaaaacttatgcttttattcctcagtggcttttcctatttcctgttcattaagtcaacaaatattgagccccagctaacaccatgcatgagtgacaatgtcaaaaccatatccttctactcccccaccaaaccaaatcagaaccaaaatttgtctttggaaaatggatctctttgtcactaaggttcaaaattttggaataaggtttgaattcaggggcgagttatcaggatgtgttttgtcgttccaacctcctgtctcaagtcattcatgactgtgcagcatcaaccagtcagatatttgaggaccttctgtgttacttgtcctgtgctccatgttgttggaaagcctacaaagtagctggggagaaaaggctaagactcagataatgctcaacctccatgactgggaggatcttgtcaggctcttttaactagtattcagcccaacacattttcttagtaaacatgaggaacttggcttagcattcagaaataataaggcccattttatttcccttctctttaccttttataatgtaattcgaggacccttgaaaggtaacctccagctttttttcttcccaggctatctttcgaaatttatttttttagtttaaggcgaggataaaaagggcacaccaaagggaattgggaagttttattagaatctggatggaatgtcttcaggctcactgacagattaatttgtgccctatttccgctacaaaacattctgactgcctgcaccattccacatgcttttgactggtagactagtacagatgctcctcagcttgcagtggggttatgtcctgataaccacattatattgaaaatatctaagtttaaaacgcatttaatacacctcgcctactgaacatcagagcttagcctagcctaccttaaatatgcttagaacacttacattagcctgcggttgtgcaaaatcatctaacacaagcctgttttataataaagtgttgactatctcaggtaatttaccaaatactgtatggaaagtgaaaaatagaatggttgtataggcatttgaagtgtggtttttactgaatgcgtatcacttttgtaccattggaaagtcaaaatcgtaagttgaaccattgtaactggggactgtccgtgttctgttttagagctgcacatgcatttctgcacct

SEQ ID NO: 111841 - DNA, 1054 bp, Homo sapiens
ttcatagccaatcttgtattgtctatttaccattctctttagcctcctcgctcccttctctaacctcttccctcacctctccccaaattattttgaagcaaataacaggcactgtctgatctcatttttgttttaagagccaagctgtgacctggggaaggaggggcagtgaaagggatcaaggagagatactcgaggatcttcaaacgtatctgtgatttaaaaagaaaggatgaagtatatggatggtaaaagttatggtttaacaaagataggtcatgagtattcagatacgtgatactctgtatgcttgagctatttcatcaccatcatcatcatcaaaaagccaagttggaactcacgtggaagttactgtgccaggcctcgcttacctgtgcttatcttgaactttgggtttatgcataatttaaaacacttaaacattatttctgtgcaatatttatcattgagctttattgaataccagcagtgctgtagagtcatgggacctttaaaaggtcaaaagaaagctgaggatcattttagtctagtctcctcagaaagcttagctcctgagagaagtagcttgatttgagctcatatcaagtggcccagtgcttcctgtcatttaccacacttgccagaacgactgattcactgagttaaaacttggcattgctaagtcattcttacctagcttttaaaatgacagattcttatgacctctttgagagcagagatatgcctaagtctgcttgcttggcattgtagatactcttgttagagagaaatgttttcatcattaatagtataaaagagtcatttatcaggccacacatggtggctcacacctgtaatgccagcactttgggaggccaaggcaggcggatcacctgaggtcaggagttcgagaccagcctggccaacatggtgaaaccccatctctactaaaaatacaaaaattagccaggcgtggtggcgtgcacctgtagtccaggctacttgggaggctgaggatggagaatcacttgaacctcggaggcagaggctgcag

SEQ ID NO: 111842 - DNA, 1128 bp, Homo sapiens
gtattgatgtatcttcctattcttaaagaaatccgtggcattttacatggtcattgaacactccacccctctcaatttattctactcaaacactgttacgccagagcatttttattgagaaatatggagttggaagttaaaggttccatgtgtacatgtggaatagtcttcttcccacatgttatgtttggcttgaaacatagtcttcttgccttgaagaaaagactccctagctaaagtcagatgctggatttgtctctaatttttcaggccaacagaagcaagttggcggcgggagctcttttcatgctcagtcttggtcatgagcacaatagtttcatatgtagttcttaatattacaacttgcattgaggatctgggactcttgaacacattgtcttgttgtaatcgtatcctaattctgatttgggagacagggtgaatgagcctccagagaccagtattgaactttagacctcttcttctgctggttttctaaatcgaatccactgaatatttgtttggccaaacaaatttttaaaataagtggcattttagcattttggagattacaaaaggtacaaaatatgagacatttgaacttcactttgaaagttacagagaaatttgagaaaatgttgggaactctgaatcatatttcaggcccctaactaaataaaataaatctttgactttgggcatcaagggaattaataaatgtatccatgcgaatttttcttaagaaattagaaaagagaagtccatatgcaatccagtcgataggagtagggtaaactctaccgacttcatggttcataaagattagagtgtatcacagctgagtaaacacaaccaaggaggcatcacaaacagcaacatagtaatgggatttttctctactactttaaaccagagggttagttaaaaattcacttctgacatttctagcccttttctgactattagttaaaaattcagatgctttcctccagttcttaaaaagcatttcataatacttttgtatgaactgtagaactaaagggcccttttcttggggtttccaaaagaaaaaaggtattggagagactaaatctattttttctctcttatttctgcaaaaatgccctt

SEQ ID NO: 111843 - DNA, 1562 bp, Homo sapiens
cttttgcatttcacctaaatgcctttctctttggcctgtttccagtctctctatctagtcatccttcaggactctcaaccaggcagagttaggaggactagttttctgaattcccatttttcttaggcttctctaatcagcagatactgtgttgtaccataatagttttcacgccttattaatttttgtatcttaaacacagcatagagtagtggctagcacaaaggagttattcagtaaatgcttcaaaagtaattgtgcagttacaggctcaggtctcttgctatgtagagcgacttagtcagaaaacattactgtggcaaaacatcctaaaaggagattgcagaacaaagaatttaacgatctcctaaattttctccaggaattcttacagttatcagtatttagtggttgagcatctgacaacaggaagctttgaagggctgagaaataaagacatgcaatgaattggcttaagattttaattttcatttcacctgttttctagtctcagtccaatttttctcagccctggattgctcagaccatactagttggattggacagagtgtaatataatttactcctatcaatcagaaaatactacagtgactggtgaggcagccttagcaaatgatataggtatttctctttgatgctgtattcagggccttcccctgggcttttcttagtaattgaaattatgtgtataggattgactcctgaagctgttttttatggaaattagtgggcatctttcagtattttcattttcattgcttatttgcttccagaaaactaccaacatgcttgatgaaagttctagaaataatgtgagaggtgattattcattagatgtctttgtcctgtggaagtggggaaacaggattcattggaacaataagtatttacattttaaaagtttatatatgatatctgtatgtatatcttacataaacatacataaatgtctagcagaattgatgttgaattaatagagaacaacattttaaatattttctactgtggaattgtttaatgtgggaaagactatacaaggtgcttcatagtttcaatatagttccaatcagttgaaaccattaaaaacctatgatacattaatatatcaaacctatgagatgttaatattatatgcattttacaagtaaagatagaggctcagaagtaactttccccaaagtcattcccctaaaatatggcagagctggagtctttacttctgactcccagccaatgtttatcccactattccatgctgcttttttttatattaattatggagaggtttttttttttagcctttcacctaaaatattgagatttgagtactaaatttaagaatagcacatggacttcatgcagacatcaatgtatactggtgaaaggaaacactaatttttagcttaagattagatttagatttagatttagattaagattagatttaagatttaaatctttctacgtattgtgatcagaatattgaggaggttgttttagctaagtactttttaattgtgacctttgaatcttgtcttaag

SEQ ID NO: 111844 - DNA, 1058 bp, Homo sapiens
tactactttttgtatgacacaaatcgagcaaacagcacagaaaccaaaatctatttatttggaaatattctgaagcgattcactggtataatttcatagtgttaaagcgggttagaacccaggctctgttacttacttgctctaagaacttgggcgaatttctttgtgtctctgtgactttgtttccacatctgcgaggatgtacactttaatgcattttttatgcaccttagaccagtgcctggcatataaataataccttctgaatgttagctagttttagagatgtaaagcactaagccactatttccagagcggtggtcctggcactatttcaatacaccaccaacattttatattcgtatcactaatagttttggtgatttgataccacttttacctctcctcataaatcaaggcattttgtggtctctagagaagtagggttcatttgagccccagaatacagcttctggctttggatctatgcttttccagcaatcttttgatcactcacatgttgtcccctcatttgagcctaaagaattggtttctctcccctctcatattggtggtgttcataagttctacccactagcagttgaaattgggacaaaaacatcccagatgtcccgtgactcttcctaattccttttcctgttgtcctctttctttcttaaaattatccccctttgccatggtactggtccactatttaaaggtcagtgactcatgttgtgcctcaacactctgccaatccctgtaccggatgctggggaggcaaagtgaataccacttcaggtttttgttactggagatttcatagagtgttagagcaggaagggctcacaaagaaacaatctcatctagcccttttattttacagagaaagaagccaagacccaggagagtgagtgacctgcttaagacccataggctcagaactggagccaaatcccctgacacttgcccacactacaaacccaaggacagtagaactaaggcgttctagataggtcatttgtagacagattcttcagtcgtttcacactgccaag

SEQ ID NO: 111845 - DNA, 1866 bp, Homo sapiens
aatgtttgactgtcagacgacaatggctttcaaccgttctaagccttctatgtcacattgatcctggccctcaaagactcgttggttgttctcctttccactagataataggctgattttgtggtatctaaacaatcataaagttgcacttcttggaaagggtaacccgctatttgacttatgttgggagccatcccactctgtagtatcttcttgcttggcgtcagcattttagacttttgttttgatgacccaatacctctagtgaggttttatttgaagtctgatacccactctgacataggctctggcagcctttaatcttttatcccattgcaaatgttagaatcccgtaatttaacaactagagtttatgtacctttcctcaatgacccttctccacccatctatgttacagatgatgatactgaaaaccagagaagtggtggtccctgtcacttatagccaacctagctgaaataggattggaagccctgatggatgtttagctatggaatataatggttaaagtagtttttatgtttttttccttatttgccttaaggtagataagcccagctacacaatataacatggaatgaggtagagaaagaagagtatagtgttctaaagaaagcatttttggtgggagagaaatttaaaccatagtaaaaagctcaagagagagagaatatggcagtaaataatatgtgactttgaattttttaaagtttgattttagaatgctctcccctttgttacacttacaaaaatattactgcttaagtagatgatatctgaacatggtttccaagggcctgagtaaactatttgtaattacctcatggattgttaggaaatcaacaaaacaggtattttatgttgctgccatggtggctagtggttgaacatttgttccaaattgcaagttgcagagaagtgcatgtaaaggaatgtgagtgtaattaaaatgccttcagaaatgggggtctaagtaaatattgtatttattaagtgaaacagcacaagtgaaattaccaactaatgcctagctcagggtaggctttagaataatgaatattagttttcctgagagtaaaagtattgctagtttttaaagacttatttttaaatataagctcagaagtggataatggagtttcatcagtaaatcaatattttttttcattagtctaattttaataccaggtaatgagcatttttagcctttctaaaaaggatgaaggagtgagtctggggatgtcctcttatcccaaaaggttcgtcttttttttttttttttaggatgattaagttgataaaatggcttaccagttccttgcacatactaggtagagatacagaaaatatttcttctctagcccatactaccgaaaggttatttgtttgtttgtttttggtaatacaagcatatgtgtgtttgctcctcagtagtctataagaagctaaggaggaagtggtgggaatatctgatatgttagtcatgtggttttaatcagtcaggactgctaactgcatcctttcttgtttttctttgcaacttctatgtaagctttggttgatttttctctgcaactaattcttacagctttgccagagaaaagtaagaaaggagacttgataatccttgctcttagaagagtgtgagagagagtaagagtgattgctgtaggctgcctaaccttaatctgtactctctgggttagacttactctgcttcttttctgtgagaaatataagaaatccactccagcagctggtggtggaggtctcttcttggattcttccttctcttgtttcctgctgttcccacttcccgtagctcccacgttgctttccttgtgt

SEQ ID NO: 111846 - DNA, 1083 bp, Homo sapiens
ctcccaggctctactaatgtagtggcctgggctttggaggaagcctgcttggctttgactcctggccctaccacttacttgctgcacaaccctgagcagcttaatctcttagagcttcactgacctccaccgtaaaatgggaataataacggtgcacacctcagaggcgattgtgagaagtaaatgagacctatgtaaaatactcagcataatgcctgccatatatgtataaaataagagctttatacttgtgaactttagcagaatagtttatttcctgagagcaaacacccctacaacgtttgacctcttcactaccgtgtctctccctccctgcagttgattgtgactaagtgttgggaagggttcatactgaagcatgtggctggagtattgacatcccttttctccattttccaagggccctcttaaacttcacttcctccatcaaacataccatgggcatttcagcccatagtgaatgctccctcccatgaattctctatcactgcactgctgctccatggctgttgtttttggttggggaagtcaggttgtatagactttgtgagaaataagttgctgcattcattcatcctaaacatatggccctggctacttgtgatgtcatggtacatacagttcaaagtaagatgaataagacagggttcctgtcctcaaaaaatgtacattcttttgggggcctgaccaagtgagaaactaagtgtactgctagatgcaagatgtgaccaaggacccaaatagagtggacctttataaaataagaagcaatggtgtctaattcaaggaaccagggaaggcttagtgaagaaagtggcattttgcctggaattttgaggatgagtaggatttgacaagtggagttgaaggtggaggcatgctctgtgcagaggtcggtatgctttgaaaagagtcagttgtccagtttagtgtatgggcggtggtggacttagaatctggcaaaactggtttgaatgctggttctgccatgaattgaactttagtttccttctctgtaaaatggagccaatagtatctacttcacaagttataaggattaaa

SEQ ID NO: 111847 - DNA, 1009 bp, Homo sapiens
ggattacagcaaggatctcttgccaagctataatctttcaagttttgattttagcttaatgcttccctgtaatcatgctatcaagactgtcagaaacatattcccattcacatatcccatactcttaatctatcaatctaggaccattgatgtggaattggacccgatcttgctgagaagtctgggctgctgacccaaaccttttgtgctttgtggtaacaacatgagtaaaaatgtaacctgtgctcttgcacatattttatcatctctttttgagagctgatgggatttataacggattgttgtatgcagttgcattttccctgtgttctacttgggccctacttgattattcagacatatcaacatgatgataatgataaagaaaatggctctttaagagacatttttagtggacaatggagggggtggagaggactgtgggaacattcttgtgagctgcagcatgtgaaaaggtttgttttgcattaactgatcaagacaagaaagccagcatataaaatcttctatcaataggagaactttgagaaaagaggaaaattgtaatacagcctcttgggtctgctttcctaagcacaacagtatgtgtgagaaaaactctaaaccaactttctcttacacctaggtggatgcttctacaatgtgcagttaactttctgtaaggcagaaagttgtctctgctagtgggagtatttattgatttattaggggttatttggtcctattttttgagaaggagaacagagtaaggaaggagtaagaaagctttagcttgattagaatggctgaacttgtagcggtaacaaatagagtctgtttattagcttctctgcaagatatgcattttttttttttttcatgctctgcagaagtttgcatcaaatagcttaccatttggatggttgccccagctggtaatctgggttaaaaccttgactgaggcaattctatactcatgatcccttggtgtgctggtctggtgggaaga

SEQ ID NO: 111848 - DNA, 1066 bp, Homo sapiens
ctttcatttttggaaggcttcctccaaaggctagctagtttgtggttagctgcccttatcagattcagtgtaaaaggtttgccttggtagcctgagagggatctagtttaccatgcttttactaatatctatcttttttctcctggagacagttgtgtgttttttttgttgttttttgtttttgttttttttttagctggggaaatgccaatattcattattatatcttatcctaaagttacacaggagaaatagggatgttgaaataatgtatactttggtaggcagaatccgaaaatggccccaagatcccagccccctggtgtacacgctctgcataatccccagaacttgtgaatatcactcccacaggtaggttatggcacagctgtcgtttagaaatggagattgacctgggtggaccttacctcattaagcagtcccttaaaagggaccagactgttcctgaagaaggatatttgacatgtgagagggacacagggagatttttcattgctgactttgaagacagaggtgacctcgtggcttggaaccgtcagtgactttttggagctgagtgcagcctctgacagcgagtaaggagagaaggccctcagtcctacagctgcaaggaattgagtctgcccacatctggaatgagcttggaagagggtatttccccagagccttgagaggacaacctccttagcttggcccacactttgatttcagccgtgtgataacccaggcagaaagtccagctacaccatgcccaaagttgtgacctatgaaactgactgctaataaatggatgttgtttcaagccactaaatttgtgataatttgttatatggcagtagaaaactagcacatgccccacatttatgtaaacaacccctattccatcctgatattgttttatccagggttgagattaagacacagtagaactcttagaggccaggtgtggtggctcatgcccgtaatcccagcactttgggaggccgaggcaggcagatcacaaggtcaggagttcaaaaccagcctggccaacgtggtgaaaccc

SEQ ID NO: 111849 - DNA, 1219 bp, Homo sapiens
ctcacagagactgccatcacatggccattactgtaactgaaaatcccctgccttttcagaaaggcacagaaatatatggtatctttcagaaaggaagtggctaatttatatccggtgatagaaatggtggcatcgggaaggaagcgtcccatccatatttcattatttgctgatgaatgcattcagtgaatagaaatagatgaactgagccacaatatttctcaaacaggaaatactgaggaatagatgtgtgaatatgagtagcacaggacataaaaagttgaggaaaaaacttccaactgctttgagcctcttaattctatttgacctcctattcgtcactgttttgaagatattccataggataaagacagggcaggagggacaaaaatgacccaaataaacaacagtgagacaagtgggtggttttatgctctgcaagagacgtgatatgtcttaaatggaactgggttgtttgggacccactggacagcaagagggttttgaaatggtttatgacctcttccccacttccccgcttgctttgctcattagtgttcctaggtggctgctgggtgacgggcttttcatcatctctgatgtgggccagtgcgaaagagcagctgcaacatctgtttctaattgggtcgtgcctttataaatacttcttgcctatttgtcacattgcttccctcccaccctgtcttccttggagtactgcagaatctgtaagcgtccctggaatgcacacgtggaccttgtcattcccaaacagactttctgctggtcagcactttgtaatgttcggctgttacaggcattagtcacttgtgctcagagagagactgtggtctttggaaactgaagaaaatgtcttttttgttgttgttaattcttggcatccagttagatttaacttctcaagagtttacacagacttttagaaaaacattctgtctctaagaaaaaagtgctctagctttgtacagtttttggattttcacacttggtggttgtttgctgaaatgctgttttgctagtgattcccctcctccccctatctggggttgtaagcagctctggggctctgttcacttcggatacctgtttctggggactgcttttcaacagcgtttttcctaagggcatatgagaaatttaatttctgatggaatgaaggtgaaactctagtcccaggtaaacctgggtaggctgtaga

SEQ ID NO: 111850 - DNA, 2354 bp, Homo sapiens
aaataaaacttactttgcggacagttcgtgaggccagaatttctccagatactgggaggtggctggtggtcagtcaaagattttgtgtgcgagacagcatgttcttttctttacctctcttcagctcagaggcgtctgtactactgaaataggacctcagaaaaagacatgacctaagatgaaggggtatgtacttcttctcttttccaagtgggtattctgtaaggagaaaagacagagctcaaaggagtgtactgtacatgtctcctctgccctctgctgccccatggtttcatctcagctctctttaaaattggacatctgttcccttgaaacctgagttctgatatttctaccttctcccatcaggtactgctgctcagaaagactatttgttttcatctgaatatgtgaaacctgcacatcagctgtacacaggggccgcctattaaattaatattcaacagtgctttggactaatacatatttttacatactataggctggtgaattcactcaaagaatgagtagttaatcacatgagttataaggctacacagcatcctgtcctttggatagctttatggttatgtatttgtgactatttgattgacatctgtgtgccccattaccctgtacgctccatgagttggggaggctttgttttttcatcatggtatccttagcatttaacacagtgttctacccacactggtactcgatgaatatttgctgaatgaatgaaagcatgaataaagatttgcttttctttttgagaacagataactaacttatacagagaagtcatttcctaggttttttgtttgtttttttattttggagataaagtatatcactctgtcacccaggctggagtacagtggcacaatcctggctcattgcagcctctaactcctgagcttaagcaagatcctcctgcgtcagcctcccaagtagctgggattataggcatgagccattgcgcccagccctaggttttgttttgaggatataaatccacttttcaaaaatctcgtggatgactggagatgtagccaaacaaaaagaaattgcttttaagcagggcatttgtaaacagtgggtacataactttcttagctaattcatatgtattgtagttaagcagaaattaaaagttgaggtggaaaacacagaggttatgcacacagatttccatttggtttggagtttcccagcataactgatagaaactccctttcatgggtcaattaaaacttgagccatcttgatctggccagagcaaatatgcttccaggaatttttcaccctgtgttggctttccttaagcaaaatgacggaattggatttatgcatctctaacatccagattaagaagccttagaattagaaaaaacaaagaaccagagactttgtttagaggtaatttgattaaatctcctcactttacagaggaggaaacataagcccgaggattaagtgacttggatcagtatactttatttatccataatctgaggcgttgagaaaaatgtaatcaccatgtcttgttaataaaaatctccagctctccacctgaatacataaatgttatctcttaaatttaaaaaaaaataaattttaaagagaaaaatctttctaaacttaaattgtaatacctgattttaaaggtaaaaattaaatattgctttcgaatggaaacgtaattttaatttgtttggattaaacaattcaaatatcaccttggtaacatgctgtcttgcttccgcctgctgataaggatcagaggctacggcctatctaaccacatctaccgaaacacttcatttttaaaagtaaagaaaagggatatcacttcagtttaagtatggtgaataaaatccatctgggcacaccgagcttgttaatttcagtagacccagggctggattaaaatacagtcatgtactgctttacaaactctcagtcaacaatggaccgcatatacaaccgtggttctgtaagattataaaactgcacttttactgtaccatttctatgtttagatatacaaatatttaccattgtgttacagttgcctacagcattcagtacagtaatattctgtacaggtttatagccaaggagcaataggctatcccatatatcctaagtgtctagtaggctataccatctaggtttgtgtaagtgtatctggagtttgttcctgccggttggtttgtggtcttgctgacttcaagaatgaagccgcagaccttcatggtgagtgttgcagctcttaaaggtggcacggacccaaagagtgcgcagcggcaagatttattgtgaagagcaaaagaacaaagcttccacag

SEQ ID NO: 111851 - DNA, 1050 bp, Homo sapiens
aaaagttctccaagtctccactcgacccaggaaggccagctggcttcacgtctcacaagtacactctaggatggagtccccaatccccaggctgccaactgagaccagtccgtggcctgtccggaactgggctggccagcaggaggcgagtgatgggctagtcagcattaccgcctgagttctgcctccttcagatcagcttcaggcattagattatcataggagcctgagccctgttgtgaactgtgcatgggagagatctaggttgtgcgttccttatgagaatctaatgcttaaagatctgaggtagagcggtttcatccccaaaccaaccctgtccgtggaaaaatggtcttccacaaactggtccctggtgccacaacggttggggaccactgctctagaatgttcacacaagaacaaaatcacctactggcatgtttctcagaatgtttcctcatcacaaagtggtgcatgactgcagaagcaaaagtgatggggaatccagaatgcttcccagctggggaggatgtggattctgctaactgctgattctgcaaacaggaatgtgattttgtggcttttcctccagctttgtaaatgagttttctctttaggaatggattttcttcaggctagaatcatcattctcgttttttatttctttctgttcactttatttttattgtgattttaccttattcatatgtccgagagccctgctggtcagcagcttctcctggaatgcctagcagctgtaatagaacttctgattaatttcagatttttaaatgatagttgcctcttcctcccaactactgtaggtaaaggaagtccaagtttcagaagacctgttaagtgctaggcactctcatccatacctctttatctcctcccaacaaccctgccaaggagatatgtatgagagagcctagcacctcttcctgtttttactgagggcagaatagagactaaagcaagtagaaagcaaagctgggattcaaacccatgtctgtctgactctaagccttttgctgcccttctctggtg

SEQ ID NO: 111852 - DNA, 2239 bp, Homo sapiens
atcacaccactgcactccagcctgagtgacagtgcaaccctgtctctaaaaaaaaaaaaaaatggctgggtgtggtggctcatgcctgtaatcccagcactttgggaggccgacgcgggcagatcacgaggtcaggagttcaagaccagcctggctaacatggtgaaaccctgtctctactaaacatacaaaaattagctgggcgtggtggcgcgtgcctataatcccagctactcgggaggctgaggcactagaatcacttgaacctaggaggcagaggttgcagtgagctgagatcgtgccactacactccaacctggcgacagagtgagactccatctcaaaaaataaataataaaaataaaaataataaataataaaaataaaaatggagctttgaggatcattttctcacctggactccagtattttgaatataaagttcattgacaacacagccagaacactaggagtcctgtctccaaggagaagactttcagtgtctaatttctgaaattgcaaaccataaccatgatattataactgagggactgtagctgatctctgcatcttgagaaaaaaaggtttcacagattatctccaacacccacgggatgcattcaaagttgtgggggcagccagtaccattttatataacagcataaatcacccagtgattttactttagcttccagccatatcctatgtgattttaaaatgtatgataactaccttaccctagtctacatcggtaaactctgcaaaactccagcagttacagagcctgtgctaggagctacagggtgaagagggggaagaagactcaagaaacctgtaaaactaatggaggagaggaaaccagctcatgtgctgagaagttttaaatatgctgcatttatggtaggtagagcattgtcatcattgtaaggagtatgaatcctccactgtgagcttttcaaagttcttttatgtatctggaagagtgttaaatattttttcactatgagttgacagtaaattgaaagcttttcttgaataatgaaagtgatcaaaatgactggaggtttttgtgtttttttggtcacttaatgcatatctgaaatagtcacctctagaagctcaaatttccctggaccagtacacttgtaacaaggaatgagatgctcagggagatggtctgctttgggagactgtgacttttgtggaaagagcttggctttggagttgttagtgccctcagctgtgtagaagccaaggcagctgtggagggtctcctttttccatgtatgtcaagggaagaagaagaaagaatgtaatgtttgtgatatgtgatatccaggtggcatggttcatggacactcaaatctttctcccctgaaattgcagaatgaagagcttcgaaacttgtctttgtctggccatgtgggatttgacagcctccctgaccagctggtcaacaagtctacttctcaaggattctgtttcaacatcctttgtgttggtaagttattcatcaccccacagcaagaaatttgatccttagatattgacaggtaactgtcggagagacatgcttcagtgaaataagaatgacatgtttattctctttctttcatcagtaaaacaaggcaaaatatctgccttatacatgtcacaagttataaagattgagagctgtatttaggtaaatgcgttgtatgttttgtcatgttactcaaattactattagtatttctgtcacacagttaagcaactgatcattacaatattgttaagatcccttaaacattttactttggactaggcctctgccttggtatttttcttcacccctctagccatatctttttttttttttttttgaggagtcttgccctgttgcccaggctggagtgcagtggggcgatcttggctcactgcaacctctgcctcccaggttcaagcaattctcctgcctcagcctcctgagtagctgggattacagtagccaccatgcccagctaattttttgtatgccatatcctttttggactaagaagaggaaggtggaaaggaagggggataaagaaaatcaaaatataaatttcctgttagtttgaaggagaagtgtgtgtggaacagatggctgttcctctctctccccatcacgcctgatgaatggcaggtgaaacagcagtgaagtggtttgggctgtgttgatctgttggcattgtcctctgggcatttccctctgagacat

SEQ ID NO: 111853 - DNA, 1255 bp, Homo sapiens
tccaagtaaagcaaagagaatttagaaaaggtgtgtgttcaatgtgagaaccaccatttgcttatttgtcagttatggaagttggggggagtgcagatatttttcttttttaaaaacttcttgaacttcttgatgactctactgcatgtagcctctgtgctgggcattcattagtagaaagccacaattggcaggcacgctacaccaacttgctccctggcattgtatcttaagcactggataagagaaagactggagagaacacagccaactctcatctcatgctttccccttttccctacgtgaagccttttaaaattcagcaggagacctcccgaatggcagctagttctacagagtggcgtgaatgggttgtcctttctctcatgataaatgctcattgcagagcagggcaattcttcattagcatagcaatttgttggcaatttgttgggtttctattgaaaagtatgctaaattgtaatcgcaggccaattactattctggcttctcttcagtgcctccccagccctgtctccaaaatcagctctaagaacatgtctgagagttctgtcctggctcctgcaggggacggtaggggaaagccttctggtgggatcctggtttaactgggtatgtggtgtgcagtggggtgtgctggctgaggggctgactccttgtgttaaataagacaattcagatgctgaattcctcagagaccaaattgatgctgccctgttagatgtgtaaagcagccctatttggagtctcctgggtgggttacaatacctgtgattcttagatatttgtcaggttctattcttaaacatgtttaaaattagtttttcaaactaatgaacataatatatatttgttgtttaaaatgttataaaacacttccctttcatctcccacccccatttccatttcacagagataacactgtgggatccttctagaaacttttgacatctttctgtattaggaaattgcttttggtggcttacagttctgtaggtaggagtccagtatgggtccgcagggctgcattccttcctggaacctttagggagagtgcgcgccttttccagcttctggaagctgcctgcattccttggctcttggctccttccatccattctcaaagccagtcacgttgcatcgctcttttagtattcttgtgtcaggaaattttccacagagaattgcagaaatacagcttaaacccagttaagactctcccccaccctccaac

SEQ ID NO: 111854 - DNA, 1301 bp, Homo sapiens
gcctgcctatagcaattaattgatgaagtattacatttttctctcagcttagtggtcagagcatggagaaaatttattaattcactcattcattagcagatatttagtgagcatgtgttatatgctaaacacaagcaaaaagtttaacatacgacagatttatagtatctataaagtaaaaacaaaatgattgctccagatgaaacacagctttacctggaaaaatttctccatggattttcagaaaagagatttggtgtatgtagtggtctgggttcctgggcatcctctaagtcagtgcaattgtttaatgaaatgccaggtgccacacgctggctcatcttatgccggagtatgtttcatcaaaggtgattctatgaggaacaagaacaacgcaacttaggtatgtagctttctgactctctgattccatccaagagtaaaatctagaataattagggaaggcaggcagatccccatgcacagttacttactcaagtagccagtcttggcaattagagtgaaagatgctgaatcacagatcaacaatttgttcaatctaccgttaccttctaattaataatacaatccctctgtttttcccccgccttgttcaccttagagctcgtaggttaaataagcctgaggatagaatggaaaaggtaggactgctttcccctgtgatgtgggcatcatgtttactagcattggcaggaataggaaaaacagaagtcccagatagcactttaataaggtctctaattactgtagcaatagagtgtttaggcagatgaatttatgataaaataaacaacaaactctgaaaaaaatctatcacagtggcatatctctgtataaatcatcaccatgatcatttttgttttcaattaacttttttttttttttaaagatggagtctctcactctgtcgcccaggctggagtgcagtggttcaatctccactgactgcaacctccgcctcccaggttcaacggattcttctgcctcagccttccaagtagctgggattacaggtgcccaccaccacacctggctaatttttgtatttttagtagagacggggtttcaccatgttggccaggatggtctcgaactcctgacctcaggtgatccgcctgcctcagcctcccagagtgttgagattacaggcgtgagccaccgtgcctggcctgcaattaacttttaataaatgtctcctttgtgccaggcattctgctagggagttttgaaatactttagtcattgacttttctgaaaatattgttatggttgtttggttt

SEQ ID NO: 111855 - DNA, 1364 bp, Homo sapiens
ggtatgctaattgtttgtaatttccaccttaatgtaaatgataattaaaattaccatgcctttaaaaagtatggtgttcctgattcacatgggtgcttaagcaattttcaacctagtaaaataagatgataatttcagtcttgtccaggtaacctggaatgcttgccatgtaattgaagtctttattgctattcttagggaagaagatgaaagttaagtaggtcactttctactgacagagcctttcccatgaaggagaaacttttatagggcagatctgcttctgtgccttttgtgttctaaaaataggtaaatcctgaaaagaagttggctctgcttgagaatgttacacttgtagcatgtacttaaaatgactcaagtaccttcggtattgactagcagtgagaactctgttttatttctgtatccactacacagtaactttgttttgctcaaagttaatttgttaagccatgaatggtgagtgtgaacttgttaaactctttcaggttagggagcagagactggttttatattgcttttatggagggtttttttttttgtaagactattcaggaaagtaaggaagacaggaaaccgtctcaactgctgcacagccagaccccatagagatctggaatgacattcaggatgttacaaacgtgcaaacagtgtcagtgtctgtttttattcattacttcatccctgcacctatgcttgtcacacagtgagcgcccaagcattaatttcatgatggatttccgatgctctaccccatctatctgctctttcctgtattcccagcctacattctgtctgcagcatggcttctgtttacttacacagcctttgctgcctcatggtttctgcttacttacctctctttgtatattgtttctttttcatgccatcacgctgtgtggggattgcatgtatctcattcaaatacccaaagagaaaaactgtgattagatagaccactctccaatgtggagccccagctcatagtgaaatgattgggcttctgttgttgccttgaggtcagggacctagccatggtctggttgtctgtggccaactagcagggccatggatgtaaaggatggtcttgcttataagaggaaagcggttatgacaaacacttagaatggtgttcccataattataaattagagtctgactggtattattcagtcatgttctagaccagattctaagatgtgggagaacaccctatcaggctagtttcttgaattctcagaacttggcacagaacttgtatatagtaggcactggaaaaatactggctgaatgatggttgactaaagaggaaattctgtgatcttagatgttcagggacacac

SEQ ID NO: 111856 - DNA, 3151 bp, Homo sapiens
ttcaacagtatagtcttttatcccttaagtaatatagatttatactctaacatttaggagagaaagagacaaagttcatgttcttgttcttgtaatatacaaactgagcacaggcaatcttacaagtacaatttttctattcagaggtaaagaagaatctcttgatctgtaaatttgaaatctctctgctaaatagtttctgaaattcattgaggcatttttaggaaggtattccatagattacacatagaaagaattatctcttcacagtgacatttctggtgacagtttttcttttttaaactttataatcatgactaataaaaaatactgatgaattgaactgatgtctgagagacattgacacattctctgatttttcttttgtggttatgtaggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacaggtacatcttgggattttggggggacatgaatggatgaggagatagcaggatccatcccaggtaaatttaaaggccaaatgttttggggattttttagttgtggggcttggtcctctattgcctaaaaggtgtgatattcttgtcctctgagaatttttctgagaatattcttccttgaggtcagaatcagacatcaaaattgatcccagctagtaggatcagaaaggggctttattagagggactaaattagcttacaacatctttccacaaaggccatgaaaccaggtttggggctttcctaccaggaaaagcaatctagagaaacacccagccaccctacagaacagttttagcagaaaccccagccatcaatcacttcatactgcttgggaagccaggacactagaggggaggtctctagaagctccaccaaatctgccccaggtaatcaaatgccttcaccatggcttgctatataatgataaaatagtacactgagtttttataatgtaccccatttataaaccatgtaagtttgggtctttaccatgagttatcttttgcccttatttgagggaagttttcaattcttaaaatttcgtggcatacaacccatgttagtcttagtctcaggattttgttcacattccttctcaagagcaccaattctgttcatcagtctcaacctcagatgtcttatgactattttacatagtacattcattctcaaaagaagtttgagaaagttaaaataaaactgccccaggtccaaaggtgattgtagaatggggcttccagaaacatctttgagcagttacaacattatgggcataagtgtctacctgcttagtgtgaccaacatgtagacatgaacaacaaatcagtaagttagggtgtgtttgcttacagctcagacactttgcttgtatcaggattttttccccatattcctcaaaactgtatattatacacatgtgttttgtaaagaggaactcgactatttttatctagaaatgcctagatatattttatctatgcctgatataagtatgagcaccacagtaatgacagataaatgtttaattcattctttagctgagcaccaagctctttattttatctacaaagcactttaaatgctcttcagtagacattgtcccgtgataacaggaacaattggtagatagagtgagaaagattttattttgcataccaaaatggactatctgtacattgtgctggggcagggaacaagttcagctctgacactgcagctgagcagttgctcttaatatatgacctcaatgacagggaatgatggagaggcccctgcctgaaggctgtttgtaatgccaagagcagtaaatgaagagaaaggcctggtcataaggaaaggggcacaagtgcattgtgggagctgggaagagagccgggggtttcaatcattgcatactcacagaatatacccagagcaaggcctgttctccatctctcagactggtatagattttctcactggcgttaggaaaaatcttgcttgtccattccttgattggaagacagcaactgtactttttcaggatccctcccccaaggaatgagaaccatcctccacatagcctcttgctgagattccctgtgctcttccagctcactggggttgccacagtgctgccactcaatttttgcctctcccctaaactgggactttccctcgggctgctggtggcttttcactccccaatcagcactcagcagcaaacagttagcacaatgcatatcctcatatttgcagctggagccctccttaagaaattatctgactcatttgggtcaaataatagtttccaaggagatttagaagagaggaagtgtgatattaacttaacctagataccaaatattttttttcctctgaaatttcttgacagctattgcataacctctttaaatggcacttaaaactctctgttaccctgtgcctcagaaggtattgttgacactgttgactgtaaagccaaattacttgttcacaaattgttatctggacaggctctgcctccctcaagaaactggaagtgggatattcatttctgcatcaatatataaccatatggaaagggatgtggtatttctctatgcccatgttgatttttacctactttggggattaggcaagcttttctgccatagatgcaagacttcaagaatgtcccagtttgtttatgtaggctttggacatgtcaacattcctgtattattatctgcctcagaccaggctagctagaaggaggcaggaagagagatctggtaaggtttcctgttatgtttaaaagcacatttcactctttgttatttaagggcttccttgttttggctgtttgtactcttcagtggagaaagaaaggggcctggggaagaagggaaagcaagttttgttgttcaattggaaatagaataattagtttgccccacactggggagatgggaggtgagctgtccatggcgtatcactagctgtaatgatagttagccctcaaaggcagagataattg

SEQ ID NO: 111857 - DNA, 1807 bp, Homo sapiens
taattggcaaaaaaaatataaataagtgttagtaggaatggggctagcaaaaggctaagttgggattaagcttcctatctttctcactttagatggagaagtggaaaggatttggaggaagaggcagataattcatctcatctacaggatgatgatgaggagtacaaaaccacttggctggcttgagtctcatcaagaagaaattatttcatcagcataattaaatctttgacatagggaatagtggttttggtaaattgttgtccaggaatacatttctttttattggttaataatggtatggaaggtaaagtagatgggatttcatatttattatgtgtatgacataagagaaggaggctccaggttgaatcccaggtttctgacttggccagtggtgtgggtggtggcccaccatgctaaggaatacagggaaagtgagggtttgaaggcaggatgaatagttcagttttggacatatttagttggagaagcagttgaaaatataggataaccaattgtggatgggtctgaagctcagaggaaagatctgggttggaggtagagatttatgacttgtcatcagatagatggtgagtggaacacaggaatgagtatgattttctagagggaatacatagagtgaaaagaagggagactgaatgattggccaggactctctaataagaacaggtagaaggaagcctgagatattagagaacaaaagatatcttgaatccagtggggaaagcattcctcactgcaaaatgagtgttgttatgcttctcattatctttggaggatcagaatcaaaaccagaggcaagaagggaaactaatagaaaacagaaccatatttggactactattgagaggaggaggtgctaaaagctaaaaatcagacacaggggaggcaggggagcaattgctgtgagctgcttctcttaccctttgggataagaggctgctggggaagagccctaatccccaaatctgcctcagtgtcaggagacagaaggatcagccccagactcaaagggcaaagggcatgggtggacctcactggagtggcttgctctacttccctactggacatgagctccatagcagaacagataaccagcagagaactgggtgaatgtaaagttcctttttttttccttaggtttttctaaaaagtcaggcttgattctatagtggtggttgtttattatataattatgaaatagttatatctgacttttatgtgccagccctttacatgtattgcatgtattggctcatttatttgtcacaatagctctctgatagaactactatttttgtctctgatttacctgtgaggaaattgagacacagagaggtttagtgacttgcttaaggctgtgcagctagtaagttgtgcggctgtattatggttttaggcttgaatccatgtttctaaccaccatcctctataactatctcattaaatattattattattatgcaatatatgtctatatttcaagattagaaaatatagaagaatcttattgctcattcattcttcttattggaattttgcctgtcatgatttggaactttattattgctgaggtacatcctaccttttttttttttttaaagcctctagagattttgtctactctaattgaaccaatatattgtgataaaatcaccaaagaaaaatatcaaaaagctttttatgactgctttcagttttgctcataagtttgtttgttgttattgtttattttggggatgtttgtttttcttaggatgtctgcgtcatttttattataaaa

SEQ ID NO: 111858 - DNA, 1299 bp, Homo sapiens
gagttatggattatgcacagggctatgggagcacagacagcccccatctctggaggaatagggcagatgaccagggaatagctcgcagtaggtggtggtgtcatatcctgaaaccacacaccagtttcattttgtgcaccagtggcaatcagtagggagaggctatcacagtcacttttctgagatggatttttgaggcccagttttggcccagcaggaaagaatgccacagtctcttagcaatatcttccacggataccccttgggggagtggcagtcagctccacgtatgtacagtctctgttttagaggatgaatgttagccaggagaagagtaggaaaaagacaggtttctcgcagaggggccagcgtgagcaaagacacagaggaaataagggcttgacatgggtggggggcgggctgctacaaatgattgggcgtggctgggacaggagaggtgagcctggagcgctgttcagggatcaggtgatggaaggcctggatacctaggtaaggacttgggctttagcccttaggagagaagaagccattgtgatgttgaatggaggattgtcctgtgaaagaggtttgagactagaaacatgctgtttctgcattctagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtacttgctgccattctgattatcatccactctccttttagatcttctttatcctaatgccctaatttgttctctgctttcagtgtgattttttttttcctggattacaggaacagtgtttgacagcatgagaaaaacgcttcaaaacctcttgcctgttagacaaaaataaaataaaacaaaacaaaactagcaaaaaaaaaaaaaaaagtcaagttgctttccaggaagtatttttaattcttaaatgggaggttgaaatataacttccaggtttgtttactttcttaaaaaaaaaaactttctctaaaaggtgtttagaggtttggttttaattcaaagtttacaatggaataaaaggttaaatttttgtctctgtgatgataatggtccagcttcttcaattttaaaactgaactgcacatgtgtgttcaagtaaagcaaagtcttaatttcagtgtgatccctgagcttgccacatttatacctt

SEQ ID NO: 111859 - DNA, 1030 bp, Homo sapiens
caccttactatatattaattagactttccattttgaaataaatagaagacaatacattctgaaataaggatgaaacaaatggcaacaagaacaaccacaaaactaagctgtggatggtatttaccgttagattcaaaaccccttttgcattcacagaaaagtcttatcagatgataaagctctttagaggactctgctgggtgttgttactatgattttatctaaacaacactgataaagatgctgtctctccagagggacaaaacagtgagagaatgctcagaagatcagcctgtccccaaggcctctgtctcaactgtcctttaaagggctggagaggctgaagccaagccaggctcctttggcttccagcaggcacagacacagtagtttacagaaaaatcttctaatggcctggaaggatcactgcagctagagtactcttcgcagaataaatagaaaccctccttcatcccatctgattcctcagctccctgggagctgtgccattagccatgatagtggagagatcacgggcagtgagggccgcttccgggtctgttgtgtccttggaagcaggggcagacctccctgttctcaagagtgccccattctccacagacattctgaaggaagtagagtgaggaggcttcctaatcgagggctgagtatgcagacccagccggataatatccaacactattattatgtttaatagagttcattgaaaacggaaaagaaaaaggcaaaacaggcacaactaataaaagcaaacagtcaaccataaagcaggttaaactttcaaagaagtgatattgttggagagttggagagctagctagcatctgaaaatgataatatcaaagttttatttatacaagtaaagggaagggttaagcaaatgtatggtcatttcagaaaagactttcaagtccggctagtgaggaaaaagaggttttaaaactaaattgcttgatttctctatctcctctgatcaatttggccaagaaagagtgaatctctgccattt

SEQ ID NO: 111860 - DNA, 1029 bp, Homo sapiens
actttgctgttatactgttaggaggtgcgaactcaagagcctaaagtagatgggaggggtctaaaaggagtggttggtcattcaaagaataagttcctttgttatcactatttgtcatagaagagtaacacttcctttactctgtaaagaaaaatgaggtagcataggagaggaaattacaagtatactttcagtgcaggatgggaggaagtaaaagtgtttgaatatggaactaaaagtttatctcaggtcttcttaatttttcacctaggtagaaagtctgattttcattatcatctctaccccaaaaaaaaaaaaaattgtaggtacataggaggcgtatatatttatggggtacatgagatgttttgatataagtaggaaacatctttattttttacagtaaggttttgcaatttttatttgtttgctatgttttattcacttgtctatttttcttatgttggaattgtgtaaaaatggacgtgtctgttttacaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtaagtcctcaagtcaaatgggaacaagtgatttttatgaacgcctgtcttagtagcagcattgtagagtggctggagcactggactgactaggaacctgatgacttcagctgtagtccagctttgccaccacttcaagtcatttaaccagtctgctcctccgtttctccatctgtcaaatgggagctttagacaagatgatctcaaatttccttcccactctaacagttacgatttctacagcaaatcttgtgagaaggaaatgccagcccagtaccatttcataaaaagcagctcaaaggaaatagatctgtgcttgtttctaccaatcttggcagaaatacattagcttgtcccaattttgctt

SEQ ID NO: 111861 - DNA, 1011 bp, Homo sapiens
tacatctggctttgggccagatgttctggcatttgaatctagaccctgctacctctctttgggaggtcagcttgctcaccaagctcctgcgtctgcaaagcaagagtcatgacatctagttggcagagttattatgaagggtaaagacaatatttgttttcaagctcctccctctgtgctctgtgctgagtaggcactcagcagtcagcgttgtcatcagtattatggtcaatgttgtcagaaatcttgtcttcgtcaggaatgtaaggtgaatccagtaaaggatcttcagatggtcttgagaccccagagatttcaggagtgatggtaataacatcttggaagcatcactgcagatatttcagtgacatcattgctaatcccacttccgccatttcccccctctcttgtagttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcaggtatgaaggcatctagcaatcaggtgtctcccagacagtggcgagagtggcatggtggtacatcacagaaatgcttgctggattgagatggtgatgatggaaggatctggtgggtgaagattaatacatatgttgtcaggcattgtgataattgctttatttgcattatctcaactaacttacctagttgatgtcattattatccacattttacagatgaggaaacaaaggcactgaaagtgtaaacaaactgcccaaggtcctccaagtagtaaacaatggtgtggtgttgagctcttgccatctgggtcctgagcccaggtttctgccagttctcttgcagaggtgcagagcctggtcgatatatttacaaaggtgcggctgctgattacagtttgccccattcatttttgccaaacacctttaact

SEQ ID NO: 111862 - DNA, 1864 bp, Homo sapiens
atagaattgaaaataaaaattaaacttctccctgctctgtttacaactggtaatatacttgaaaagtagcaattttctacagtacctttaaaggtaatgttgtctctttagtttacttgctgggtctattttccacattgggggctggagggagatgagaggggagggtaccatttactgggcactgactatatgttcgatgttttattcccttcccctcatttcattctcagggtcatatccctagaaggtaagtgtcactgtatccacgtcttagaccttggaggctgagggaggctgtgcttttctaagaacagccggttacttagtatggcccaaattccaatccggatctgtgggactccagtccctcttcatttctccccctatagcaggccttctccatcttctcaaattctataccacctccacctcctcagcccaggttttccttgtatgaatatatgtaagataaaacttggctagtcacagacacacctttagtgctgtgttgtgcttactgactgatttctagttcttgatgcacttgtctttccaaccacagcataactaaaagcaaaacagtgtcattctacttatgctttgatctggcaagcagcagctttatctatgttttgaaagtagataggtagaaattatgtgaactgaaatttcttagtatacaatttcatgatgctgtccttcgtttgtggattttcaatagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagaggtaagccatctgtcctgcttcaagggaaagatttgtaagagagagattttctaaatacatcacgctttagaggacttcatgatggtccaagtactttctacatgcattttgtcacgagtgacctgccaacctggccaggaaaatgggtcagatattctcatccctgtcttacagatgataaacaggttataaaagttaaaactatttttgcagtcacatacctagttagcagcaaaaccgagactaaaactagatcttaggtctccagatctgatcacatggcctgtgtagctctgtgtttcttcaatttacaagtcttaaaacatgagatttgggattctgcgactattattatcttcttagtctatcagccaactcagctagactttggcagtgtctgggggacaacgatctgacacaaagcctgcactccacatctgcgcccgtgcttctgccctcacggggcttgcactccctgcttcagccttaccttagtcccctcccctggccagattaactgcttcctagaagttaacatagatttatactataacattcatcccattgtatttgagtgtgtgtgtgtgtgtgtgtatgtgtgcttgtgtgcataatgtctatttctgctggtcaataatgagtatctgaagtgtttgaccaatgtctctatatgtttctaagtgaaatcatttaaataaatttcctcgttttcttgttttaatttattttgtctaaaaactactgaaatttagaggctatttaaatagctaagcactcaagatggttttgctgcagagaaagttgagccttatttgctgttggcttcaagaaccaaggggatgctgggtaaaaaatctaaaattgtctagaattccttcctttccttttctttttcattttctttcttcttcctttgcttttcttcttccccttccttccctcaagggccagaaatttcccaacacattatttaagtagctaatacataatgcatatatatatatata

SEQ ID NO: 111863 - DNA, 1077 bp, Homo sapiens
agcaaaatggtactttacacctgtattaaagccagtgcagccacatgacacatatttgtttgttttcttttattttcttttgagacggagtctctgtcacccaggctggagtgcagtggtacgatctcagctcactgcaacctccgcctcccaggttcaagcaattctctgcctcagcctcttgagtagcagggattacaggcacccgccaccacgcctggctaatttttgtatttttagtagagatggggtttcaccatcttggccaggctggtcttgaactcctgacctcgtgatccacccacctcggcctcccaaagtgctgaaattacaggcgtgagccaccgtgcctggccatgttttgttttttgaacagatccaaagaactttacatcaaaaggattttcattccattcaccaagcctgttttctttttctctccagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaagtaagcaggtgtcacccccctgtatcggggacctctaacaatttattcctcttgcatgtctctacttttcccatttacagactggaaactggtcctttaccagaaagataaaagcaagtattttctctacagtgcagggaagatgatgaaggtttttaaatttttttaaaaggtacacaaagattaatttataaaactttaccacaattgaccaagcaatcaggcctggaggaacctgttgtctccagtagcatcttccacaccaacactaggagtctcaaagaagacaggttgatgtctcttcagcaccctctgaagacaattctcatgactcttgatagagagcatcctaaaatcacaattgttaaaattattttcctattctgtgttgtaagacttcgtaagccagtcactgaaattctcgttcccaaaatgaaacatttgg

SEQ ID NO: 111864 - DNA, 1411 bp, Homo sapiens
caggctagacagagcagcactttgaaaagagctgggaagatgcctcctagcatagctggaacagatgtgggagttgccattcaggaactgactttgttataggtagaaaatgaaaaggcagatgcttacttatttacctgctatgcttccacctccaagcctaacttagtttttctaatagttttaaattctcttttttctgttctaatgacacgctccttttttaatgtaggtaaggctttatacttctccttgacctgtagtggcatgagagtgtataacatttcctaagatgacaggcaaagtagaactaaccctggcactgccattagctggaccccaccttctgccatctctggccacgaagtcactttccttgtttgcggctataccacagtggtgggactgcccaggggtaagttggtcagtggacagtgttcctcttttctgaaaactgtctgcacaattgccagcaggcatttgctggttaagatgcaaacagttttaaaattcgtcattttaaaaccatacttggcatctaataactacagtttacccaaccatccactcatcttttaaaaaaaaatcattttgattcttgctaaggaataaggttgcatgttttgcagttgcctaaaattagacacgtggaccgtgggtttggcattactttgtacctaaaagagggggaaagctcctggcattgctgtagctgtaaccattccagtgattgtcctttttttccccctacccaactagattaatagcatgtcctccattcactatgtaatttcaatccctaaactgctttagaccttttcttcaagtcaattgtacaaaggcatttattgtatatttattctctgactccttcagcagctcagaagtggaaaatgaagctcctattcagtactaatgggacacccaaacctaatagataatggttttgtgttatttgagaaaacaaaagccaaacagtaaatcctcccactagacatgcagtggtttcaagaagtcacttgtgaattctaaattacatacaaatggaaactaaccatatgtctttaattcagtattaaattttgctttggcttgtcatgtagagtagccttctcaaatttttggttttaatttctgtcaattccataatcattgcatgagcattcaccatcactgaatgctggtgctgtcgctcctaattttcctttctttttaatttattattatttctaacttttttgttttgttttttaacttgcagtgcaagcttcacataaagcctggcaagccaaggatgttcccgcattcacctgcttttgcagtaatatcgtatctctgccatgtgtgttctttagttttattttattttattttatttttttacccttcctcaaacaccagtaactattat

SEQ ID NO: 111865 - DNA, 2416 bp, Homo sapiens
cattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattct

SEQ ID NO: 111866 - DNA, 1047 bp, Homo sapiens
acagatgccaaattaccaagcatgttgctaagtgatcactttcatatttgaaaaaatgatatgcttcacatcaatacaattactttagtttaaaaaagacaaatgtctaacatgcagcttacatatatgacaattctgcattaacaatgaaagtagattacacgacagttttagaaaacacattggttattttcaaacagcaaaatgacaaggatctacaactacagtttaaggcatatcagcatattttaaaattaagaaatagacaaagttctaatgctgttcacagcttttcaatttatttaaaaaattcccttcatacctacatacaaactagactttgtaggtcttaattcccactaaagaatgtgtcctgtcagtggaaccaggacttttcgaagctgagacctgacaattccagactcttgcaaatggcaaagcaaaggggtgggaatggacagtttttgtaggaccacacagagacagcaggacgtgggtcggtaacagctgaaaaacctcacccaatagtttgtatgtgaaacagtcatggaaatgtcaagaaagcaaggaaaccaagtctgttcatttgaggtgcacaagatgtggattgtgtgtgttactgctggtgagtcacaaagcagagaaggaagataagtaatctgtgcccactgttacattaaataattcccattgttgaaatgccctttttggagaaaaccttaaccaattaataaagagcctaagttgggaaaacacaatctgaactgccaataaattctcatcaatgcttttccatcacattctacagtacatgtgttatggagatctaaagttcagaagaagcaaaaagatggtattatgtttgaacaaaagatatggggtaaggccagctagttatgtaggcccctcaatccccaaaaaagaggtggccactgtcagcagttagcaccagggagagaccattaaactaagattaaaaaattaagtggtcataaaggcatcctagcataaaaatttttctcttggttttctctagtagaagatggt

SEQ ID NO: 111867 - DNA, 2664 bp, Homo sapiens
tctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacattatttgtgtgcccttttttgtgagttctttttagtcactgcttggtttgcatatgtacacgtgcttactggataaaagaaatagggataagagtctcatgctttcctgcctcgtgtggtagacttcaaatggctgccgtctgggttacaccagtttctcaaagatacgtgccatgtggtgtcctgtacttcacatatcatgttatcaccctttttcccccatgcctgtccctgtccaccctgccaattcatgtgccttggtgcccagctgaggcatcgtcttcttcactggcctcctcttccctgctgctgctcaccctcccgtcgagctcgaggaagtcaccccattaactgacacactgctgttctttcacagcttgttgtagagaagctccttttcttttcttaagccattaagaatcaaatttgaatctgaacctttcttttttctcttctgtagcttcttctttatgtaaccatcctgttgacaagccctactctctcctaatggacatagagcattagaagagcaggagctgtctgttcacacgtgttggggaagagttacctcatttccaccatcgcctcctgttcttttaaagtctgggtcaaatattgcactgctgtttgtacttgtcaatgtctgcccatagtggatactgaagtgacttaccactaccaaaaatagtcatattcaataatattaattaaaaaggaaaaaggaaattgactgaaacagaaaacgtgggccaagacccaaggtcttgtgctgggatccccttgcttagaactatcatgttcttgaagctgctgatccaagaactgatggactgaagacagcgtgtaccctaacctgagggggccaccacacccagggcccacaaacttgatctcatggtaactcctgtcctttctgtcccatgagccacattctgaacagcctgatcaggatcctcaaccgtcaggtcataagatccgagcaacattttccttccttttgttagttttatgggttgttttggtgtttggggtttttaaaaaaaaaaaatcatttgatattgcatgaacagagatggctgcaattttttttctttggagtgttctattgatacaatgtttttatttttcagctgaccatctgcctcttgagagagagagaagtgggcatccttcctttaaattcaggaaccactgttgttttatttgactttttctgttacttgcatcccttatataagttgttttggatttgggactatgttttgggggagaaaaactccagttagttctgttttttgtattggttattcagcttacttttggtatcaaaattatgccagttttaagctcacttgagtgaagtttaagtcacaagattctgtttaacatgctttccttgttttggaaacaaccaaaaacttcccttttttgttacgggattttgacctacaaatcctaatcatgtttaaaatgtgccggtgttgggtagatgacttttctgcctctggggttcaatttatatttaaagataccttaaaataacttactggcccatccctgcctttttatttgttgtgaagctctgtaccttgtgtccacagctttttaccaagacccatatgtcttggaccatgggaaatgaaccccaaacaagtacatgtctcttctcccagataacagcatcattaacaatggttctgattcacattgtcttctcagagttacctaggtggatttctctacaatatct

SEQ ID NO: 111868 - DNA, 1040 bp, Homo sapiens
tgttatcaaataatgctatgagttttggccactagatggtgcttttagaaaaatacagcatctttttcaatttctgggagaaattgagttgagtttactgtatgttagtgagcagttgaacactcatctggttgctgagccaactgtgttggcttagttagaagttcatattacttaaggtacaggaggcctgtgtgtgtgagagacagggaactttggcaagatcagccagggttaaggggcagatggtgactggataccacgtttcagaccaagaaaaaccagaaccagtcttacaaatcccaattagtgagttgtgtggttctgtaaagtagcctagaaatacaattgggaaggcttgaatatagccaagtcccaaaaccttgctgctttcagtttgaattggatttggccaatcattaggagagaaaaattgaagagcacgcttacttagcacagcttgcatcaagaaatagcaagttttccctcaccatatttagtggcttttatgatgtactcgtatgtaagaccaatgtcagacataactctcccttgtgccagttttactttaaaaggcgtaataagataaccaagaatgtcttatcagagaaatttgagaagaactcacttttttagttcctaagagcctctggagttaaggatgaaatgagaaggatgaaatgcctttctcttaactctagaagtatagccttcataccagatcaaatgccagaattgttgaccttattgtgttacacaacagtaaggttgtaaaaaagcagtttgaatagccctaggcctagtgaactggtctcccatttcttggaaatagcttattttgttaggcaataggacactccagaatgaaggccaactttaggcaagcagccacgacaaagtgactggtggggagcagaatcctttttgcttttcaggatatgatctatcttcagcaaacgacttagcatagaaaaggcttgccttttctttctttcactcttaacgttgctgtgcttatatgagttatacaagttcaattc

SEQ ID NO: 111869 - DNA, 1034 bp, Homo sapiens
cacttgattcggtgtcccatgagaagaatgctgtgttccaaactaacttaccagcaatttgtaaatgttgaaaaccttaagactgaaaagtgaaaatcctattgtcctctaacattctgctcaatttgcagctactggactacaaatgaaatactgactctaaactcagttttatccctagctgtctacataacacaactatgtcctcatctgttaaataggaggaagtttcatagtatctgtatcattttacagatactatgaacatatgcagttgtaaacttcttagagctcctacaattcagatgaattaaacagatgaagatcaggatgagaaatttttaaaatgtctatctgtgaagccaatcctttgctatcttccctcccactccctttactgacatgtgagtaaatgcttcccatttaattggattttaaggtcataaaacaggtaagtcaaccctaccacaagaattttttacaaatcagatgatgacctgaaaatactcttgttctgctaaatctgaacattacaaaatggctaaaaatgacattttaaagataggggtctgagcctactctcacaagcagtcacattaagatgtaaatttactatttggaggattcacagtgcaccagtgaaaaaatatcacgaaagaaaaattcttatgtctaaaacctatatccctcgatcacattcagatcctcttcatgttttattttcagtaagtgtattcttggtctttctattgttttctctagttgaaatagcagtgcctagccaatcaggaacctgtacctcttcacaaccagaaaaaagtcacaaaaacaaaagttaaggacaactttttattgctaccagaggcttttatcatcagtacacagttctgactgcaatacctttttcagactgcaaagggagctcaggatccagaagtcattaaaagaaacataaggctggggaggcagggggagtaagttctattagaaaatcctaatagcttaacaaaactagggtactaaattcagttata

SEQ ID NO: 111870 - DNA, 1218 bp, Homo sapiens
aattcaattaaaattcatggccagcaatcctgttccccctcagcatcctgatttaattttcctgttgcttttgcttgcttctccatttaatagttactgaactttatgcatgttgatctatattgattttcactgcagttgaatgaacaaattatttcagtgtgacagccatgactcaagttccaattagtctgaaaagggtactttggaattgtcccatattaatcagagatggcaaaagaaaaagttctcatattaccaggttgattttgtgtctcatttcaaattttaatttaaaattatggttttcatttttgtttaccttaaagtgatgcttaaaagtggcatgtaattaggacacttaggtttgttgaaagcattttcgacatttgtataaaagaatttgtgataaatatatccaggtgctcaccaaagaaacatgtattaacaacttaaattagatttttctaactgatagttttcactcatttataatcagtaggagagactgtctagatgttggggcagctctatgatttaagtctgtaacatgttataactgaatttagtaccctagttttgttaagctattaggattttctaatagaacttactccccctgcctccccagccttatgtttcttttaatgacttctggatcctgagctccctttgcagtctgaaaaaggtattgcagtcagaactgtgtactgatgataaaagcctctggtagcaataaaaagttgtccttaacttttgtttttgtgacttttttctggttgtgaagaggtacaggttcctgattggctaggcactgctatttcaactagagaaaacaatagaaagaccaagaatacacttactgaaaataaaacatgaagaggatctgaatgtgatcgagggatataggttttagacataagaatttttctttcgtgatattttttcactggtgcactgtgaatcctccaaatagtaaatttacatcttaatgtgactgcttgtgagagtaggctcagacccctatctttaaaatgtcatttttagccattttgtaatgttcagatttagcagaacaagagtattttcaggtcatcatctgatttgtaaaaaattcttgtggtagggttgacttacctgttttatgaccttaaaatccaattaaatgggaagcatttactcacatgtcagtaaagggagtgggagggaagatagcaa

SEQ ID NO: 111871 - DNA, 1405 bp, Homo sapiens
ggactcatttctgtttttgctaagtttgctgtgttcaggtagggaacaccaggtctaatatctttgtgtttagacgtgtgacaaggccacaatatcagatttcttcctagttttctggttttaatataggaaagtcttgcatcagattgatgagatcatgccaaaattatttgcgacatgattcccagtgtcttggtttgaggagagtccatcacagacataccgtgctgtgaggaggccactctcactagttctgcctgagcccccactttgagacaaagtatggtgagtgttcccaggtttgaaaggcaatcttccttttgtccctgttaacctcccactacacccccttaagctcttgcgccacctgttggtcaccattctgggatggctaaacctctttctctccttagccttataaactcaggctgttaactctacctagattagtgtggtggtctttgtagttcctagctgggcagtagtcaaagtacatgttctagtttaaaactagagtaggtgcagccataaaacagaacaaaatcatgtcctttgcagcaacatggatgcagctggaggccattatcctgagtgaattaacgcaggaacagaaaaccaaataccacacgttctcacaagtgggagctaaacgttgggtacacgcggacataaagatggcaacagtagaaactggggactactagaagggggagggagggaggggagcaagggttgaaaaactgttgggtactgtgctcactacctggttgacaggatcacttgtactccaaacctcagcatcatgcaatatatatctagttaataaacctgcacatgtaccatctaaaagtaaaaagaagcaaatttaaaaaaaaaaaaacaaaaaaacagacccctccccaccagtctcctggttctttttgaaggtggctgtggtcagactattccagcaggttcctcagtgcttcatgctgttcatcaaacctggatccatctggacctaccatttatgtcatttattgttataaaaaataatacatattctcttgacaccttataattagagttcatttaagtcctttttatcaactccattagagtacttgtctggtgtcgagagttttggtagttccagtatatgtgcttgttttgtttcttccactggatctcaagaaggaacaaattattttggtgtcttatagaacaaattcagattgtactagattagaaggaatttattttgatgttattttggagaaaagacttacttgggacttgggtggaagtggagttcatatggatggttttgttttgaataatttctaaggtcttttagctctatcatttcttgtcagtctcccaccgctaaaatataactctatttacttcgttttttcacacagaa

SEQ ID NO: 111872 - DNA, 1032 bp, Homo sapiens
gtaatttacttcagattaatttcctgttcaatattttttcatcatctctaagtgtataattcatctgttgtccctggtatcttttacttattactattgattttagtttttcaaatgggctatcatttccattatcatagttcatttatatttcctaagataagttaatggctacttgctgcgggagaaattcactgtattttcttaatcttaagaggtggggtaacttaactccaaattactatcagttgataatagtgttacttaaactttaaaatgttatattctctgagcacctaaatttaattcaactatggatatttggtgagatgacatagtgaaaattttaataaagagtaggagaatattggatattgatattaaatgtgataatacataaagttttatttcatgtgtctcaagtctgatagattttgaataaccttaacatttttaaatatattttgtagtattacctaaccttttatgagagagaattctaaacatactcttgatgatagctcaaactttgtcttctgttttcaaaattgttcccttatagaatgtttctccatcccagagagatgaagtaattcaatggctggccaaactcaagtaccaattcaacctttacccagaaacatttgctctggctagcagtcttttggataggtttttagctaccgtaaaggtaagtgttttaagatagacttacatataacctcatttgagtgtatgtatgctaaactagaggctattagtgaacattctgtaaggtagaaagaagtggagaactttgctggagaatgatgtatgtacccataagaagacatggtgatgtcttctgctattgtttattttatttttattttttgatagttttgctctgttgccctggctggagtgtgtctgcctcctgggttcaagcaatttttgtgcctcagcctcccaagtagttgggactgcagacacgtgccaccatgccagtctaatttttgtatttttagtagagacagggttttgccgtgttgg

SEQ ID NO: 111873 - DNA, 1062 bp, Homo sapiens
tgggaggcggagcttgcagttagccaagattgcgccactgcactccagcctgggtgacagagcaagactgtctcaaaaacaaaaaacaaaaacaacaacaacaaagaagaggtaggtcatagatttgtatgccatgctggggaattgtacttaatcttttaggtaatggtgaaccttttagagtttaaagctggggaggttgtatattttaaggagaagactagcagcatgtggaatataatatatatacagaatatatattaatagcagtctatattttaccatgtttgatcaatccattataaattctctttaggattatttgttcaactactgaatccttctaatcctatttaagcagtccatatgagaaacagttcacctgatggaatcaggaaatactgttttgggctttttctttttctctctcattctttattttagaggaataggaatgaaatgaattaggcgcagaacttactatttgtaatgctgtcatgatgatattactgtttagtacatatttgaattgatttgaaaaagtgaccttagactcagtattacttcagttaaattgagtcttcttaaactgttatcttttggattttaaaaaaattattgctggttttggctagtgatgataacattggctatgcaggaatgcttttcttggccctgttgttaaattttactatctggtatatgggccaaacatagtggcttacacctgtaatcccaacactttgggaggccgaggtgggaggattacttgagcctgggagttgaagaccagcctgggtaacatagtgagacctcgtctctacaaaaaagtaaaattaggccgggcgcagtggctcacgtctgtaatcccagcactttgggaggctgagatgggtagatcacttgaggtcagggatttgagaccagcctggccaacatggcgaaaccccatctctactaaaaatacaaaaattagccaggcgtgatggcacaagcctgtaatcccagctacttgggaggctgaggcagggagaattgcttgaacctaggaggcggaggctg

SEQ ID NO: 111874 - DNA, 1083 bp, Homo sapiens
ttcccctttctccctcctcagttggccgagtcgtcccgcgcgcaccgcctccgcgcgcctatgagaatgaggtggtaacgggcccccggatgaccccgcgtcaccactgtgaggcctacagctctgccggggaggaggaggaggaggaagaggaggagaaggtgaggggcgggggcgggggcgggggctcgacgcgtctccgcggccggcgtcgacgcgctggggccccgctgctccccccgcgccgcccccgtggcagcgcccttggccgcgcgctgctcgccggagacccaccctcccgcatcccccagcccggggaacctcggggccgccctcttcgtcctctccggcccagacagacccgtcacctgcccacttgaaaacggcactactgtgttccttttcgggccagtttttctgtcagcgagtaacttttttttgtggcagcggcaaattagctactctatagtgcgtgttggaggctctacgagcccgtgttaatacacaaagaaggggacacacccccaccctcaggttgaacgattctccggggacaccaggaggattactaactttgcacggcagactgaatgccaaatgaatggggtgaacctccggtgctgtgaaattcgggggagggcaacgttacccagggcttggggcgggtgggtggggggaatccgggggaggtgagatttgagttgtgctctaaaggctagattaaataactggaatttgaaaggaggacagaggagcctccgctggagctagggggctccgttacagatccttttggcagaagttgacaattgggtatcaaaacagtggaaggtgtttcgggaggtaggatggattcagactctgaaggggtttgaactaaaatgtttatgttttattctgtcagtggggagccactcgacttagagcagcagagcattacagtaatgacgttaaataacaacatttgatgaggcttattatctgccaggcattctcctaagtggcttgcaattcacttaatccccccaaggctggtagtaggagcctcattttacagatgaggaaaactgagactccacaaga

SEQ ID NO: 111875 - DNA, 1904 bp, Homo sapiens
taggaatctagcttttgaacctgcatggaaatttttgtacctgcatttgaatttacataatttaaaggttcaaaaaacttttttttttttttttaaatagagatggaggcttgctgtgttggccagaatagtcttgctatgttggccagagtgttctcaaactcctggcctcaagcagtcctcccacctcagcctcccaaagtcctgggattacaggcatgagccactgttccctgctgcctttttttttggggggggggggaggtcgagaacgtctaaaatgtgaaaatgtgtataattgtgggtaaagagccagtacatataagagaaacaacttgattgtgttctgtcttaagaataggagcatcattacaatattctaagtatctgctaagtcaaagtgacagttgttaaaagaagcctcttgtttttttctcaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggtcagtgggattaaagatacattttgtactttgaacattgctatagctaacagtaaataattggaatggcaatgaaatttatatttttaccttcttcaaactttcaactttgactttattggtaaatctttttttttttttttttttggagaaggaatttcgctcttgttgcccaggctggagtgcaatggcgtgatctcggctcactgcaacctccacttcccgggttcaagcgattctcctgcgtcagcctcccaagtagctgggattacaggcgtgcgccaccacacctggctaattttatatttttagtagagacagggtttttccatgttggtcaggctggtctcgaactcctgaccttaggtgatccacctgcttctgccttccaaagtggtgggattacaggcgtgagacaccgcgtctggccctggcaaatatttaaaatcatttaaaatcatttaaatctttggaagtttaataaatctttgttctttgcattgtataggaaagaaatactgagccttgataaactagaagctcagctgaaagcttgcaactgccgactcatcttttcaaaagcaaaagtaagtcgattccttgcttatgtatatatctcacagtttgtattttgaatttttaaaaaatatttttcttttttttcttttttcttacagccatctgtattagccttgtgccttctcaatttggaagtggaaactttgaaatctgttgaattactggaaattctcttgctagttaaaaaacattccaaggtaattacagtcattattctttaaggcaaatttttttcctgatgtttatttttttctgtggtgacttaaacattaagtaatactttatgggactcttaacttttacacttgttttttttcttatatctctagtgttaaagttctcaaaatgcagctttgacccagacagtattaatccggaagggaacctggtcacttagctcagcttctttctgcatataggtgccccttctgtagtaatcatgccatatgatagtacagctgttacattgccacatatgcattgttctgaaatgcatactaggtagtagactcagaacaaacactaatgggataggatgggatcccatcacacctgtaggactgaactgtcatcccattagcagcagcatcaattaacaccagcaatgttgatgttttaaacccgaatgtcttttc

SEQ ID NO: 111876 - DNA, 1961 bp, Homo sapiens
cattttcatagcttgttagtttactttgatatttgacagtgtaagtggtataataaatcactgatgcaagaaatacatctaaatagaccatatgctaggaggtatgttgtttttagtcttcattactggatttaaaatacttagaattctacaattctaatacttgctgatagttattaattggtacaagaataatagtttggcaaatagtaacttgtttaaacttaagaaaacctatattttctttctttctttctttttttttttgcatgtgccaccatgcccagctaatttttgtattaatattttttgtagagatgggattttgccatgttgcccaggctagtcttgaactcctgggattaagcgatctgcacacttcggcctcccaaagtgctaggatgacagggatgagccactgcacccagtccaaaaaatctatattttccaatgagattactatagacttcatttaggaagtccttataaattttgtctctgtaaagcataaattttgaatataaaaatcctcactagagatatagcagctttattttggctataaaacatttaagtgtgttttaagtaatggtatcctctttttttgtctctttttctctttagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttg

SEQ ID NO: 111877 - DNA, 1907 bp, Homo sapiens
tgtattctttgtggctctgctattattgtgcaaatcctgagcctgacctttggcactgtttgccccatggctgctgaaatgatagtctataaacactgccatggatgcattctgactttcacagtatgccttgacttatagttagctaatttgagcctgtcattttctttttttcaaagtgtctaaagtccattttgaaaactgggtaaccttacagtccttagacttatcgttgcccccaacagtttaagtgccactgtttcctttccacttgcacttcaaacccactactaaggaaagtgcactagtgcactgtctagtcacttcaccaaccagcaatgaagtgactagagagtgtgatacaggtccagaatccatctaaagcctttgcttccttgggctatttctggtactaattgtcctagactaagttcctccggaggacagagcctgagagatcttccttgtaggtaatttattttgggatgtgatcttcagaaacaagaatagggattgcaaggagtcaaataggaaaggaaagccaatttagtggtgagttattgagctgatcacatctgtgggcaactgaggcttgatcctagcaggatccttctgaggagctacataaaatgcacctcagaatgtccactggaggagtaaaagaggagaatatccagtggctccaataccctattggccaaaggtcacttacctaggtgttaactctctcccatatacaagtttagcttttcttatgacaatagtgaaggattctgaacatttgaagcaaatccagggaatatacataaaattaactacaaatgataaagttcttatggaaataaatttaaatggctgggcatgatggctcaagcctgtaatcccagtactttgggaggccaaggcatttggatcacctgaggtcaggagttcaagactagcctggccaacatggcgaaaccctgtctactaaaaatacaaaaattagccagcgtggtggtgcatttctgtagttccagctaactgggaggctgaggcaggagaatcttttgaacctgggagatggaggttgcagtgagccaagattgcaccattgcactccagcctgggtgacagagcgagactccgtctcaaaaaaaaagaaaaatgtacgcatagttctgtgttttctaagcacattgtatatacttttattccttatttgtagatcatggcaagttaatataaaacttagaattggctgttgtagggtttgttatgtgccaggcactgtttatatgcttcatataaactcatttaatcgtcacaacaacataataaaatatgtattgtgattctcttaattttccagatgaagctgaggcccagaaagattggtaactcaatagctatgtaatcttgggcatgagttggtacaggaaagggctctgcagcatgtccagactatagtgaaaagtagcccctcctactgggccgtcgaaccttacagacctatggtgttagaggttgagctgctgttatacagtggggacagggaggaataaatctggcacccagcagtatgcatgggcaactcttggtactctttggtcccattttgctgttaaattgacaaggacaagaatcatggcttgaaaagagcacagtaactgggttctgggttagcccactaggtcaaccaacaagaccagcagaggtgctaattgatgaagagaagccgtaggtgaatgggtcatggaaggagatgatgaatatcagttgtagccccagaacagctacaacagaagaagctgtaggttacctcactagcctttcccttctacgtatccctgggggatgtgggggcacaggaagagggaggaggtgctttcagaaattatacaggcggggtgtggtggctcacacct

SEQ ID NO: 111878 - DNA, 2066 bp, Homo sapiens
gcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaacttgtttttgtgtttcagtaatcagtttaaaatctaagatttttttttaaattagactatttaatgaagtgccatgtaattgtagcttgctagtgtttaatgtttaatagactggttctgtaggtgttttaaccatttaacactctctgccatccctggagaaagtggttctactcttactgaacacattctctctgacaaaatcaccagctgctttatttttctatttattacagttaaacagttgatgaggtctgaatcttgaccaaaactgctcagctgagatgtttttcacaatagacactgtacaaagtgtgcgtgcaaaaggacacggttggtagtattttttcattaatgtgaacattgactaaaaaaaagcagtcctgccttttaaatcttgtggcagctcagaagggaggtgcttaagaaccttaactactatgtcagataacaaaatatttttttccattttggagattggttactgctcacacatgatgtatagggctaaatatatgcttgtttccttgcacctgtgtacttcccctctctccctccctttccttcccctgtaggcaataaatggccattttgcaactgcatacctttgtcttggtttttgactctttatttgtgcagtataaacctctgcttttaggttgatacgtctcttctaaagtgaagtagggagccaagataattcagggcaaaatacataattacaaattcatgctacatttttttttctggtgaaaactacattactaagtacattgtttaaaaaaaattctgaagctagttatatgacttgctttgcccgaagaaaccagtgcaaagggatatatgtcacttctgagtggaactttaagggccagtctttaatttgccatatttccttttcttgcctgtgtgatcatagaagtatatgttgagatgaaacctctcattccagatccttaagtgactttgttgaagagaactcccctgctgtcctttgggcatgtagcgtaataaacaactgctaaatctcagtgtgttaatacaataaagttgtgttattagggcttaatttagttgatcctgactgacagacaaccaccagacagatttgctgagttatcaatattgaagaaactcaacagctggacctgctaagatctcaagtaaattcattcaacaaacattcaggtatcttctgtgaacaaggtgctgtgggcatattaagatgaaagacatctttataatgcctatcctccaagaattcatattccaaatactccttatgacacagaagatattccagtgtttcagtcaaagtaaagatatcttaaatcatagaatcttggaaagagagagagagaaggcacatagtgaaataattaggaattctgcaaactgtgcttacagatattcagctgaaaaatgactttaaaataaggtgatagagaacagattatttttagtgaaacagaaaacagctgtgcggcttagtaagcgcttggaaaagataatggtagattattttggaacagattgtcaacattgacagttcagtgcctattgacttgtttttaccaaggatccagtgtgagaaggctgtcactgaccctgaggaccttgtcttcacagaagcctttgtgttggccagcctttaggaagtcctccaaaagtggaatcactctcatgtgaagtgaatcttgaagttgtccagatttcaagacacctgccttgttaagagacctttgtgatgaggcattgaagacactcaccaagtgtcctttcatttcaccatctggccttgggcaaaatgtaggctcaatggtaaagtggagatgaactaaatctcacgaaatcggtctccgaaaagcagaaaccaagacaagggtttgcatggaggtagtttctttgggtaa

SEQ ID NO: 111879 - DNA, 1025 bp, Homo sapiens
gttcttcgttcaacagacatgacattgaagtaatagaatattttttaagtaaaatagttttcactttcaaagcctatgacataaggacatttgtgcttattaattgttaatttttttttatggtacattgtataaactgagtagcattgaactgcattttagaagtatgtcatcagaaacaaatcacattatggaaaggatatacaaatgccaagtgatatgactcttttggcatggtggtagcatggtccattcagctttcagaatctttcggaggctctagtttggtgcctagtactagttatttttgttagaacaatctctcaaaatttagataattttccagttgtatgtctgtcacttttaactctaaagcgtaagaatcatggtaaccctctcagaagtggtcctttcttgctcatttcagtttcgtattaacttcaaatcactgatgtattgtctttcaagctatcaattgttatatgtaccaatttaatttagtttgtagttatctgaagtcacaaaattggttcagcattgatgtcaaacaatggctttgcttcttaccaaacagacttagtatcctgctgcttgtttcaatcttgatgcagtaagtgatgcagtatctgggtctgtatttacttagaaactgtactgtcctttctctgtgcttaacttgctaaaaatatattcccttacctgtgaaattcctgagcggtgctctgccaacttttcaaggggagggatttggatggctgtgttactgcacactggatctggaattgttcagggttatgagtgacaaatttcttaaacaccagcagcactgagatgtgcactatgggcattcgtacagttgttgtccaaatgcaaacaactttttcatcttggagaagctgagatacagagttcaatagaactacttggaatattttgagaaggttgaatgtttcatctttggctttgttgtctctggagtggggaagtatggagggcttttttttttttttttttttttttttttt

SEQ ID NO: 111880 - DNA, 3221 bp, Homo sapiens
ttggaatcttttttttgcctaggaggggccagttgaaaatctgtgactcaagaggcagtgaacagaatactgttttctggggaaaaattggttggctacttgatgttaattatggcacagtaacaggaaaaggttgtgtctgtgtttttaagtttttctttattctgcttttttgctgctataagagttttctgaaatttatattttaaacttttcatgcactttactgtttctagtctcaaaatgtgatatttttaataaacaagaaattttccattatgtgaatgaaattttaaaagacaatagcctatatttgtgtctcactaatatataaagtataggtcaaatttaaattatttaattagttttaaatatacacaatttgtctcctctttcaaacctgacatcttcggctgttttattagtcttaaatgatgcatttactttggtcattttatgctaatttcttccatagtaaattaatcaggctatataaggtaatatttccccagagggtaattttagtgggacgagggtggtgggatgatgtcatatcatacatgggattgcatcagaagggttctgtaaagcctgaactcccttttaaaagtgcctagtgatagaggcgttgtttgtcatctattataattggaatgtcattgtagttcagtgaattttgatgtaaataaaatatcttttaaaaatgttaaagtaccaggataaacaaacaaaaagaaacaacccttaagatgacagattttcctcaacatgcaggtttcccttcttatatacctcaagtatccaacatctagccatgcaaattgattacctgaagcatagtactggaaagtagaatagcatgaaaaacttaattttgtggacattacctttttttgtaatcagctactgtatgttttattttagatcttttgttttgggtgggttttctgctctggaggtatatgcactaacaaaacattttcctcctttcatatacgcatgttaattagcaatgtgagcaatatttcctaccatacttcactcccaatattttttgagatgtttgtataaaatggaatttaaagttcacttatgattgtatatgaaccacagaggagcccatttattaataaaaaacttttttaatagttaaatgtagagggaaaaaataaaaaaaaatgggaaacattgtaaacagcttaagtttattttgtgtatgatcgaggcactctgttgcaggaaggtgtgtaattgggttctctctgcttcaaatgcgctctttcaaaccattcattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatatattcaatgaaagtaaaatatatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcatacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcatttctttgatgtaaggcgtgtgaacattcgtttgaatatcacatgttgaagtcaggtatggcacaatgggttctgagaccagcttttcctcccctcccatttgccttgttccaagctctttcttttcaaattacttttctgatattcataggcaggtatttaattttactaattagcatcctgtgtgaatgtattaaagaagccactgtgttttagtgtagttggcaaaaatataaaagctgtttcttatttgcccctatttttttggtgtcttaaagttatatattaaatcacagagaagcaagggagaaagttgaaagatatctaaggctcatatcacttgattctatggtagattatattagaattgaggatgtggcacattaaaactggaacatgggcaaatatagtgttccattttaaaattctaagtttatattgttaaatgggtgaaaatttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagactttatggcacattttcaaaatagcactcatacatacttacattttgacagaaatgtgaattctcacattgatgagatattctttttcccacctgccctaccctttaaaaaaggtcacttttctaatgtgtagtagattcatttacgcctttccctttgagtcataccatgtttggagaactgtgtgaattgtaggtagagaaattaactagggaagccagaagcttgaactaaa

SEQ ID NO: 111881 - DNA, 1618 bp, Homo sapiens
agacttactgatcagacaaatccagtcatctagctctgacagataaaactgctatgtatggcttcctgctgaatgatttttgctgagttgtctttatgtagcaaggaaatccagaatttacacatattccagtatttgtgaaaatgagtattttaaattaagaatagaatagttaactgtgtagtgttttgtatgtatgtagcaaatctgggaaagctagactaggattagcaaatccataaacatggtttactatagcttcagtcaggtgtgtttggatatcttgatatgcaaataattgaaaataataccgttaactatgtatgtgctcatataaatattcttattttctacttattatagccaataggattagtacaggctccattatatttatactgatatgttggatttcactaaaccaagcaggccaattctaaagatgactagacataatttaatgtgtttagcttctcaaattatcacttacacacaaatggaaggatttataattccaatagcatgctgtgtttccctattgagccacctttatttcatgtaatacccattgaatatttgagccttatttgacccactatcaagacaacaggtaccagaagaaagggtagtcagttttttggtttttataaattatggattgttctttatatatcttgaatttttctttttttcctattcccaatctctttccagggcgtgattgactacattttctattccaagactcatatgaacgtgcttggtgtcctggggcctttagatcctcaatggctggttgagaacaacatcactgggtgtccacaccctcacatcccttcagaccacttctcactgttaacacaacttgaactccaccctccactcctgcctcttgtcaatggtgttcacttgcctaatcggaggtagtggagtactgccccgccaagacggggatctgttgctatggacctgtacagttgtaaatcaaagtatgtaggagtgaagtatggccatccttaagctgcttcttcaggtttctttcattatgtgtttgctgtaagactttgtacatttttgtgcatattggtatcatttggcagtagggctggaaccaaagtattactctctttacaaaattttaatttaacatgtttttaaattggaccttctttatattgtattaacagccagcattcaaaattgataaattaccaatttgaggcccaataacagtgtatttgtttttccaaaacaaatactttcttttgaatggtttcagtgagccaaccattttataaaaggcaatttttaaaaactataaatacagtattttaaactgaatgatgatatgccttccagggaaaaccttgaatttttcctttataactgacttttggattccaaagtcatttgcacattaacagagtacttaaatttacttgttcagtccataaactatgatatagcctctatacatggtaagaaaatttgaaaaattaaagatggttgcacagtatacttttataatccagcatgtaacaccacatgacaatttgttggccaaatgctggtttggagtttttttgaggaatcactttggtttttttgtcctttatat

SEQ ID NO: 111882 - DNA, 1102 bp, Homo sapiens
cattagacattgaaatgttgaagatgcaaaatctgtttttgttgtaaactatttttattaatatgctctacttatatattcgcaaagttgttgattgcttagaatggggaaatactaaagagatagtggtttggaataattttccaaaaacatttagggttaataccttcctggtgaatgccatcctaggtcctggaaatcatctttagcctgaaaaaccactaagaaaactaaggatatctttgagtgttcctgatatattttgttctgaaataggcaaacatcctttgattcatttgcttgactcatatgaaatggctggtatttgattttttatttttaaacaacaacaaaaggcagttttatatggctcaacctaagaagaccactctgagcctggtggattaacctggtaacaagtcttggctgtgaagccttgtgtaaggtctaaatgctaaatggaagtgtctcttctttattctaccaggtgttgtggaatacttaagcaatggaggagtagctgacaaccataaagacttcaaggaactaaggtacaatgagtgtcttatgaacttcagctgcaatggaaagaatggaagctcagaagggagaatcacacatggcttccaacttaagagcgcctatgaaaataacttgatgccttacaccaattacacctttgatttcaaagtgagtggcagcctttgggcaggtgtagaaattatttcagatacaagcatgtaacaaaaaaggtgtaaattctttatgattaattgtataatcttcaggaatttttagattcttaaaatgtctaggctaagtatgcacctaaatataagtaggtttattgggttttgtggctattgttgtcttaaattcttcttgctctcttgcttgtttagatttcaaataatataataacaaaaacttctaaaatgctcactaggtaccaggcactggtcaaagcactttgtatatatcaatatagttaaccctcacctgctcaaaccatccctaactttcagcagtaacctccctcccctaacctcccgccccccacagaaaagcaccgaatatagcaaaactcactttgaatgaattt

SEQ ID NO: 111883 - DNA, 1036 bp, Homo sapiens
tgtctcagaggttaaaaacattctggagaaagcctctagtaggcctggaagcccaactgcagatcctaattccatcccgctggtgctatgtgcagatcttaactcattgccagattcaggtatttataatatcatttcctcactgctttcaatttcacttttactcttggttcaaaggccagctagctcctaaattttgagtagataaattaaggaatgtatcataagaattccatggatgggacacaaggtaatagaagagagtttaataaagaagctattaccaaaggtgttgcctggtttaagggaaacaaagcaataaatgatgcagtactctgccactaggggatttagtaatagatctctttaccactcctctacctaaaagggaaagtggtgggagctgtctgtcattagaacttggaaaaaatacagttgtaggaaagggccacataataggagtgatggctttgaattgcatgaagcggtcaatccctggcaaaccaaaaagaagggagccagggaaatatatattcttacctcactctgcttctgtcctttcatctcctgctaggctgcccattgatcaaatccaaccaaaagctagagcggggagggatttgcagttgatgcaataaagatcagctgcctgaggcacagagtgtactgcagaagggtgatctgaaggggcagccagaaaatattcattacgtgtagctctctagtttaataatgttagcaacttttaagtgaattcattaaatgatatttggataatgttagtagttacagaagaatgatcaaaattatcctagggcttcatattacttcttgagctccactaaactactttatgtctgaacttttatcattttactttttataaaaataatttctgcattttaggtatcaaatggaaaacattagactattactcttttgccaataccaaagcatatgctaaattttgtatattatcactgctaggctattttaagttatttaaagtaagtaacaataaggttactataagata

SEQ ID NO: 111884 - DNA, 1009 bp, Homo sapiens
tggcgatggctaattcagatggatccgaagctatgctgaacagagtgatgacaaaagataacattggtgtcgctgtggtattagaggtccacaaagaactatttggagcaggtgagtgcaatgtaaaatattcttactaaaaataaacaccatcccaagtttttccatctcaaaacaagtgaagagaattttgccgttatttattgcaaagttattttcttttgaggaaagttaagggagatgggcaggaaaatagcaccattgtgtaaagcatcatatatttgttgggatattttgtgctctctatcacagtcttttttacttaccagataatctatgtaaagtcttttttaatatgccattaatcccaaacagttcttttaaatagggaatattttggttaggctgaatttagaaattatgatgacttggccctctttttgaattatatttttagcttgagtgtgattcttttgtctttaaggttaaggacttggcacatttcctctagtttctttgttatatctcagtcattgtcagggtaagagcaggatcttttatctacatggtacttactttagcattttagattatttatagcttccttcagagtcagaaactcattatgtacttcatacacagaccttttttatccttcttactgcctgcctttgagcatctcactgtttactagtacattttaagcaagaaaggagtgagactacatcagggctttttttcccctgtactttttgtagaggaaaagattattttggactagagtattgatttgaattattcagaccatgcatatgtgtcaaaccttcttttctcaccatacttcaatttattccttatcaaaggtaatctttgatatgaaattttggactttttacttttcttagcccctccgtttttatttacctttatgtcctttacaatcttattcttcccaaagtttggtacttttttttctgatattgtggagaatatcttttggagttttact

SEQ ID NO: 111885 - DNA, 1036 bp, Homo sapiens
agccaagatcgtgccgttgcactccagcctgggtgacagagcaagattccatctcaaaaaaaaaaaaaaaaaaaaaaaaaaaaaaaaagaacggtacaaatataggatgttatttatctacttccttatttaacctggtctctcagcttaccttttccaattagttaccttctggcactcccatgattacttaaagggaccaagaacacattttatatcattttatactgaatatagtaagaacttctatttggtttggttttaacagtgttgggatgtgatccagaaagggtcagagttaactttgtgtgattatactattgtcttgactgtgtattacattgcccctttttacttgtaaatgaattcagggatggaatattacttaaatcctatagattgctttagtttctcatagttggcagtcactgtcctctctctagcattaattaattacatcagagcccacaaagttatttttagactacaagttggtaagaaattgagttatgtctttatttgaaggactgctctggacgtgttctttttgcacatgaaacatccaacctaataataattctcaaatcatataaggggattttttggtcatagcagtctttattatattaatatatgttcttttatccatttgacctttcgtctagtttttttttcaaaaatgtgaatatacagaagaattcttagaataaaatatcatcaggaataatgcttttagcatctgtataccagtcacagagtatgaatggtaaactaatgtatcgaaagagacaagtttaagattttccgtattaccaaggctgtatggcttggaacaatgattggaaagtaactataaactaatatgtctaattgagaagaaacatctaataatagaaagaatggcagaaaacctctatatttcaaaatgttacctgtatggaaatctgtgaaacaaagtagatgcagaatagagtgcatttggtttgtatgggaagggaatgcaagaagtagcattgttaaggtagtagggatagaa

SEQ ID NO: 111886 - DNA, 1432 bp, Homo sapiens
ctttcaagataatatggaagatttttattattactctcacagttttgagaggaaaaatctaaaattccttaacaatttactagaagtagttaaggctttgaaataacagttagaactgttatctgggtatttgcaaattgattcttgaattattaaaaatgctgtgaactagttaagtaatgagcacataggaagtacttagatgtgtcacctgtttttcttttcttcctcaactcttttttcctgaatagtaacatggatctggcaacagattgaatgtgatacatcagtatattgtacctcttttcaacttctttcctggaatgacaggactatatacctcctataggtagaacaaaaccaccttctgtcccagtaccagatatttatccatgtcttagctgactattcagtgccaactatttggaatttaaagtattataccctgcctttattctttcttcagactggaaatatagggcaaaaaaagactgtgagttttgaagccaggtgcttcttctatttatttagctatataatgttgaaagacttagcatttctggacctgtttcttcatttgtatattcttatcttgtaagatcatttttgtagaggttacaaaactaacaaagataactgtggaagagtagtcaacactgtacttactctcagtctctttcttctgtaatcagagtatctgataattcctcatcttcactgatgactgtttaatcatacatgaaaaactggtacagaatacgcaacaataaatggaaactatcataattgccatttatagcaaaatactataataaaaatctctaatccatcatgatgaaaggatagagtattgtttagtaaaggctaggacacaagttaccaatattcagataattagaatataatacactgttctttaaatcacattattctagtttagttttgggggattcagaatctacttcaggatttggcagcacctgtttggtcatcattatgaacatcattttttgggagttagatgcatagagatactagaaaatagaactttgagtgataaaataccagatctcagcttttgctttgtcttttaacaagtattatttacgttccaaagcattttataaaatacattcatacatatgcatatgtttcttatatgtatataatgtatatgtagaaactgagttgtaaatacattttttttttttttttttgagacggagtttcactcttgttgcccaggctggagtgcagtggcgtgatcttggcccactgcaacctccgcctcccaggttcaagcaattctcctgccttagcctcctgagtagctgggattacaggcatgcgccaccatgcctgactaattttgtgtttttagtagagacagggtttctccatgttggtcaggctggtctcaaactcccgacct

SEQ ID NO: 111887 - DNA, 1044 bp, Homo sapiens
taaattttgtatgatagactccaatgatgttttagtagattagcaatctttatcttgcctaggcattttacaatgatgatatgtggcgtatgtgtgtgtgcttgtgcaggtgtacacatgatattgctttagaaaaagttgcctaattttctcccgtttgtctgttgttttttctcccacttcttagcatcattcacggttatgtgttacaatgtgttatgtgataaatacgctacccggcagctatatggctattgcccatcctgggcattaaactgggaatacaggaaaaagggaattatggaagaaattgttaactgtgacgcagatatcattagtcttcaggtaacaccatagaaattaaactgtctttaacttaaaaggtgaacttaaacataagagaagatctgaccactgggagagatcctgtgtttagagccaaagctcaaaaagaattgttttctctcctcttaaaaataatggacaatttaaataagcatttaagacatttccatagtgaaactattttgctgactgaatacaaccacctacttatatttatttactgttttcttaagtggaaataatcttacccgttcatgttaatattcacctcatgatcattggtattgctgaaagagaaaaccacagaagattgccagtcttttaggaatataaatttaccttgtattggagtctgtttttttttaaaaaaaaaagcttgcccacagttattccttaaacagacatattttaatatattgtactataaatcatgcatatttgccttaccttactttataaaccatctctgaaatttagattcttctgttttatagcactttataaattgaactttactgaagaagcagcatcttttcatgaaatgtgttctgttgcttcaaaatttagctaatgattagccaaaaagatgtttgaatagtttttagtaacttttttcttagcaactttcaaaacatattaagtgcttaaaggtttaaaaatttttaattgacaaataattgtatatgtttatggggtaca

SEQ ID NO: 111888 - DNA, 1938 bp, Homo sapiens
ccagagcagcttcctccgaggccatggattacattaaaagaacgagaccaaattctgccgtcaggtaaatagtttttcttattcttccttttttttcagaaattcttaaaatgttatttgggcttcatgatctgtaataaataagacttcatttttacctttcatgggtagatgcatttaaaaatactgatggatagacttttaaaaagtccacattaagatagacctgtcaataggtgtcttatatctttcacagtaatgcagcccttggttttaaaattatttctgtaatacagctttccaaatagcatcttcatagagagtattgggtgatttaagatttaagtaatgcagcccttggttttaaaattatttctataatacagctttccaaatggcatcttcatagagagtattgggtgatttaagaaaaatgagaacaatgatatttcttgtgaaaaattttaaactactgagaagtacttgatctttcttgagagatagataacatttatggaagaataatgtagactagacatatatttactatactggcaacaaagtataataccagcccaggggtgtagaagtagtacatagtatttgagcaatataaggatataatctagcatttctagaactgaagtaatgtagaaaacataagcctttatctgtttgcagggaccaataatggtttgacatttataaagcttcttcatatttgacattttaggcttgggaattctacttaaaataagttatgaattaccgtttttcgaaatgtcttttttttaatcacaagagtaataattttcatgatatctaatttcattttaaaattaaatgaaaattctaagtgtttggatatgaagattaaaccagtcacagaatagtactacattaatagattttggctgggcactgtggctcatgcctgtaatcccagcacattgggaggccaaggcgggcagatctgttgaggccaggagttcaagattagcttggccagcatggtgaaaccccatctctactaaaaacacaaaaattagccaggtcgtggtagcgcactcctgtaatcccagctacttaggaggctgaggcacgagaatcgcttgaacctgggatgcggagtttacatacagtgagccaagattttgccattgcactccagcctaggagacagagcaagaccctgtctcaaaaaaagagatagttaatttttaaagggtaaatcacaattagactttatatatattttgagcaatataaaggccttttgtttgtgagttttgggctttttttaagttaagaggattcagaacaagtcttttttttttttagtatttggaaatgtgggatatatagcctcttcatggttctatttgcattttaataacactacaaaatattataatatgcagtacatttttgtgtctttcagaggtaataattttaaaaccaacccactctagagctgcaatatcagcttgttttaagaggcattgtgtcagtgttatgaataacatttttactatcaggttgcatgttggtgtttaagtgaaaggagtacctaaggttttctacaaaacttaaagctagatagatttattttatacttggcctttcctagtgtataattaattattcccttctgatgttaaaaacaccattttctaattcttcatagtaatcccttttgaatatgagtgaacataatcttgaagaaaagattttctaatattgcacagctacatttctattaagaaaaggaacaatagaaacaaattttcattaattgctgaattctcaaagtaatctgttcttgggttttctttattgaaaaactagtgtggacttttcttgtgaggtatggtgcttctctgagtaggatctgagtgctgaaaaaaagttactgttaaaaatgcattttacttctga

SEQ ID NO: 111889 - DNA, 1033 bp, Homo sapiens
ggtaacacattttcttcttacttgaaatacgtttgttttccctatatgtaatataaatattctacgaagacccttcttttttaagatatcactcattctttctcctatatggctatttgagtttgtctgtggtcttaaaagataaatgcaggttttcaaagattaatgtagaacctataggattacttcaaggtgccaggttgtgatattacttcagaattgactatgattaatatatatgcttttatgtatatgtgtatatatgttttggacaagcccaaattttagagttcttaaagaaaatatttatttacacatacatttttaaatgtatataatagattaaatatagtagaattcaatttaagaaattgaatttaagaaattagtattttattttatagtatacatttctgtcttgccttgcagttataagttttaaaggttttatttttgtcttctgctttaggcaatcctttatcacaggatattctcaacttataccaggacccagatggaacccgaaagctactgaacttcatgcttgacaatctcgcaggtaactgttagtgacaaagctgtaaaataaattctacagatattatgaactagctaatatatgttcctcaagagcatctgactgttttttataattgcctatgggtttggagttccttccattgtatatcctacgttagtggaacattcttcttttcatatactgaatgttttctatttaccaagcaatatgttaggagattagttgcattattttgtttaagaacctaggacataggaactttaactcacagtttagagatgcaaattctgagattcagagactaaagtaatttatttatacatagctaatcagtgccagagctgtgaatctaagattatcttgctcttaatcacaaaaatacacagttattagttgtttgcatttgatgcaaatgacttggaacccacacattttacacatttttaatgaatgaaatgactagtttgattcattacacgtttgtggaaattt

SEQ ID NO: 111890 - DNA, 1030 bp, Homo sapiens
tagggattctttaaaaattccctaaagaaattctaaaaaaattttgcaggaatcttaagatcttatctaaatgtttccaatgattatctgttgagtaataatttttaaaaattgctatcacgtgtttaaacatattgttttaaaatcttgttcttcactatcctttacttgctttttttacttttggtcatccactaatgaggatgctatttttttcctataggctgctcaaaatttcacaatcataaagttagatcttatttatgctatcctattcttgtctgtactatctatgctttattttaatatttatgtttcatgtcagtgattgttgatcatagtatattttttcatcttttcacattttcttttgtcttctttaatatacttcacctgttgtttcttattctttttatttttattaaatttttggtttgttttcttagtattttgatgtgattagagtagtattcagttacttaaaaagagataccggtgattggctactaattacagtttattcctgaagtttgtgtaaaaatttgtacttttttctattaattagacgagtttcaaggatatctgttgtttagctgctaaggatatctgtcgcatttgcatttgataggcattttgggtgagaaaaaagggggtagatttagcctgagaatgatatgcagttcctacacctccaactttaatgtgagctagcaaatgagtaaatcctagaaatagaaccattgttaatagttgtggcaattgcacattttgtagtacttttatattgtgcaatgtttttggatgagcacatagaaatgtgccttgaatataaacaatcactcatagtatgttagaaggagccttaagaatggcaaatacagatgttaataaaacttagtatattaaactaattttttttttttttttaaaacagggaattgcttttaaataacaatctgttacgggttttgccttatgaacttggtcggctcttccagctacaaactctaggtttgaaaggtaagtgatt

SEQ ID NO: 111891 - DNA, 2486 bp, Homo sapiens
ttattgaaagcatgcaggagtttaatttaggctcaggacattgtgtcatttgctattcttgttagatatgaactggattttattttttgtctagtaccaagcagtacttcttatattggaccccttgaataaggttacctttagagccatttgtcacctacttcatacatagcacatttgatgagttttatgtctagctggtcatcattgatgattgttcagtgattattttggcagttatagcaggaagatggcacagtatagttatgtgctgcataacaacgtttggattgcctaacaatgcatttctcagaacatgtctttgttaaaccacacatgactgtgctagttttgattagggtggccatgtaactcatccaaattggactcttttgagcatgaaaagggatgataataataattgcttcagaacaacagatataaaccaagactgacccaggcaaactaagatatgtactcatactaattaggacacttttgattactagtaacagaaaacacaattcaaagtagcttaaacagtaagagaactatattggcttgtgtatcagaaaaggccagtatttgggtgtgctacaggtgtcattcagtgaggaccctgcctttgtttttctgttttccagactctgccttccatggctgactttccttatcgttgttgcgtggctgccagcagcaatttgggctgtattcttctttgtttatgaccagcaggagagagaagcctgcttctcctataaacatagaatgagttctgcggttttgtgattattagatactcctgaactaaatctctgcaaggggaatgtcatgtgctgattgtcttaggcatgggatatctgaatatcactgaggaaaggaggatagaattaccttattctcttagactagtcagagtccattcacgaaactgctgtgtgggaaagcagtgcagctaaatgaagggaaggagttaggaagcaaccataatgttcattgcaaagtccagtgctgttgcttatttgcattttcccttaggcatctgataatgagttcctgcaagatcctagcatactgcagataatgtgtgtgttttctttttctgcaagtgagaatttgtagtataaaatgacttactagactggtaatgggagagaaaaggagtttaccatcctattttctctttttttaaagtaagactataataattattgatctcctcctttttttttttaaacagactaatagggatgccaaaggaaaaatatgatcctccagatcctcgcagaatttataccatcatgtcagcagaggaggtagccaatgggaaaaaatctcactgggcagaattagaaatctcgggtgagtggaatctgaagcatttaatctggaatgtaatagtgataatacaaaagttgagtattgctatattttttgttgtacatttttaattagatggactcattgaaaaactacaagatggtaagatactagtgttttctgttttatgtgtgactgaatatctttgtttccattttttgagattaattacattgagcaagcatctggaattgaggatatggggagtttagtttctaagtaaaaccagtttctttgatataatagattttgtttaggctatttcagagtaattatttttgcaaattgaaatctttgccatcctcctatctcagtgtcggcaaagaaggaaacctggaagctatttattctaataaatatataataactgtgttacaggaccttaatacctgtttaggatttggtaaaatagaatgtgattcctaaaaactcataattccagtctaataatgagaaaaacatcagacaaactcaagctaaaggaccttgtgcaaaatacctaacttgattaatactcaaaattgtcatggtcatgtaaaacaaaggctgaaactgtcacagaccagaggagactgaggagaggtaactaaatgcaaaatggtagcctgcgttgaatctggaacaaaaaggtataaaaactggtgaaatccaagtaaagtctagagtttaattagtagtaatgcaccagtgttggtttcctagttttgacaaatgtaccatggtgatgatgtagattctaatgttagggaagctgaaggaggggtatataggaactctctgtgttatcttggtaacttttctgtaaatctaaaattattacaaaatttaaagttattaaaaatagaatataagtatttttcttttatgaattggtataatacagattatatataaaatgccattttttccccagtaggcattcatttggaagagttaaaccccacattgtaatgtcaatagcaagaattacttgcacatttagctaaaaggtaactgggtggatggatgattggtagtcaaaagaatgaatatgagcagatcttactaagttaatctagggtttcttagccttggcactactgacactttgagctggataatagtgg

SEQ ID NO: 111892 - DNA, 1023 bp, Homo sapiens
tattgctcattatcaatattgcagagactttgttccagtttcttgtttgttttttgactttgtttatgactttgctctttgccttatagacattaaatttttaaaatactgtttatcattccttataaaaggtctttgccttgcttagaataagttttctgcaccccaagattataaaatattttctccgcattttcttctgggaatgtctaaaatttggcatgatttagtagaagcttggtttttgtagttggtcttaactatgttcagattcccgtctagccacttactagctgtgaggtgttagatgtctgcacaacttctctgtatctcaccttcctcatctgtaaaatgatagttgataattagggtctatgcttttggttaagttaaatgcaataattcaaattctctagcataccatctggccacatactgggtgttcagtgcatgttttcttttctctctcacccataaactccatcttctatcagtctagttaaaatctggtccagaagataagggaggggaaagtttcaagaaataatgttgcccttagttttcaaagtcagagaagccatgtgggatgagtactgtctgaaaaggagattgaaaattcatttagtaattaggaagtaatttatgtttaatgaaaacattttttagtagcatgataagaggcatattttaatacaaagaagactaaaacctatataacatacctaaaggatatgtgcatatgcaacatgtatccatcatgatttgtaatatttgggagaaatagttgtaactctactcttcttattgttggaatactggtaagaggatagagaatcaatgctgacatacagtatatttatattgtatgtataaggtgtacataaatttaggtaatttttactattaatagttacaaattactgtatttgtaacacacctcacaatcatcaacctgtattagaactactgctccattggaatcttcttagtagcattataatggactttaatggaatttacaca

SEQ ID NO: 111893 - DNA, 1085 bp, Homo sapiens
tgtgtctgcttttttcacttagcataatattttcaagattcatgttgtagcatataacagtatttcattcctttttttttttttttgagatggggtcttgctgcatcacccaggctggagtgcagtggcacgataccggttcaccacagcctccgcctcccaggttcaagcagttctcctgcctaagcctcctgagtagctgggattacaggagcccaccaccacgcctggctcattttttgtatttttagtagagacggtgtttcaccatgttggccaggctggtctcaaactcctgacttcaggtgatctgcccaccttggcctcccaaagtgctgggattacaggcatgaaccactgtgcccggccaatatttcattcctttttatgagtgaacaatatattattatacatacttggttattataaataattcatgtatatggttttgtgaagacgtatgttttcatttctcttgggtgtatacctaagagtggaattgctgggtcatacgtatttctgtgttttaactttttgaggaattgacaaacttttccacagtagcagcgctgttttacatttccacacctcacgcttttttcttttttttttgagacggaatttcgctcttgttgacaggctggagtgcaatagcatgatctcggctcactgcagccttggcctcccgggttcaagcgattctcctgcctcagcctcccgagtagctgggattactggcatgtgccaccacacccggctaattttgtatttttggtggagatggggtttctccatgttggtcaggctggtcttgaactgccgttctcaggttatctacctgcctcggcctctcaaagtgatgggattataggcatgagcaaccgcacctgccctacctcctgctttttaatggcttcattgtaatccattttattgatgtcctgtcattcagtcccctgttgattgacaatttatttctgtatttttgatgattatcaacactaatgcagtgaaaaaacttgtataaacaccttttgcacacttttttaaagtataaatttttaggaaaggaattgctggatcaa

SEQ ID NO: 111894 - DNA, 1036 bp, Homo sapiens
gccatgctggaatgcagtggcgcgatctcggctcactgcaacctctgactccctggttcaagcgattctcctgcctcagcctcccgagtagctgggattacaggcacacaccaccatgcccagctaaccaaggcaggcggatcaccaggtcaggagatcgagaccatcctggccaacatggtgaaatcccctctctattaaaaatacaaaagattgtgaggtttttaagggcatagatgatatatgccttacctttgtagctcaagtgtttgatacatagtaggggcttaatacagagtttggcatatagttgggaatttgaaagtgtttattaaatgaatgaataattaaatggcattacagacatggaaatcatatcagcagatctatagttgcagaaaaatgagtccaggttcaggggtggtggtgagtgggaaagtaagtaaatttctggttaacttctagggctcgagtgggaacatgaggttaataaggcaaattggagaatgatcgtggaggggcttgaatatcttggtaaggaattttaattttgttctggagtcattgatacaaagctttcaactctagagcagcaggtgttttttaaatccataacttgggttctcttaatacacaaattgtatgttgtaatattgctttaggtattttatagaacattcattacctaaacaattgttttgattaatagatactgcaagatgtagctctagaatatcataattatcagtactactattaaagacattgggaaccatggaatgattttgaacaggttggtggcagtttgaaattaatctttttttttttttgagacagagttttgctcttgttgcctaggctggagtgcagtggcacgatcttggttcactgcaacctccgcctcccaggttcaagcgattctcctgtctcagcctcctgagtacctgggattacaggcatgcgccaccacgcccggctaattttgtatttttagtagagatggggtttctccatgttggtcaggctggtctcgaac

SEQ ID NO: 111895 - DNA, 1014 bp, Homo sapiens
attcatcttttgcagagagaacctccctctctaatcttaaagtttaaactctatttttctctttcccatattacttaaatagatttcctaaatgagtaacataaattagagttacataataccagctacaaatactgctaaaagaatagaactaaatttagtatatcccaaccttaatgtctctctatacaaagactttgttggaatctcatatatccattgctttctgatcataatgtttatcatatttaacaaagcaaaactcagaaattacttaacagggtatattcttctataggttcatatttagtacaatcttctgcaatatctacatataattttatgaaacaacataatgtgagttatatacagaatggtagccttgaaacactgtcagaatttgaatcaccaaaatataacctgttaattaatatttattaagcttctatttgttatagactattgtattcagggttctggggaataaaaagaaatgtagaataatctttctaccagggaatggagctaatatttttttgactactgagtaccaaggaatgtgaaaagccactcccctccttccctttaaatgtgtaatctaaattattcttcatgaaaatcctatgagagaggcagtatgattctcattctgaagctggttaagaaagtgagccttgggtcctccactttccagctctacggaaactcatttaacttctctatgcttcagttttctcatctgtaatagggagataatattccttatctcgtagagttttgtgaggattaaatgatgtagtcctgtaaagtatttaggacactacctggcacatctgtagtaaaaaaccaaactaaaaaacaatacacgtacactattactgtttcttattaggaaagaagttaattaacgtgcccaagattacaaccagatctatttgaatttaaaacactcttatactataatgcttacatttataggatgtttaagtctggatctagtaaacaggtgaaggc

SEQ ID NO: 111896 - DNA, 1195 bp, Homo sapiens
ggctcccgagcctcgcaggtgagagctgctcctagggggccggccggggagggctgagtgagtgcggcacacgcgcggcagcggggctgggagagctgctggtcggtgccgcgccgctgatcccggggccgccgttccccggccgcggcaggaagcgcgccggcctgcagcgcggcctaactgcctgggcgcccgcccacctccccggacgcctcccgggacggcgagcccgcgcgagcccacggcgctgcctcgggcctgggcaggtgagggtcggaggcgggactcgccgattgccgtcgccgtggccgcctccgcgtctcctgagaggcgaaggcttattttggcgttccaactgcaagccttcgcccggccggctgtgggacccgagggaggaaagtgaatcagaacagtcagtcttgggaatacgcggtgtcgtgttcccttcttttcatccttcccctaaggctgtgtggagggactgagtaaatattttggatttttgttgcaaatactttgccgttggtaagatttttttttttttaattagacaaacattttcttggaagggctgaggaagaaagggaaactggctttcctggcctgtgggattggatggattttgtgcatttgaaattgttttatcctgcctcctagggggagaggcgtgtacgcgccgccgagctgaggagctgggtgaggaagaggaagttactggagctgtcatcctgcttaactcggtcggctattgagcttagactgtttaggtggattgtgttcagggagtttagctgagccgtttgtacacattggaagcacagtgttacattttaccgtattgcctctagttatcttgtcaatcaagataggctcaacaaacatgttttcctcagtctccaaaaactagatcaagcaacctctgttgtctactcagtatgtgctgctggaaagctattttgagaatagcctaagcaaaacccagttgtaaagataaacctgctgccaataggtctacagtacatttcagaaccaaatacaaatggcatttggataattatttgctaatgtgcttttctactccaacctcattacatttgtatgtagttagatcatttagctagaaccgtgctgtggataaaagcataatacagtttcgatccttgtaggccgtactctgtgtcatggccagagattg

SEQ ID NO: 111897 - DNA, 1028 bp, Homo sapiens
cttacagtaagtgtggttaaattaaccagcaaattctcttttagatctaatctgagttagatctctccaaaacatctgaactaataagttgtgtttctgtattattattctttcaaagaaggctaatggctgctaaaataagtttggtaatcactgaactaaatgataataaagcattattattggttgaagcatttttaaaaagaggtaccccgtttgtggagatgaattaggatatgtttccctctgggtgcatgcagtctatcaaagcacagtccccactaaccttttgcctagatgtctctatccagcatgcaaactgaacaagcatatgacattatgctataattacctgtatgtgtacacatctgtctttcacatcctagattgcaaattctgtctttatctctagtacatcatagaatttctgatacagaattcacaaggaacaattgcttaattaattaatgatagcaattctcaaatcatatcatgtagtcttaactttacaagcaattagctgctagtaaaataaatcagaaataacagtaacaaaataaatgttatttttctctcacataaaggaagtctggaagtagtcaatgcagggctgatatggcacatccatggtcagcaaggaccaggctgcttttctccttgggtttgctatctttagagcatggcttcctttcctgcttcatagtccaatatggctgtccaggccaccccatacagttgtgtagtttatttactgtgaagacacctgaccaagaagtgagtgggggctgtgtattctgagggattccttctacccagaggaggaaattttctaactcatctgcaaagatgggggattcttcctattctgttcaaaggcaccaaaaacattaacagagatgccatgactatcatgattccagctatcccactcattttcctggcagaacaaaaattaaccacacccctaaacactttcctggaagactcacccaaaaaatacttgcttagatttcactgaccagaagcaa

SEQ ID NO: 111898 - DNA, 1096 bp, Homo sapiens
tgtatttttagtagagacggggtttcaccctgttggccagtctggtctcgaactcctgacctcaggtgatccgcctgccttggcctcccaaagtgctgggattacaggcgttagccaccacacctggcctgacaatgggtttttttcttgcttatgtcagatatctgaatgcgagatatgttgtgtagggactgaagtaaataatatttacgcctgcaaacaggcatgccccttcatctgtcagagcattgagtcaatcttgtcaggagttgagctaggttttggttttgttgttgccatggttaccatcagcttcaaatttctgtagttaccttgttcttagggtgggggctgggttgctggagggtttttctcagcgttcctgttcatgctcaattttctgcattccctgtgcagctgtgtttcagtggcagtgatggggtggggtggggtgggtcactcttttgcacccttccctagcagtagacttctattcctggtgatgggtgttgggagggattttttttttttttttttttaaataaatgcagccctagtcttaagtaggcccagtgcagctggaccttggggttggggttttctcagcatttctgttccttctcttcatggcaccacttatctgttgcatgtcttatggggaagtttcctagcccttccctagctggattggtacaggatactgggctctggactatttcctgccctgctctcagtgggtagaagtgttgtaggtttttatcttctttctcccttccatcgttagacacagtgcgtgtttacctgtgccttttcctgtgtgcctgcaactggctggggggtggggggacggcgcgcttctaatcttctgctttgctccagtctttcctgggagcacctggtgggaggtatgtggaaaatggcctgtgaattgagtgtgaactccccgtatgcctgggtctcccaagaggtttatactgtcacactagccctaaaattgtagctggttgtttcttacctgcttgcctttctctcgtgctctggcgcaagggagactgtggtgggaactggagtgtgggactgactgtccttggatttc

SEQ ID NO: 111899 - DNA, 1061 bp, Homo sapiens
ttgactttgaggtcatttcctctataacttttccctagcctcctaggctggattgaatgtcttttctgtcaggctctgatgatgctcttgtattactacattatattgaaatgacctgttagtatgtctttctgatctactcctctgtaagtttctggagagcagcatcagtgcggtaattcaacttattcatgacttcagacattggaaaagttcacttcatgtttgttgaattagaaaaactgtaaagcagtctatgcttttgaattaaaatataattcatcctttgtttttttttctcttatgtacactggctttttttttaaaaaaaatctcttaggatatatattgatataactcaactttattttcttttaaggtctgcaaagaaaacaaaaaaaggtgctaaagaaaaaacaccagatgagaaaaaagatgaaatagaaaaaataaaagcatatccctatatggaaggcgaacctgaggatgatgtctatttaaaacgcttatacccgagacagatatatgaggtggagaaagctgttcacttacttaagaaatttcaaattcttgactttactagtccaaagcaaagtgtttatcttgatttgacactggatatggcactgggaaagaaggtatgtagagtccattaaaataagtttacctgtgaacagtggctgtatgaattggtgtttctttattttattttattgttattattatttttgagacagggtcttcttgccgtgttgcccaggctggagtgcggtggtatgatctcagctcactgcagactccacctcccgggctcaggtgatcctgccacctcagcttcctgagtagctgggactacaggtgtgttctaccacgcccagctaatttttgtacttttagtacagatgaggtttccccattttgcccaggctggttttgaactctggggctcaagcactctgcgctccttggcctcccaaagtgctgggattacatgcatgagccactgtgcctggcctcttaattttaaaaattattgcctctcataatttttagaaaacttc

SEQ ID NO: 111900 - DNA, 1096 bp, Homo sapiens
atattaattagctctctttgactgtggggagtggtacccctacattgaaatagaagagaataatgggaaatgatgttggaaaggtagattgatgccgtattgagaagaactttgaatgatgggctaatgagcatgaacatctgcattctatattcagcaggactcagaagtttttgagatgggagtgacataatctgttctttagagctttaatctggcaagaggtttttaagataattgaaactagagacagggaaaccagttcaggtacaatggcaagagactaataaatgtaatgtttaagctaaggtcttcataacgagactggagtgaaatgtataaatgtcaaggatattaggacttagcaattaattgggaatggagaggttgagggggagaaaaggaagagtcaaatgatactgaggttttttaagtctagagaactctcctaataagtgttatcattaatggaaacagggagtacaattgggaggaaaaacaagttcacttgctgacacagtttgttttagatagtgctggatgtctggtatattattatttcaaataaaattttgtagtgtaaacagaacaaatattttaaaattgtgttagtagatttgtcttcaaattttaactctagttgagctaaaaaaattctgctaaaatttttatatatcctagccactaacaacttgtctgaattctagatcatgacctgtaaattaaattcaaatggactttccagttcttttgttgtgttagagttttgtttatttttgatagcatgcattaagtcataaatatttattagattttgaactggtgtctggcactttttattagggatttcccttacagcagtgttcattatggagtccagtttatattctttcttaagtaagacctaaaactgaacatattttaaaaattaaaccagaattgcagttgaatttgatgaaaatatttctcataacttttttgttcttaattaaattcaagctcaaatcagagcaaaacaaacagtactaaatacagtaaaaaccaaaaatgaatactaatatgtttgtattctagatatctagctccttgctttgca

SEQ ID NO: 111901 - DNA, 1004 bp, Homo sapiens
tactgaggattgaaaaataaactgaaaagacattttctgtctttaagaagataaacactgaggagagagagatgagagcaaactgctgcactaaaatgcaataagtttattggtagaaaatgtacaaagtattgtagaggaatgagggactgctttgtagaatgagattatataaagaagactgcagttgagaggttaagcatgaataggcatttgctttccttacatgaatcaggcagaggaaatggccattttacatatacaaaagtatgagagagccagtagtgttcaagaaattataagcagctttctatcatttggtatataaaatgttatcagatactggtggtcaatgggattggacagtgatagacagtgggctaggtcacagcaggctttgtgtgctataccatggagattagattttatcctctttgcaaataggagccattgaaaactttagctcagaagaatgatgtaagatttgcttatcagaatgagtattgtgagaactgtataagtggtagggtagccatatgaggatggtgaaactttaagaacagagaccagcgaggaggcgattacagtaatccaggtaaaagatgaagaaggaaagagtctggtagtggcagtgaagacagatgaggaaagatgttgttggatattaagaattagaattaacaggagttattgattaaatgtagggggtaagggagggggaaggatctagaatgatttcctaattttggtcttgagtagcctagtaaatactattttaactataaatgcacaggaagtaaagcagatttgggtatgacaataatatcacaaggtgaaggggtcaaggaggtagataagctggcgcaactttattttgtattaacatgaagcattaacagtattaatatgaagtaggttgtggttagtatgcacattgtgctccctagagcaagtaaaacatactcacacaaataaatatagcttaaaactataaatagaggaat

SEQ ID NO: 111902 - DNA, 1377 bp, Homo sapiens
gcagctcacagcattgcagcttgtttcttcaaagccagtaaggaagatagtcttcttcaagacaggcattatagctttatgtaatgtaattatgtacacatgattattctgtctcttggtttgaagcaagttgcaagtttcattcacactcaatgaatgtgaacaccaggaaacagagctctttggaactaaagtttatctgccacaatttatttgctatatctttacatgagatatgtgtttcttttattcagtaatttttactacttatttggagtgataattgtggattttactttttctaactagattccattggccgtgacatccccaaaatgcttgaattatttaaaaatggacatgaaattaaggtagatgaagaaagggagaactttctccagaccaaaatagcaacagtaagttacaatgaaaattatcaaataatcctctttttttgttgttcaagtattcttcagtaatttataatattataaaatgccagtcatttgaacttgtttttggcactagcattaagaatggcattaaacatacgcatagatactttttttattctataaattaaactcataaattttaatggtacttgagaatttcttccagagttatgtgctactctcacatttacttgtactttgccttatttatctgttgtatgtatacacttttgtatttatgtattatattttaagcttattgagaatagggtttagattttgtatgtccccctaatcaagattgcataatgctgagcacatagtaggtgttcaatactactttagtggaattgagtaatttgctttattttaatgaattatgtccaattttctctgctagtgtttttaaaattgtttgcctgcttttagaagatgctggaaatcagtttccaaagccatttttaggatactaatgtagatatgccacatttctaggactgtgttttaaaatatattgtcattacaaacattaaagttatttatactaaagaatctctaaagtgcctatccaacatatgtaatttttttcttgttcatttactataggaataacagtaattgataaattgatagcaaaatttaaacaggacctaccaagtgtcagttgctattctaaacaatttttgtatattctgtcttttaattgttagccatatgagaggtaaaatgatcacccctgtcttatagatgaaggcatgcaagcccagagaagttaagtaacttttccaaggtctcacagctactatgaggcagaataagcatttgaactttggcagtttcctcaagtccaggctctttatccctataccatcttgcctcatgactggaattatttgaatagctattattctttctctttgcc

SEQ ID NO: 111903 - DNA, 1610 bp, Homo sapiens
aagtaaagaaaaagctgggtgctatgttgcccaggctggcctcaaactcctatgctgaaataatcctcccttagccttctgggtagatgggactacagatgtatgccaccatgctaggcttctcagctagttttatggtcaaaaaacaaaaaaacttgctttagaaatggagcaaagcaggtttaatctagttggggaaaccccagcttgccatcattatcatcaaagctcagctccaatttatttggcactgagctctgctccagtctaatgttggaatttccttgttccccaaaaggcctttgacagtacttcttgtttcttagggttgacaacattgtaattgaaaaaccaaacaaatgaaacataaaatacaaattttaagagtctattctgaagttgtagagacttgagtttgaatacctaccttttcagctacttcagagatggcagattttaaggaagtttcttaatgttgttgtgtctcaaatttcctcatctataaaatgtgtataatagtacttctttcactatgtggttttgaagattacataaaattttaaaatggtaacatctattgttattgttttggttggccttttgggactgtggaatatccttataaggctctttttagctggattaaatctgtcttaagtaatgttttcagtatatttagtagttaatagtttatgtagatcctgactcagaatataagaaaccatgacatcgcattcatttctttcaacaaataccatagtgattaagacataggtcttaatcactaagtagtagatcactaagtagtagatcagaggagatataatttcttaatgaaaaagaaattatgtgtttaaagagtttttttttgaacacttagtattgcagtatagaaggatgttgagagtgggttttagattcctgttgtcttgattcaaacccttgttccagctagaaagagctgtacccccttgctctctgagcctcaatttttccccatttcccatttctcctgtatataaaatcatggtaataatatgtaccttctaagctaggaaggaatagatgagataataacataataaccatttagcagagtacttctggataagggggagtaacagggacctaatttatcctcctacctaaaacagtcagcattatttgataccaaaaccagacaaagaaaaccacaatgcagtatcattcgtgaacatagatgtaacaattgcaaactaaattttagcaaatagaatccagcaatatataaaaagggtaacatatcatgctcaagtagggtttattctaggaatgcaaggttagtttaacattcaacaattaatcattacagttcaccatattaagaaagtaaaaaacaaaagccatatgagcattgcagtggatgcagagaaagcatctgacagaatccaacatctgtttctgattaaaaagtctcagcaaactaggaatagaagtccatgtccttaacctgaaaagagtgtctaagaaaagtcaaagctgacatcatatttagtggtgaaacactgaatgttgcatttctcctaagatcaggaacaagacaaggacatccgtctcaccactgcttcttt

SEQ ID NO: 111904 - DNA, 1048 bp, Homo sapiens
tctaactaaaaaatctttggggattaataaagttaggtaaaagttggaaataaaaacagatttgcataggtaatgcacactggaactttaaagaagtgcaatgtactatgaaagtgacttagttttttatctttttaagaataattttggtgtctttataagtgctttgctatcattgtagcaacttggtagaatttgccacattttgtaaaacatgtttggtcttcaaaagtatgtttagttaaagattgctatattttcaatcaacttctgctttttttcatttcaaagtaattcctttcaagtgtacctgtatatacaaatgaagccttttaaaatgacttactctaatattttttgacaaatcataaaataaggaattttgatattttatcttagaacattggagactccttgggttcatagcgtttttcaaaagaaaatctaaagagaaattaatccatattcatacatttcaggtaagaaagtaaggaaatgaaacatcacacattgtcttgagatctgttgcttcatacagccgtagctctagtaagctctttcccaaaaaagggaaaactgctgagcagagagactataggaacctgcatgtgggatcacctgaggtttgcttcttgagtggcaaaagttgaaatacaaacacaggaagtctggcttctgctaattagcacatacttttatgtcccgaacaaattctcttcttcttctaaaggaagaagggtgattttgcttttattccctctatagtacccttctcccttccattcatcctttttttttgagacagtgtcttatttactctgtcccccacaatggagtgcaagtggcacgaacttgactcactgcaaccttcacctctttgtttcaactgattcttgtgtctcagcctcctgagtaggtggggattacaggcgcctggcaccacatccagctaattttttgtatttttagtagagatggggtttcaccaggttggccatgctagtctcctggcttcaagtgatctgcccacggtcgcctcccaaagtgt

SEQ ID NO: 111905 - DNA, 1014 bp, Homo sapiens
ctagtaaaagttaaaaaacttttcagtggttctacatgtgctggcatctcctttaataactctctgtccctttattactattttctatgacaaagtacacatgtacacacattctgaatgcctgccgagtggcaaaaactgttcctaactatggggatatattgttgtccagaagttcttgccctcaactagatcactttctagttagggtatagataatatacaaataaatatatatgtacttatgatggtggagtgtgtgtatgtgtggctattatagaaaggttggtcagggaaggcctgcctctctaaattggaggtaacatttgaatagagactgaatgaaataagagaacaagttatgaagatatctgagagaaaagtattcttgagacaggaggcagcaagtacaaaggctctgagaaaaaaaggggattgagcttttataggaacaagaggtatttcttctgggtgttagaaaaggctaaaatatctttgaagaaaaacatgctcaaaaagttctgagaaaagtattaaatacacaaaggaaactactttgatacaggaggacatagaattacatattttactgacaatacattcctgaatatctttacataatagcaatcttaacttgcttttatttgaatagaaaagcctttcgtgcagagtttttttttttttttaacatcaggaaacccttatgaggctaacaatagacttcaagattctgtgaacttcctgaaattttatgcagagtactgtgtgtacgtgcatgtgtacatttttcttgggtgagtggttgtgttttccatcaggaattcatgactcattcgttgagcaaatagttattgggtacctactatatgccaggcgttactctagataatggggttatatacatcaacaaagtagacaacaatccttgccttcatgggatagacgtgtagatggtataaaggtagatatctgttgatagaagatgaatggtagaaaataagtaaaaaaaagaaa

SEQ ID NO: 111906 - DNA, 1070 bp, Homo sapiens
acacttgaaaataacatgtgttctgagaattctaggtaaagatagtggtttgaacaccacagtggtaacttattagaaaattccaactcttaaatcagcaatggcaaaagccaaacacaatctaaaccttagtatctttaaaagacttaaaatggggctctagatacctctggaactgcatgttagtggtgagcttggggatgggacaggaggaatctgaaaaagggaatttttttatccttactttatcatgctgggtaactgccctttccttgccagcacatgactggagagattaaaatatagggtctctacactgggggagatcaggagttgaaactgaaaataaggagattaagtgaatatatcaatattgaatgctgagaaactccccttaccctccaccaccatttctcttccttgatttagctcccagaactctggcagccaggcctcaccctctaggcaggagataagaagaggtttagttcaaggatctaatgatagtaaggcttttgacccagctttacaattttttccttcccattttgaacattcatggtggctttcctctctctttccatttctggataaagagatacttggtcatttctggtactttgtgagaactatttgacatgatttaagaatcattcttatagtttttttcttttttacttttttttttttttgagacagagtctcactctgttgctcaagctggagtgcagtggtgcgatcttggctcaccgcaacctctgcctcctgggttcaggtgattctcttgcctcagtctcctgtttagctgggaccacaggcgcatgccaccgtgcccagctaatttttgtatttttagtagagacggggcttcgtcatgttggccagtctggtcttgaactcctggcctcaagtgatccacctgccttggcctcctaaagtgctgggatttcgggcgtgagctgcctcatctggcctataacttgtttttgatgcttgttttcaggtttctcttctgtcttcctctctcccatgttctctttaccttttttttcttttaatagctctttgaa

SEQ ID NO: 111907 - DNA, 1051 bp, Homo sapiens
attactatagtattttaataatatttaattcaaatataaaatcttgattatttggaatgaggaaaaatgataaaaatttcactaagtacaattgaaatgatgaaaaacctctttaaagtacaatatataaatgcatttatatgatagcctaggagattaggcattaagttaaaacattaaagaaaaaaactatagccatattacaatcatgtaaatatccagatcttgagaacatgtaaataataatgctattggcaaatccaatctaagcttgttttctagagagaagaaaagagtaagacaactcagagttatatttataccaaatcatgtcaaggcctgatttaacaagtatttcttgtctggatttcaaatatatttggagctttgacatacttaatataaaagcaaagcctttgatatgttctttgtttttcttctttttaaagtgtagacatggtccaattataggtgagtatcattttgtgtgcttgtgtaacagtgaatggttttgtggcaagcgtattgtcaacctggcagctgataaaagctgaagcatattgtaacaaaaataaacaagttcaggacaagggactataaacaatagtaaaatcttatgttgaaattagagagcctttggttttagtgaacatgttagaacaggaaaagtgaatgttctggagttcagccaaacagcaagatgtggatagtataagacatggaaattaaatgcttattttgaagcaactgggtccataggttgaaatagtagctagccaggaatattgcttacatctacaaacaataactggataaaaggaagcagcccattggttcatggctcactgccacttcccttcctccttttcccttattccttctagttaataattaacttttcttttgttgcattatttttggtgtactatagtgtactgtgtcataaataagggaattataaagagaggaaaataaactttagaatgtaaagtagaggaagtaggctggcaatagatcttagatctccaaggatatggagctaagaaagagg

SEQ ID NO: 111908 - DNA, 1034 bp, Homo sapiens
tctatgatttcttttacaccagaacagcagaaatggaagaattgtgacagaggccatttggcctgcaaagcctaaaatatttactgccttaccatttacaaagaaagtatgccaactcctgtttcatactcttctagaattctttctaaaacatagatcagatataccatttatctgcttagaaacatcaaatggcttttcactgctgacggggtattttctaagacctttacctttaaatccctttgcaacctagtttcagatcactccctctggttcaaattcagtatttcctgctgttttcagttgtgcaactggaagaccagacttacaaatggcagcttgcaggctgaatttggccactggtcttacttttttgggcccaaatagtggtggtggtttgttttgtcttattgaatcaggatttaaatactggacagtatcccataaaaatccagatttttagctgttcttgacaaatcaggagttctgaggacattggccccacagccctcagtctgttaacccttagttgtagcaactctgctgtctccacccctagtggttgctctccacctcagcacaacctgtatcacacacatggtataagcatatgcacctaaacccagtcctcctcacttgtacatgtttcccactttggccactgtaggcatttgagttcgtaaccctggacctagatacaatgagctacctcatggtcccctgatccaccttttatttttttatttcaatcagtttttggggaacaggtggtgtttggttacaggagtaagttctttagtggtgatttctgagattttggtacactcatcacccgagcagtgtacactgtacccaaagtgtagtcttttatccctcactcccctcccaccctttcccttgattccccaaagtccactatatcattcttatgcctttgcatcctatagcttagctccctcttatgagtgagaacatacgatgtttggttttccattcctgagttacttcacttagaaaaatggtccccaatt

SEQ ID NO: 111909 - DNA, 1014 bp, Homo sapiens
aaaggattcattaggcagagagaaaaattcttatttttccatcttaaatgtatattcttttagtgtttcacttagtttccctttttctccccttagtatacaacacgctcacttgtgtttctcagacaactgatacttcattttccttatataaagatcacgaacttgtaatagctgtgtccagagtcataagctagtaaggtggtggaagtggggtttgtctgccttaagtgctcagacacgtagctacttggccactccttaccatgtgtgtgctcatgaataagttacagagttttctgagtctcagtttataagtgtaaataaaggataataatagcacctacctcataaggttcttgggagaaatgaataagaatatctatgtgaacactcagagtttggcccaaagtaagtacccaataaacagagctgcaccatcaattattattattattattattattattattattattattattactactactactactttatgttatgtaggagacatacagataacctttcttttcttggtttagactgttaggagtcatggaaattaagagttttggctcatcttcaaaagctgtctgccaggccacactttatatagtcttagaatattacatttggaagagattttggaggacaactggtctaacaagtgcttatccaaagcagcagtcctctcttcagttttcagtcaaaggtgattagtcatctagagactatcagaacagttatagttaatagaagctgccactttagaaggaacatgtgattgtttaaaaatcatgtatgtgtactttgctttttttttttaagttctgtcttctgtaagattgtaaaaatcctttattcacattgtaatcctttatcgggggaacctgcccccaatatttcatcgtaagttctttctattttccataagtgtcggccggctgagaaataaagagtataaagagaggaattttacagctgggtctctgggggtgatatcacata

SEQ ID NO: 111910 - DNA, 1011 bp, Homo sapiens
gctactatattggacagtgcaacattagagttttaaaattcttaacgtactctagtacttaaaatacagcctcatgaatggttctcaccctgggtggaagcttactggagtacttttagcagttgtgagaaaagtaatacaaagtttgttatagtacctaagtttgctgtttttgtttgtttatataatttgaacagttttgaagtcaacacagttacaacactactctctccatattgctaaatatgttttcttttttgttgtcgtggttttttttttaaaccaagcaattgttatggatcaatgctttcttgaataaaagaaaaggagtaaaattacagttaattgtacatattccattaaaaattttataaattttttaactcatgggagtgttatccatcatttatattagagcagaaaaagatttgagaacttctggtctaatctgtagaccttgtatattagggctaaggaggtttaagggagaccattagagctcttcaatgttagagtctttttaaaaattggtgtgctatagtgttactttttaaaacttgaaacagttaacacacaagagatagccctgtagaaatgaaaatgtctcagaactgctttgtccttgtattcatcaacgtgctcaagagattttgtggagaagagaaatgaaaatttggaagctttccctattcagtgtttgaaatcaccacaaacaattagtgaatggtggctagtggctgctgttgaaacatcttgaacttctccagcagtggggagaatacttggtgtcctgaggatgcactcagcggggaagcaatacaatcagccattccttaatttccctaaaggtattgggtaatttcttaatacccttgtattgaatattgtaggatatcaccattttaagttatagtttagcaaaaattcatcattttttatgcctctggtctttattttaaaatacggagtaatatgcttttaaatgggggatgccactctttattaaaatgt

SEQ ID NO: 111911 - DNA, 1101 bp, Homo sapiens
atgtgtttgcttctttatgattatagaggaattatgtagtccagtgggaggaatgactattgtgttaaaaatgcctgtgctaagtcttcataataaaagcagcgtgggcagaagccaaaactgctccacattgttgaaacctcaatttgtgccacttggagaagaagatgatatgttagtgttaggagggtgtgtgtctctccgagtgattttacagggctgtaatctatggctgtgcaaagaacactggagcatttgagcatcgtgccaggtagcccagtggtgttaagtgactggtagcatacaatcaagtgggaagaaaaaagaagtcagttattaatgaattattcaggcatgtatcctacaagactgggaaaatctgaaattatttttgccagcattaactagagttctaaatcaagatctgggtaatagcgtctgcatggatttaagtagttgctgataagtaggtacctgggaccatctccatggggatagtttgtttcattaaatgaactcactaaacaagctgttaaaacccttctttatttcagtatggtcccagtcttagcctgtaaatgttaaaattcctttgttttctcttactgtgtgtggttgaggtctgtaaggctggtgtcctgtcagtgctgatttgtgttttttggtgttttatttttattttttgccaggaacctggttcttgtataaaccagggcccccctgcagaggatttagaagtcaggaagggcagccagtactattgacttttacttcaggtttggctaaaaaaataaccacattcctatttcaattgagaattagcttagtgtttatacaaggaatcaggtcattgtttggtggtccataatatgccctttcttaaaagaaaaagcaaaaacaaaaccaaaaaactatctctagcaatctaagcaatagcaccacatattcagagctttcagtccagcaatgcagtgctcatcataagcccatagtgaatagttacaaaatgaatgcatgaatgacatctcaatttaaatattacagaattgtaagcaccttttttgactaagtcaaggagacacacaactggaggaaaaggag

SEQ ID NO: 111912 - DNA, 1047 bp, Homo sapiens
agaggtgtaaagagtcaacccattaaatttgcctatttctgatgattaatgagtttgagtatatcttcaactcctgttggtcttgaagtttcctattctatagatttctttttaaatgtgcttttcccattgctctattggccttgcctccttttatggagttcattttatggagtttccttgtatgttatagatagtagccttttttcagttttaaatatgcaaattttctcactctgttgtcttttaactttgaatataatgcctttgttaaacaataatctttgattcattattttttgctttaaggttttgcttttgaatttttaataagacctttgctaaggttcaaaaataaattaatctctcttctattaatttgatgttttatcttaacttaggttgtcgagccatctgaagtccatatatatatatatatatatgggtttaagtagggtcccatttgatttttttccatttcacgatccagttttcccaacattgtttagtaattcagcctagccttccttatttctctttattgtatattaaatttccatatacacatagttctgtctgagctataagatatagaaatttctaaatttccatagtctaaatttctgttcttgtaccactatcaaactttttttcattaatttctatggctttgtagtatgtctcaatatctgattgggaaaattccctttctttccttttcaaagttgacttagctattcataagctttagagcacatttactgaattcttaagaaaactcaactgggtctggatgtggtggctcacacctataatcccagcactttgaaaaggccaaggcaagaggatctcttgagctcaggagttcgagaccaggctgggcaatatagtgagacctcatctctactaaaaataaaaaaaaaaaattagccaggtgtggtgatgtgtgcctgtagtcctagttcctctggaagctgaggcaggagaatcacttgagcctgagagattgaagcagcagtgagccatgatcgtgctgctgcactccag

SEQ ID NO: 111913 - DNA, 1083 bp, Homo sapiens
gctcaaaatgccagtgcttccaacactctgacccatggcctttccactctaattcatttaggcagtgtgaggtttaggtccagacagacctagggctaaatcccagccctgctatgaataaagcatgtcaccgtgggtaaatttttgaacttccaagacctcagtctcctcatctataaaatgtagttaataatgcctacctcataatgttgttaggaaaattaaaagtgacaatgtgtagaaagtgcttagtacaaacactaaataaagggtagctaataagcaatatgtagagcatggctaaatggtgggtaaacggccatgtgggcagttctggcagtgtaaccacctcctaacacattttccccttggtttggtgtgacatccacaggggactaagagtcccaggcccgtgaagcccagccaggaagtgggcactttattcacccatgtcccatggcgttctccctctcactctcttcctcagtttgtcataactcatgtgccagctgctctgggcccacaccctctcactgtacagcctgcagcccccccaaggctctgcgtcaaggccactgtctgccccgctgtggagagggtttctactctgaccatggagtctgcaaaggtatcgttggtgtcaccatcattcttgagaggctatcccacaagaacatagatttacttttttccaataatataactttccagtgtaacttttcttctagtgtatcttttatggctatccatacattatatgcatttttcattacagtagttttgcaaagggttaatctgaaaaaattttatttgaaaatttgtgaagacactcaaagtgttatgatttttttttctggctgtttttagggggaatattaaattaaacaaactagaactcttatttcctcctttctctgctctcttacctttgctaatgtttttcttagacttcattttgtttttccctaaagaatttctttttggtaatgacactgctgagcaaactgagagtcactagcgatgcctctgggctgagtgaaatggaaaaatcttaaatagctgtttaccataaaggctttgggc

SEQ ID NO: 111914 - DNA, 1035 bp, Homo sapiens
ttccttgagcccaggagttcaagaccagcccacgcacatagtaatattccttgtagtctcaactactcagaaggctgaggtgggaggattgcttgaactggggaggttgaggctgcagtgagacatcattgtgccattgcactctagctgggtgacagagttagaccctgtctcaaaaaaaaagtagatgatctgctcagatttccacagcaggtagacagtagaagcaggattttaatacaagtttctgacttagagcatgagcatggaatagctagtttagtctgacatgtatgtgtgttggttatgaaaagtgagtgtcatggtagtatgccattttggtttccaagcctcaactcttacctgaaagcttgagtaggtgaagggttaacaattaacttgtctaggactttaagttaaatgatcttgaacctattatacagtcccatgggcctagaccttgggctgaccttaaattatcttgcttctgccagatgttccttttttattgattttaaagaagaaaaacccttggtatctagtagaaagccatgtcgttttggagagttttgtgagagagaattttaaattggacagttaatgaataaggcaggaaaaagcccaagagctgacattaatttgtagaatgaaggagaaccacccattttggtgaatcagctaagatgagaaggaaggctgatgttcctgggacctgactgactttaggacaaatgcagaagctctggagagcagttctgagcaaggaacacacttaaggcaagtggtgctcacaggggcatttagcccaaaaaggcatttgactgtttctcaaagaaattagagacattccttaaagagagggataaatatgcagttgctgacattttgattggaagtttatatgattgcttgcaaaaccctgcacccaagtgatagctagttatgtaatatgcaccagaaaatagcttttttccacttacttacagagtcaagaatatgccttgttcacactaaacagctgtatgatgtgaccaa

SEQ ID NO: 111915 - DNA, 1051 bp, Homo sapiens
ttgaaacttaatcctcaatgtggcagtattgagaggtggggcttttacaaggtaattgaaacctgaaggctctgccctcatgaatggtttaatcattaatggattagtggattaatggttaatcatgggaggggagctggtggctttctaaaaagagaacaagagacttaaaatcacaagctcagccccctcgccacgtgactgcctacactgcctcatgactcttcacagagtccccaacaccaggaggctctcaccaaatgtaccccctcaaccttggacttcccagccttcatatgtgaaagaaataaattcctcttctcataaattacccagctttaggttttctgttataagcaacaaaaaatggactaagacattcccactcagaaataaaactaatgtaaaatataaagtaaaataaaattgcattttgcaactagttcttatcttagattacagagacatcagagcatcctgaatccactaaaacttatgaaaaagtttgtatgcttgtcaccaaatccccaataattaagaaccatctgtgcctatttttgaagatccagagaggagatcaaatgtaaagaagcaatgacaataattttgacacttgtctgaatgaccagagccataaaaccttcattctcacatggataatgtcgtcttaccttcaatagggctgtttctgaacatctccaagacatggagtgtaccttataaaatttaaccatatctttcagatctgtctcaagggaaagacaaatctaaaacttgaatagaatcattactacacgtcgctgagcaatgcttgactttgcttaagcaagattcttgctggcttgttagtaagtccagaagaaagtgaggaaggaaactagtttctcataaccaacacatagacaagcttatcacacatttaaaataattaacagtgcagttttcttaaagaccactacagataaacacattgatgagctgatgatgcaaatatccctccaaaactggcttttggggaaaagatagggtgttaagttatggaaaagtggaa

SEQ ID NO: 111916 - DNA, 1415 bp, Homo sapiens
ttagcactgtaaacaatattgacggttcctttgtgggcagagcaatacaatgcattctgatcattgaatacccagacatcagttcaagtgccagttctgtgactcatcagctgagtgaccttgggccgtacacttaatctttctttgcctcagcttccttgtcttttatatttttatttattttatgttttgtttccttgtcttttttaattctcttatttatttttatttatttttaagagaggaggtttcactgtgttgcccaggctgaactggcaactcttgggctcaagcaatcctccccgctcagcctccctagtaagtgagactatggacctgtagtcccatacctggctcttgtctttaaaatattatcattttctactacataaagaatttctctaatgattaataaaatagtatggaaaccccctagtgcagtacccagttcatggtagggattccacagaagttaattcactttcctccctgctctatgtacataccataatgccaaaagctcaggaatttttctggttttgttgagcaactgaaaattcataaaactaagtcatttcttttttttttttttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgggcccggccaaactaagtcatttctaagtggttctgatattcctcccatttttccatttttacataaaaccttggaaaagccatttggactgtccccattcccagagtcagagtgaccttcccctttgtaatttatagatcttcctacagttagccaagagttgttcagggtgaaattgcttgaccatctccagcaggctagagaaaaacaccaggctcagattgtggggttagcatacaaaatagagctctaaaggaaaaaaaattagtttgagcaactgcttttacttatagtgatttattttcttccttgacattaagataagcactagctttcagatatggtgaacctttcttgctacacacctataaatatataatataagagaataaacaggacttttattctggatgagaatgcctataggacacagtcaccctcacagtatccgcaggagaactggatctatcattctctagctgtgggcttttgaatgttgatgtggaaggaaggcagccatcctggcaggca

SEQ ID NO: 111917 - DNA, 1050 bp, Homo sapiens
gcgggcccctgtgaatattaactatggcaatgaataaaagggtgtttcatgcagggcagattttcaataagtgttggttcctgttttccagaggaagaaatattttgatatcaagtatgggagagagataaaaggcaataagacagtaaccaaacctcataaaggtaaaaaagtcaagttcaaaagtagtaggttgttttgtctgatgtacagaaaggagtatttagacaatgattgtttccttccccccaaaactatccaaataaagttaactttttttttccaaaactcaggcaaacaaaataaataaataaataaataaataaataaataaataaaattccaaccagataagatgctagaaattaaaatgccttactctctgcatttgtctcaggccattgatcattttgcttttgttcaagacaaatgttgagcataaatattgagtaaaataacttttgtttcatttaggaactgatgagaaaatgctcatcagcattctgactgagaggtcaaatgcacagcggcagctgattgttaaggaatatcaagcagcatatggaaaggtaaggtcacattaacatgacaggcagtaaagagatcattaatgtaccatggtcgctcccacatggttatgcccacagtcttctgtttcaggctgagtgtaacagaagatgccctgtgcatccagtcaggagcctggaatctgagtcgtggttttgccttgaactagctgactggctttgggcatgttacttggtctttctgggcctcagtttcttcacctgtaggataaggtttgccttagcccagtgggttctaaaccagaagtgattttgctccccaggggacatttgggatgaatggagacattctgatgatcacaaacaggatggtggggagtacttctagcatgtagtaggcataggtcagggatgctacaagcatctgagaatgcgcaaggcagccctccacaacaaagaattactaaggaaactatctgactaattctgtcttaggtaaccttttatttctcttttaatttta

SEQ ID NO: 111918 - DNA, 1050 bp, Homo sapiens
acattctcaccagagacaaatgaccagccactgtcctcccttccccttcctcttggagctctttgggagttactgagaggcaagacaccgaggaagagagcacctcccactgaagctgggcgtgaatttataagggttcctcttcctcttcccttaccccaatctaagcattgaaagcatggcggatctaggaaatgcatttgaatacagttcctaactgtggcactcatggaatcctcccatttggctctccttcaaaaaacctctacaaaacagaacaatttgggagtaattagaaaatgcagattaatattcatagaaatattttcaacacttctgtttattccctgtggatggacatgttttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtgactccaccagcagtctttgatgcaaagcagctaaagaaatccatgaaggtatgagccccccacaagccatttctgcccagggtttgaccaagtcatcaaaaatagtgactttcttgcagtgcacacttgtgatgggtggacttggatgcccttttggtctggactctcccagtggtagaatgactctgaaataggcaacagctatagaaccttaagcccaaatgttcctgggctggaagaattttgtcatatcctttgtttgacatgaagagtcaagttctctaatttgtcatcgttgaaagtaaatagcactatgattaaccccaacactcaagctaaaaacctagcattatccttgagcccttgttttctcttacccttccaagctcccaaatctatcagcaagttccttagttttacttcaaaatccattataaatatgtgcacttctctcaaaatccattgctactgttctagtctgaccaccatcatctcttgactggtccatatcaataggcttc

SEQ ID NO: 111919 - DNA, 1047 bp, Homo sapiens
ctgcagctcagtcatctgttgaaaaacaatgtatttgtgtgcatgtgtgcgtgttggaggtgatcctttgctctaaattcagttagtaggttgcactgaggagcaggtaaacttggagcccatttatctttgttatttagaatcttctctgttggacaaggtgctattcatgccctcccagtatgtctctttgatagtagtttaaaaggtgatataaaagcaggttaactttcacttaacgaggttttgtggtcggtccttcatgatctggaacaggttatgacggcaggtagaagtctacttacaaaaaaagtttactccattttaaaagaagaacttagaatttagttttgtatttctggcataattgccttgtagaaaatacttgccctgtgtgctgcatgcttcattggcctttgagtttttagttgcaaaatgatactacaaaataaacactttaaaagaaatactttttgttgataaatggcccttttaagttctatggttaagataaaaaaaatcgaagagtggattcagttctccgagcgttagacgttgatgtggtttgaaaacagtagactgagattccgcttgtattttttgaaatgctatacacaacagtaaattagcacaagggaaaaaacctgaagatttttgtataaaatatttgaaagagaaagaaatcgtgaattattcaagtgtacatatcattgtttcgtgaaccattgctcagaataatgatcttagccgaaacttggagaggtgggagaaggaggatccttagtttttcagaagaatgaatatgtggtgagtggtctttataaaagatttactatactataaagttttctagctctttattacacatgaatttcaattattggtttagattgtgttgtaggttttaaaagcacatggctcttcactcaaatgccatattctgtctttgaattgttttagtaactaattgaaatgtagcttgagtagtgttacactcactcattccactaaatcccagatgggtcttttatttaatagaaaaaaaat

SEQ ID NO: 111920 - DNA, 1126 bp, Homo sapiens
gaaggcctttttgatcttttagcagaaacctgaaggatgaagaaagttaggtaaaaacagaggtgtgaggttggggtgatttgaagtatgtcatgaagactgaagtctctgtgtgagggaaggaagtttcagaaactgaaatatgctcagagctgtggactacaatgaatgaatcacatgtaagagagatccaagatgatgttggcaaggtgaccagggtccggggcttagtataccatgctgaggagtttaggttttatctgaaatgcaacaggaagctattgaagggtttgaattggggcagtgacatgctctgatttgtatttttacaagatcatgctgattgctgtatagagaggtatacaaattataaggttaaaatgatgacagtggggatgaagatgataatgcttaaatgggaagaccttgtggtggtcataggaagtgttaggaattacttgcttatgtatctctcaggtgaaagtaccgtttgggaacataaggaaggaacagatttttttttttttttttgaggtgtttggaggacagccagtagttcagacatgtttagagatgtgtttggatgagatatctgagaggaaatatcaaatgggaagctgggtatgtcgtctggaactcagcaaaggtgtttgggcttagagatggtacttctgattgattagtgagccctggctgttatttaaagccctgggagaggatggatgtagggagagtgtagaatgagaaggtgctcattgaaggactcctatagtgcattggtctcagacattagtgttcattgtaaacattcagaggatttggtaaaacagaagtgctgagcctggtccccaacttttgattatgtctgagtgaggcccactctttcagtgatacagatgctgccggttcaggaaccacgtcttgagtaccgagtaccactgatttcgagcgggcgaagaagactaagaagaaggtgctagagaggtatgaggaataccaggacactctgatacctggaaacttgagagtatttcaagaaggggagggagtgagcagttgtgttgctgcaaagtcatcttacttgatcacattttttcgcctggcattcacagttattcatgctcac

SEQ ID NO: 111921 - DNA, 1046 bp, Homo sapiens
cttaattcttatccttggtgtttgttgctttttccaaaatgtaaaatagttattgatttacgagtgtaatataatctttctttttactcaagatttacccaattataaatggatacagtggtgttcttctgcttattttccaaggtttctgtggcacatgaatatgaaattgacatttgtgtaacatgtagtgatatttgcagattagatctggcaaatacatgtgaataatttataggtatctgatgtgaaagtaatagtgtctcatagtacttttaaagttcaatgatatatccatagcttacaaaaactttctgcaattaaaataaaaaactaaaatgagacgttttattttttttcttccaagaattcttctattccttcagctcttcctgaaccgatgactgctagtgaagcagctgctaggaaaagccaaataaaagccaggtaggcaaaactatgctgaaattgaaaaggcattaaaaaaaatgataggtcttgtttttaatcctagcaagtgtaattgattaaatatcatcttcatccacaaagaatgttgtgttgcttattgtatgtggtataattgagatagcaaatacaaaataagcttttaaaaatattagataaggagtctggcatcatctcactggaactgttcactctatgacaagtgattatttaactgatgatgtgacagcgggtcttttttttggacaggatttgtcattttcatcacatagcaactctagtttaggaaatactatgttttgagtttatagatgtttatttttttaatttaaggaaagaaaaaaatagctcctacaggtaactagaatatatagaatatgtatgtactttgtagaatttgtaatgagtgattataatactttttaaggctggtatatgttttcaatcttatttttcagagtatttattatattaataataagtttgaactatattatgtaagttaagactgaatctgttaatgattgatttttccccccctcacacttttttgaatttaaaagttaataagcaggatt

SEQ ID NO: 111922 - DNA, 1021 bp, Homo sapiens
aaagaggccattgcaaatttcacaaatcagaagaacatcagcaatccacctgatatgtcagggtggaatccttttggagaggataatttctctaagttaacagaagaggaactattggacagagaatttgaccttctaagatcaagtaagggacacttgaaggcttattttgcttcacagtaaaataacagctctattattattcagcaaggccaaagacttttgagaatgtgtatggaaaattctttttgtgcatttgagggcaaaattcaggccatcttcttatacatatactatcaaattatgttgtgtgcattagaaatcagttgcttgatagtagctattaaacccaatattgctgatagtatgctaatatcctaaaacttaaatattgcatatctatgaatgttaaattcagaatatctctaaaacatggaaaattgatgtttcaataaaaagggagacattttattattttgccttactaatgattttgcagctctgtttttctgcacactcaatagaaaatattgtgggtctgagatgccctttgaaaatgcctgaaagaaaacatgggctactacattatgttaatgttttgtaatgtccttttaatgagtggtgacataaaagggctgctttgttgtcctgatatggcaaaaattaaataaattctttttcactttaaatcagatatctcaatgtttttacttggaatcattgcttttctttgaactacctaatatatgtcaagcttcgccacacatattttagaaatgtcctttttgaaagaatgatgtgagtgttttgagtaggttgccaaataggagcaaaaagctcacttctagagtatgtagataattttcaggtttctgaggctttgtgtgtgtgtgtgtgtgtgcacgcgcatgtgtgtgcaggtgtgcacacaaaacaagtgtgttttccccttttgcatgtgaaaagaaggtcttaataatccctagtttatagttcctagttcctatttcatttaggtaat

SEQ ID NO: 111923 - DNA, 1110 bp, Homo sapiens
aaaatttccccagttgcccgtactatttgcagatgtaacctgaaagcacaaaggtggtatagatgattgtgtcttttcttgctctttttgaaagtgtgtttccatttcttatactgtgttctcaaatatagctgtctaaaaatcaaaaatagaatttccaggatctaaaatgtacccttatgctgtgtggatatacatttgttggtctacttacttctggtcagttctgaagtggatctcagctcctcttgaattagccatagacttgcttctccctacacttctccctcatttatattcacctgcaaccactgggcccagaaaagttactagaagcttattgggtatgatggataaaataattgaatttggccattcccaggacatgatgatggtagagtgcttattatgtgttcaggcaccgttctaagtcctttcttcacaatagctctatgatataaaatgtgttatcccattttgtgtataaagaaagtggaatagtggtgaccttgtcaggattattattgggttagctttagtagctgtgttaattacccatgaggagggaatcatagtatataaataaagtgaaattgatactaaaaaaggagggtttcctttttactccttgaaggaaaaagtgcatgaatcatggttgtatctaaaatgccgaaaaactagaaacaacctaaatattctattgctaaatagtgaacagttatatatggaatattttatcatatttctatcagaataaataatagactgttgatacctgaaaagatgcattaaaaatagtaagttaaaaacccacagatttatacccacactgacaattataaatgtgtatttctattaatacaactttgataaatggacaaagggccaacagaatgagaagtataaagtgacagatgtcttctgaaaagtaatggtagccagttgaataatgaaaacagtaaattttaagaagactagggagtacaatgtaataattttaaaaagaaggcgaatttaaattcacttccaagtgacactctccaagatgaattatctgtcctacgttaaatgttccagaagaccttcaggaacacaactagaaatggaaaa

SEQ ID NO: 111924 - DNA, 1026 bp, Homo sapiens
cagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaatatttttaactgctgcttgtcattctttgtaatacataacagctttaaaatcatattttagaatcaggaacgaagattcagggaatgtctgtcacatcttatggcatcccacctggacagaatatccgatttgaagattgtgattgacttccgtaaaactgtacaactctccatttggcaggtacctactagataatactttgccctgtattaaatgtcaaggggcaaagcctattcctgtgaattcctgctggttgctttgctgcattaggtccctgtccactgtaaatcatcattcctgggaattctacttctgcccaagtgtgtaaagaatcagctcacctattagagaaggggtagaaataccttctgtgtgcattatcacaataactgtgtttacactaaagaggtgtaaatacagtcctctgaaattttgtaccagaattcccaagtagtgtaatgagataatgatccagaactgaaactacccttaagaaaacatttttggaagggagaggtaaatagcagtagggggtttcttgtgaaaaattaacctccatccttaagagggctga

SEQ ID NO: 111925 - DNA, 1053 bp, Homo sapiens
aattagttactgattggttgcttagtaaccaaaaagctatagactattaaggattttagacaattgatgaagcaatgaagttgtggcaaagtacattgttattgaatactgatattgagtctatagtaactagatttgtttaatgaccagaatataaaatattaatagctagatgaccatgttactgccttagcaatagcttacaaaatgtttatcatttgtaactactttatactgtttatttgtcccattgcctccaccccactgtcactgtctcagtgtttgctctccagggctatttctgtaacctcctgtttcagcccttctagtccacacctctgttggggggcacttaaaatcttcaggagtatcttatcatacccataatattgaagttaaaacccattaatgtataggaaatgtcataatcatattataaagaatatgatgcttttccttaatccctgcccccagccataaatatgtgcacacctttttttatgtccttggtgaatgccagcccaacttttaaaatctgcctcaggtgaacagcccttctctgatacttttcttcccaccagtcccaccctccaaatgcacatgtacctccacagagtcaatatcctcccaccttttccaattatgctgtgcactgaagtacagtaggatttgttactgtactgtttgttcagtgattctgtatcacctccaatgtatgacatacagcaggtacttaatagctgaaaggcattctgccatagaaccttatcaattatcagaacagctgattgaatcagattagctttactctcagtttggcaaccatataaagttagcaagtcatcactgttttttaaattattattattattttttgagacaggatctcactctgtcacctaggctggagtatagtggggcagtcacagctctgtcacccaggctggggtatagtggggcagtcacggctcactgcagcctcgatctcccaagctcaagtaatcctcctgccttagcctcccaagtagctgggaccacaggtgcatgccgcca

SEQ ID NO: 111926 - DNA, 1220 bp, Homo sapiens
agacgcccgggagcccgggccgccgccagcgcacgctcgagcacacccgggcgcgccccagcaccctgcccctcccagctagggctgaggggcggggccgccgcggcgcgctgacgtcagaggaggctgcgacgctgccgggtccgccgcggcgctggcggcagtggccggtgtgagcgcagagccgggccctgggcagcagcggcagcgcggtaggacctcgcgcagcgtccgcgggctccggggcgggggcgccagcggcgaagccccctccccggggaggcgggacctgggggagctcccgagccggggagcggcggcggccgggaacgatgcatcagaagctgctgaagagcgcgcattacatcgagctgggcagctaccagtactggccggtcctggtgccccgtggcatccgcctgtacacctacgagcagatccccgggtccctcaaggacaacccgtacatcaccgacggctaccgggcctacctgccgtccaggctgtgtatcaaaaggtacggtctggctgcctccgcctggagtgcccccttctctcacctacaccctttttgtctggtcccccttctgctttccccgcctttctgcttgcccatcatttcctcgccgccccatccttttcatccctttttgccgcctctcctcccccgttatctccccttacctggccggggtacttggtccacggaataatcatgatagtaacagtgatcataattacagctctcctatgacgctttgctctttacaaagggcttttacatcctttattcggtttgttcggctcattgagatatatattgaaatggggctgagccatatttgcccggtgtatacctttctttttagagcaacactgtgggaattcagtagctttgggccagataagtgcctgtataataggaaacaagttaacatatacacccgagatttattcatttggcaaatacttatggagcccatgcagaaaaaaaagcaaacatggcccttgttttcatgaagctactaaggtgtagcctgggtaacagacattaaatagataattacacaattacataataaccattgtggaaaaaatgctgtgtaggaaaagtactgtggtaaagagagctcataacgggcacccagtctccactagagcaccacagaagcatctctaagaaagaaatttctttatcattttaaacctttaaaaccaca

SEQ ID NO: 111927 - DNA, 1034 bp, Homo sapiens
gatggggtttcaccatgttggccaggctggtctcaagttcctaacctcaggtgatctacccgctttggcctcccaaagtgctgggattacaggcatgagccactgcgcccggccaagatccccaactcttaaataaataaataaaacattagtaaaccatgatagtacattagggcaagcatctggttggtttttcattaccagaactctaacgagagtgttaagtctggcttttattcctgaaagctggtacacaaattaaaagtttgactgtttgttaaataataaatgttataaagaattttgaaaaatcacgtactctcttgtataaggaggtctttaataaacaaatatttctaattgctcctttggcaatcaagacgtttttgcatcctgggacagtgtcgcttagtaagattcccagtgggtgagaggtacatctcttttgtaaagtggcagatagattaatgtgaaagaaaggtgagaaagaggcagccccatagaactgctcttaggcagatcattttagaaaggcatacatatggaacttgagaatgcagaatttgagttccttaaaaattactcatgtctgtgtagcccttgaaaggcaataatctaatatatatttttcaacatttaatacatgttctttaattttattatcttctttataattgttggggatggggtagattaagcttgtatccagtaggtatttaagctgaaacgtcacagcttttgtgtgtctaattagcatcattgcctcaactgcattgagttaataggtagtagtatcacagaggttaaactcattcactctagattatacctagagttataccctaaggtacctgctttggaaatgttgaaatatgtaattgcatataccttgctttataaagatagcaaccctatcaaaactaaatccttggcaggctaataggagcgccatgaaataacctgaaattgtcatttgtcagcagatgatagaaatctgaattcagagttagaaagctggtttaggagtgacaatg

SEQ ID NO: 111928 - DNA, 1060 bp, Homo sapiens
cttctaggcaagtgaatggtgtatgaggtttttaaaagtttcacttctaattctcactcaatttatcgtgttcattggttgatgaattagctcagacactgaaattgttttccatgctgacaacatttgacaggatttgaaaaagactactgagtctttttttttttttttttttttttaattttaaggagcagcagacctatgtatgggttcaggtggtctaatagagattttccatccggggataagaatttctagcctattgtttctcaaagtatagttcatatgcttagtgcatcggaatcacctgggtgctatgttaaaaatgcagtttctttgtctctggctcagacttaaaaaatcagtcccgtatttttaacaaccctccaggtgattgttttgcacactgtcatctgaaaatcactgatcagtacaaggcgttgaattcttcataaagataatatgaagggagcttttttccatgttaatactctccagacaaattaattcatcaaaagaagcaaataattcagaggagatataacaaaattttgtttattataaaacatatgggaaagggtgagatggtatatgggaactctgctcaactttctgtaaaaactgttctaaaaataatttgtaaattaaaaatattttaaaagtacgtgtgaacattcgacacacattcttccatatgtgttttacataaatgtgagatcatgtatgttattttttagggcttttttggtcattactttcttcctcatcctttcttttcaagcaaacaatagctacaacttggcaatggcagtatacagcacaagcctgaaggatgagaacattcacaaatcacaccatgaaatttgtcccaatttgtttccagagcaaaaatctcaaattctgcagtgtcttgttaggaaccagacacctagcatgtctggaaccacgtccttccatccatgtcattagctcctcatatcccatcaccatctgggcatcttgagttagaacttttaagaacacagtacccagccaaaatccagtgaaacagactaagtga

SEQ ID NO: 111929 - DNA, 1314 bp, Homo sapiens
gttatttaaaacaaaggcgaccacaatgaactcctctctccccaccccctaacccctgcgcacgcacacgcacaatgaagcgaaacctcattggctgggatcagtgacgcacttctgaaagccgcagtttggcaccatcttttccatctcctgctccttccgccttcccgccatccgccctccacacgattcagcccggtggtgttagccccctggactcgattcctgaggcaaacagtgccccttaaggtcggcgacagcctcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggaggaaccagatgatgtcccgcatggccatatcacctcactggccgtgaagcgttcacaccggcgcctcggcctggcccagaagctgatggaccaggcctccagggccatgatagagaactttaacgccaaatacgtgtctctgcacgtcaggaagagtaaccggccagccttgcacctttattctaacaccctcaactttcagattagtgaggtggaacctaaatactatgcagatggggaagatgcttatgctatgaagcgggatctctcgcagatggcagatgagctgagacgacaaatggacctgaagaagggcgggtatgtggtcctgggctccagggagaaccaggagacccagggcagcacactttctgattctgaagaggcctgtcagcaaaagaacccggctaccgaagaaagtggcagtgacagcaaagaacctaaggagtctgtggagagcaccaacgtccaggacagctcagaaagctcggattccacctcctagagcatgcttaaggtattctgtcttccctgacccagtacccccttctcctaaatccctgcatcctgccttggcctgcccaattccatcctgtcttaccccattctggccctgcgagattttacggtaaaaaccacctggtgaccttagggagaagttagagtgagttgagggagactcattacacgctattggaagttaaataggataccagctcatgctgaaagtagattaatttcaatgaagaaacaagcatttatcctgctttttgggcatgagttgtatttcagggtaaccacgtagttgatgaaaggcatt

SEQ ID NO: 111930 - DNA, 1023 bp, Homo sapiens
tggcacatgtatacatatgtaactaacctgcacaatgtgcacatgtaccctaaaacttaaagtataataaaaaaaaatttgcaatggtaccaaggctattgaaaccaatatgcatcctttaaaattagaataacccctctgttttgtaactttgaagttaatatgcataatgcttcatatactgagtagaatttacttacaatcttagagcaacaagggatttttggaagagacgggtttacaattttcagaagtgcctcacgcatatatgttattagaatcatttgacaacagagatccatggacagcttcctcaggggtgatatgatttgctagaggagccagcacagtttcattcatattcagatattgaactattgaacctcttaaaagctagaaattgaccttcactctatggaggaaagcaaagaatttgaacatttgactaattactgtgtctgtgaaactatgacgtttacctggttagctgtaccagttttatatcaggaaaaagaaacatgtcaaagtcagaaacatcccttctatgatgttttatattaaatttttagccaaaattcttataacattatcctgtcaggtgagcaaatgttacccttttggtgatgcttaagtaaaattacaattagataatgatttatgtattatttgtttaaaatctctctccccttatagactaataatttcatgaaggcaggtactgtgtgtattctacctatcattgtaaaccaggcatgttgcatggtgaatacttattattgaatgcatcttcttcacctatcccaattcttaaaattgagaaaattgatattgctttacttggaaatcaaattcaaaatagagtacctttttgctagttatagtaaaaaattctgtcaattatggagaagtattgtgcttgaggaaatttatgatacaatcactcttgatataattttcattgacttcatttaaaatttgtttctcataatatatatacaatgggaaatgtggcctttgtaatca

SEQ ID NO: 111931 - DNA, 1207 bp, Homo sapiens
cccttcatatacttgatgctccagagaaaccttgcgagtcactgttcccctcctatgcacaagtatatcttttggatttacctcgttttgtactcacatttccctgatactgtgttctaggtgtcaaatgctatctcctctttctcttgccttctattctcactgaacaattcaggtcaaaagccattaggtgggccaagcactgggtgctagggtggtgcagagctacagtaaagtagtcccagcaatgtgccgaaagccaagcagggcgaggagagtgtccccatggtgcagggaaggacagcctggcatggagcattggagactgagaagggtgaagaaagtgtctacgtgggaaggtggcccagcatgaggaatagagaaataagccagtgagcagattacctggtggtgggaaggaggtgacgtttctgaccctaattaagatcaggaggacaacacttctttgagctgagtcgaagtggacgctttgagcgtagccgccccacagccgccgatccctgcgtcgcttcctgtagaaccctgggcctgctttgcagctttcctccctttgtctcacaaccatgtctaccaacgagaatgctaatataccagttgcccgacttaacagattcaagaacaagtgaaaagacagtacagaaatgaggtgtcgcagaatagaagtcaatgtgaagctgaggaaagctaagaggaatgaccagatgctgaagaggagaaatgcaagctcatttcctgatgttgctgcttctccgctggagaaaaaccgcaaaaaccagggcactgtaaattggtctgttgatgacattgtcaaaggcacaaatagcaacaatatggaaagtcagctccaagctactcaagctgccatgaaactactttctagagaaaaacagccccccataggcaacataatctgggctggtttgattccaaaatttgtgtccttcttgggcagaactgattgtagtcccattcagtttgaatctgcttgggcactcgctaacattgcttctgggacatcagaataaaccaaggctgtggtagatggaggtgccatcccagcattcatttctctgttagcatctccccatgctcacatcagtgaacaagctgtatgggctctaggaaacattgcaggtgatggtttagttttccgagacttggttattaagtatggtgcagttgaccc

SEQ ID NO: 111932 - DNA, 1022 bp, Homo sapiens
taccaaatatagtacacaacaaatacatacctcagctacatgatctaaaagttaaacgttccaggagtcccattctgaacttggaaggtacagccttcagagttagtttctggcacagcattttgatcttcctcttcctctaccaagaaattcttctcaattaagcttaacaaagccttatacacagactcattttcatggttttgtagagcctcaattttgtctaagcctccacattcttcaatcattatactaagtttctcagtttcacctagtttctcagcagcctgaaagatgttcgaaatggcatccaggataaccagaataaccttggtatcttttgaagttaagagattcatcaatggttttattaggccacaatgaatgaggtatacagcctgttcaactgttccaccactggtatagttggtcatggccccatacagcttccttttgtgtctttaaaatctgccttagagagaacattgtgaggaacgggactaatccatgattcacaacttgctgtatctcatcctgagggtcagctgtgatgtttgacattgtccatgtaccttccttctgaaagttagttttggagttgatgagcaggttgggaaagacagcaagagctcctgcatcgatcacaacctgagtctcttcatctgtaccagtgacaatattccctatgggtcttagtgcaggagtcacagttggcaattcagaagctcctagaagcttcacaagttggggcaaaactcctattttcaagaacatgtcagttcgtttatttggaccatcagtaaggtaggaaatagcccaacagctatctgctaatacttctggatcatcatgatgcaggagccaaactaaggtagaaagaatttgctcaacagcatctaactggggtgcaggattcttgtagcagcagaggattgaaagtgtccaggtaagatgacataagtaaccacatactaaagatgacatatcgggaactgcaagaagagccaagagtgggtcaactg

SEQ ID NO: 111933 - DNA, 1040 bp, Homo sapiens
tacgccttcaagtttaatgtcaatacagtgcttctgttgacttaccttgggccattgaagaataggcaatcaagtagttgtcagtttagggaagaaaagtttaaggctttgtcaaagcgtttacataaaatatgaaaattccaagcacatattttggttaatagaatcgtcgatgttactgctttttaaaaaaatctaaattcactaccaattttggggtcatgtggagtcattagacagtcccccaagcctagataaatcagaatctatatctactatgcagaaaaatcaagtggaaaatttctgttgctaatttaatcagtgaagactgctaaactgaatatttcaagattcagatttcataacttggcacagcatatctgttactttgtggatgcaagtagagaaacttcagttttaaaatatttttgtctggggattttcagatgcgttgttgaaagcttctgaatacatggaatatctgtgcttttctatattttattcattaacaaaagagagaaaaaggaaaaatgtgtatagttgtatcaaccactatcagtagagccctattatattaagaaatctgcagaggactaagtcaaaaatctagaaatatgtttttttttacggaagtaagcttacatcataatgcataagtggaatagactgtgtgtataagctgagagacaccaagacattcttgccttcttcagcctaggtgtcaatgctgaaattccacaaagagaataattccttctgttaagcattctcctcttcttttgaccctcttaaatgggaacaccttaagaaaaataacacactgtctgtagcactttaatgtgaatttatttacactgagccacccgtccaccccgtgccttctcaagcaggagaaggccacagtagcaggagagtactaagacacctgtccatacttgtgtatgcatggggtgtcctgacaagagaaaagagaggtagtgagaggatcaaagaaggcagtcaaatttagcaaacagtcattgactatataccatctacaa

SEQ ID NO: 111934 - DNA, 1049 bp, Homo sapiens
ttagagtagaggaatttatttaatgtaaataagtattattttccagactttcaaatagttatactagtcttgagcacagatttgtgctttaatgttcaaagtagtgtattatctttgatgaagaaacaatggaggagaattattttgaaaaacattttttaaatgtctttttaatttctttaaaacctgagaaaacttcatgctcattgtttactaaaagcaacttatttgtccaaataattactgatgaagtagaatcaaatttttgaatcttgaaattattttaaatgaacacttgaatcctagccttctttgtttttaacatagtgaatgtcatgaacaataaggatgttaaatactaagttcttttttaaaatcacaataataaagaatggaaagaatctatgtagaaatttaattcttcacaatgatataaataagagcctgtgttttattttgggatttctgtcatcctaggtgttttggaaatatttgctgtgtctcaggggattgtaggaatacgaggagttttcagcaacaaatttttagcgatgtcaaaaaaaggaaaactccatgcaagtgtaagtagaaccactttatatttgttaaaggtgctataaagattttacatttgtaaaacagaataattttccaaattcataggtaagaaaatttgcccaaagaacttaacttttaaaaagtatttttacatttaaccaagataattttgtgcgcttccagaagtaataatttaaatatttaatttacttaaaagatattacagagtctacaaaaagtttaagcataaatgtatttgaaaacagcattctcaaaggggcagccatccacttatttcttagaagtggcccacgtaagaaggaatatggcaataatatatttcatcacattttaaacttacaagtttatagtgactgtatttgtgctaagtagatgaggttcttatttaagtttacaggctactcataataccaaattgggtctcagtaatgtaaaatattttcatattaacaagcagggagggaaaaaac

SEQ ID NO: 111935 - DNA, 1078 bp, Homo sapiens
aggcaactgtgacccttaaattattcaggccagccccaactcctatttatcactgaccttttcttcctcacgtccaaactttgtgtgcttataggtgtcccttatctactaagttttcctttcaccaaggaacctaatttcaaagcaaaatttccaagctcaacctcttaaagaggcatggatttcctatggttataatcttgtgacttttttcatagctctgttgtccatcttgatttttccctaaatatataaatcttggaaaaggtggttatcatgtattcttcagtcttttcataaagtatgcagaaagctcattgctaattagggaaaaacatgttaccttattttaaagatccagagagaagcatgtggtggaattatttttgtttctcagggttttaggggatcatgtttgaaaggaaagctaattgcagactttatgaaacaggcatggaatgtgtgcttgatcagtcctaagcaaggaatagatcatcctcctttcctggtttcagagggtgccagctggcttgcctgggatgagactccagaatggacttcctgcgctgcaggcagagtgaagaggagtcagcagcccctaaagctgaacatatttactgaaaggggaaatggaggcttgagtaatacttatcatcctcatcaaaaaataacttactaagcactccactctgccagtcaagaccatgcatgagctagatcaaggcatttgaaaagaatatttttttgccctctaagagctttcaatatacagtaaaatggaatgtctagctattcaggcacaaaaatgggtttaaactctgccttcgcagtaaatgccagtttcccctcagttttgcactgtggaggtctagttaaaagacctattttattgaggaaatctggatgtgattgccttgtagattcagaaatccattttagcagaaagtgagacatggtaatatatttctttgatgatttgaagagtgacacttgtcattcatcaatattttaacaggaaacaacttcagagcaagtaagattgtatgagcaaagactaggcaatagctttggtttgtat

SEQ ID NO: 111936 - DNA, 1070 bp, Homo sapiens
caatagtccagctatatggagttattaagggcctcagaaagaaagtcatgctataccatgttttgcctggtgtggtccttacttcaagggtatcaaaaccacatgggatgctggttaatgatacatcaagtccagggtctcacctcagacttagaaaaacacagtccctggagatagggcttgaggagctgcatttgagcctgctctctgagtaatttgaaggcaaattatgtaagtgaagaaaagagatcctgtagttgatattctttactgcattatctcaggttgggtgatattaaagccaacttgtgtattttgttggttgctcagtatgaagaactgagatatagaaggaacgaatgtccagtaccaagcaggagatatggccgtgcctgggagatagcatggcaaggctacaactgacccatacacagcttatatagtaaagagtaagaagtagccctctgggtgcttgctatcctgtaccagggcacaagtataaaaaacgaactgagtttagggtacctgtcccaggcagctccattggtggagggaagggatgggaaccaagcaggtctaaaaggagggaggggaattagaagtgatgcatgtgacaaggaaacttagtttagagcaaaatttggtctatagttgtttttattacagtctatgataacctttttgttatttaataatattagtctataacaacattttgattatttatatttggctttttttcccttaactttataaggtttttcaggagaaaggggcaaatcaaagaaaacaagctgaaataaatcattaaaattgattaagtacacacaaattccaaggtttatactggtgtctgttcaaattcactcctatttctatatctcatatcctacatatttagttctgtagttgcacgcaagagtcggtatttgcacagctttaattcatactatacaaggtactcaatcatcatagatggtgatatttactaaggaacaaaaccacaagaagggattttagagagatttttttaaacaatatcattttggaaataatttatttggtttaat

SEQ ID NO: 111937 - DNA, 1035 bp, Homo sapiens
ccttcactgtgagaaggggtgaggagagccacagtttacttctagtgaaaaagttctttttttttttgagatagagttttgctcttgttgcccaggctagagtgcaatggtaggatcccagctcactgcaacctccgccccctgggttcaagcgattctcctgcctcagtctcctgagtagttgagattacaggcgcgcacaaccacacctggctgattttgtatttttagtacagacagggtttcaccatgttggtcaggctggtctcgaactcctgacctcaaaagatccacccgccttggcctcccaaagtgctgtgattacagatgtgagccaccgtacccagcagaaagttcttatttctcttaatagtagtgtgtttcctctccttgtaataatctggatattcaagaaaaaatagttcgatttgtttaaagttcttttttttttgtcaattaggagtatatactaaagtacaaaaaacgctgattttaaacatttcattttaattttgcaattatggtttgttgaatgtaacctgttattattcttgccagatcaaggagaaattaaagagattttaatgtaatttaagtcaacaaaaacatgggcaggaccatgttaatactgttttccactgtaaaagtggcacctagcacagtgcctggcatgtgatatctgtggaataaattagtgaaaaatgaatatgaaactttttaaacaaatatttaaacaattgctttcattgtagtggctgatggtggtaaggcaattagatgaaggagtcttgatttcagcaacttatctgaaatttgattcatctctctacttcatactctttaactatagaaaaagtctgttaatttcaggggttttttttctagaaaaataatggagttctatcattttaaaagtgtatattttattagaagacttataatttaaaaaaaagatttaaaaaataaaaatcagcctggaaaatttattgtccaaaattttctaatggtaaatgtatgtattttagtacctctagc

SEQ ID NO: 111938 - DNA, 1042 bp, Homo sapiens
cttgtttcaaaggaataattttgacctcatttctgtgaacaggaatttatattttaccaggcaatcatttcttagtaatatagttccatttattttcttagtgagttaggaggaaaaacagtatgtaaaaagatttgtaactatacatttcaaagtatttaaacaatagtaacagggtttaaatgtatcaagagttctggttacttttatagtcatcgatattatgtcaccaagtaagtagggaacagaaatgtgttacaaagataaatgaagtagaaatatagaaagaaaaatagtaattttaaagcaactttaaaataagcaaacatgtctttataaaaaggaattgagtaggaggaacagagatcaacaaaattattgtttttttttctacaataccttatgttttattacatgctgaaaagatcgccacaacttaaatttcctctttttttctcctccttaggccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacat

SEQ ID NO: 111939 - DNA, 1063 bp, Homo sapiens
tttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatcattttatgctgtttatgaattataaatgtgtttatagctcatttgtaatatggaaatcttttacatttttcctattcactgcacttttttattgtttttatttctagccatacctcagataatatgtttagttttacattttaaaatgtttaaattctctttcacagcaccaaaggctcagcttggatttgtgtgtatgtgtatgtcaattcatgacattatgtggaatcctaaacctttggtggctgggatatgatgggttagaagcaaggagaaaatataaggactttttgatggaattaaatgtgggaggtaaggaaaaggatttagaggtaaaagtacactaagtttgcaacatttattgagatctaagtctgtcttgccttcatttctctttttatctcccccttgccctcattcttgaacagctggaggaatacattttattctgtccatgaagcatacactatgaaattcaagtgcttaaaaatacttctatgactctctgctatcccactgtatagatccacagggagcaaacacttagaaatgatagagaactgaaggagatcaatggtttaacagttatccatgccaagtcccattgtcagaaatattcttattactcagtcaaacactctttgagcttcccttcctaaaggtaaccaatccagtgaatagatgtgcccttttataaggaaacttctgatgtttattaaaaaaactggccttttgatagaggtaacttaatttgggaatttgttgtgttgaaatggcatttaatttcaacctaaatactga

SEQ ID NO: 111940 - DNA, 1113 bp, Homo sapiens
agaagaccaccctgcaagtttctgcctctgtggtcacagcttcatgccgtgggcgtaaaggtgggtgtgcagccagaggcaggatgtgcaggcaagatccaatgtggttaaaatttgggatcactagtctggctttagggaatctggagaccatttcatgttaacactcattctaagagagaaagcatgtccatcagaggattatcattaagcatcagtgtgattcactcaagggttaatagaaagaaacattcataagaggtgaggtttcaggttaagagagaaataggagcctcttgttcttctcaccagagtgtagaatgtcttcttccctttaggaagaagaccctcaaagtttccagaagtttccaaagtttcctaaagagacccaagtgggaaaggatccatgtctccttagctctttaaaacatgtcatgaatcaggcatccaaacaataatgcactcagtgactgagtgaacatctagtgaaccgaatgattcagagattggtcgagatttattaattgcctaaaaaagagactcaaaggccagggaaagtagagccagttttgctttgcttaagaaaataagaggaaaaataaaaatgatgtcgcacgttgcttttggggcctaatatcactttccctccaccctcgcagagggtaggtctaactcttgttagttatcatttggatggtttgcttagttattccctgtctgttttccatagacattgtttgagtacttactatatgccaaatatgccacaagtgatgggtgtagagataaataagacctggtttcttccctcaagaagcttgtagtctagatgagaagacgaaaaattaaaaaaatatgctctatatatcccacgagggcagagctggactactgtaataagtactgccaccttacttttgaacagcgctttttagttttaatgtagcacttaaagcattcagaatatatttagctgccttatctaattagatatagaagtaaaccacctaaaaggaaatgaatggcttctaagaagttagcatttaaacctaagataccttgatgcttggtccaaattcccttttcagtgctcataactcagctgctgaatat

SEQ ID NO: 111941 - DNA, 1097 bp, Homo sapiens
agcttgatgtcatctttaggctaattaacacaaactatttacaacagacttttataaagattgcttatatgttactacaagttcatagaccttcccatcacagaagtaaccacctccccaacatattcatacagagaaaggagatatctgcattgtaactggtctaggtaaggtagatctagtaactgtggttgtaaactttaaccagagccagcctaagatctgggaatctttaatgaatttcattattgtaaaggtttaccagtagatacctgtgggtttagaagtactgtgatttggagcaataacttccaatatttaagatctgattgcctcaactaggttgtttttaaaaattgcagtgttaccagctgctctccatggtgagggaagagagattattcattccccaaattgtctttcatttcaggtctgatagactgttactaaattcttaaaaataaggctccttttcttgctgcctcctaagttgctcttaactcagacactaattttctgtataagactttccatgcaatgtgaactaaatagaagacctatgaaaggataagacatttctggataatttgttctatctttgcattcatattcaatgccaggtactgtactgagtgctttcatcttctctcttcaattctcatgacaatggcatgtgtatgagtaatttcctctcttttaggttgaagagacggaggttgaataattgtataaattcccatggttcacaaggcaaagctcagaatcaattattctcttctgtcttttagttcagtgttagaagaacggttattaatcactaagttttagtttatacagtatgttcatctttgatatgtacattcatagtatattacatggttcaaaacctaaatttttcctcctctattgagacagatatgagggtgctccaggtttagaaaagaagagcaaatggtcagatgtaagtttggttcactgagccaaaacaagaaaagtgtatgaatttatgtgctggtataaatgaatgttgcaccaagcactgaggaattacttgaccaaatgagaggttggttacggaattcagacattgagttgac

SEQ ID NO: 111942 - DNA, 1023 bp, Homo sapiens
gactggcatgagatggtatctcattgtggttttgatttgcctttctctaatgatcagtgacgttgagctttttcttatatgtttgttggccgcatgtatgtcttcttttgaaaagtgtctgttcatgaagcaaaggaccttttggtatgtaatgcaacatattcacagttcttaagattagagaatggatatccttaatcccattaatgtgagaaaggggcattctgcttatcacaggtaatttatataaaatctcaggaatttaccgaacatagttattcactatcaacttctattcttggaaaattgaaatgaggctagttttctgtgtacaatgtaatgtttgaaatgtgtcttatgtaaaacatcagggagagtcttttctttttgtgagaatcagtcaatgtctatcagtcagaagcagaagtggaaatatttttgtgagattttacaaggaattcctgtaaattcacatgcaattttatgagtgatataagctatttcatatcaagacgagttattcatgtttaaagtctaagttctattgacatcacatgtccattttgtgtttgaggatcaaagtaggtatttcctctatgcaatagtctctttaactggtcagagctggaagtcatcaggctacttatgagccagttttgggagactaatccccattcagagctgctagaatttgaaggccctttcatctgcagatcttctctggttgcctttgtaatgggatgggtaccatatgttgccttttgccccatgtggtagtccattcccttccaggttcatttagtgttgttgacagcagggccagcagatggtgtcctagagccaaatatgtcctgtgcctatatttgttggaggatcactttgaaaatatgcatgaacatctgactgccagccagctggcaacttggaaacacttggttccactatcagatcatcttacattaacttctttaatatgcaggtgagcaactccaagtaggtcacaattctttggtctagcaatca

SEQ ID NO: 111943 - DNA, 1085 bp, Homo sapiens
atactttttgctgtctgatatccattcttcccttctcccttaatgaaaggactcttgttttgtagcaggacctgttgctatggagtaaggactacatttcccaagctcctttggaggtgatttgtgcagcttccagacatatcttcaaaaagaggaaatgttacatctttgctgccctttcctcatcctgctgctttaaaaagtgtattttaaatacttttaacagtggtgtttaaaagtgctgatgagtcatattccaccatgtagataagagcaataccttagagatgacaaagttatgtgatatataaaaagcctgcatcgcctgtaagagccctggactaccattttcagaatataatgaacaagcactaaacctctgttttctttatgaactgtgattgagtctctgccaaacctacatcctaagacagaatttgatgccacaatttgggtgcataaagaggtataacctagatatgtgatgtattatatttagcatttggtaggcgggaggaggagacacagatattggagtcagaaaagctgattgatccttaaggatgctgaggcaaagcactggtataattgtcggttgttatatcttagaaggcactccacaagctgagaccaaacattagggaaaatcacaggaaagcagcagaatctcaaagtgttgactgcttttgctcttttagtgaaatctttttaaagagatgaaggtagtctagagttagctagtatgcaagtggaggtggaaaggaatacagttctgttaagaaaggttttttgctgggttagcaacataatttcacagagagtactataatttgaggactttaagggttgaaaaaggcaacttttcctgtacttcaaaccaaaggaattataattggtggcttcaaagccactgccttagtaggagataagctcaatgccctgccagatttgggagccagaccagaggcaaaataaaattaagggtattgctttcccacccaaacaaaatggctcagatagcctgaatgtatcttccatccagagagggggtgagcaagcacacagggtaataaggaaaggcaagc

SEQ ID NO: 111944 - DNA, 1008 bp, Homo sapiens
ggtgtctttcaatccattacatcattctgttacgaccaacaggccttcaggtattcatttcattccctatttgttcatcttgatatccacccaacccataaattataggacatgagaattcaaattagtttttttctggctactgccatttctgagcaagagaagagtattgcttttagaatttcttcagagaatttattgctctcttaggtttgcaaaggccatgggtatcctgtatagaactagctaagttaggttaacatactgctatttgggtaaagacttacaaaatagtctgatggttggtatattttagatgatagaaattcaatgccttttggagctaaagccactattgttaatagagttaacattaaaagggatgtcaaaccaagctgaatgagaacaatgtggtacagtaagttggaaaaataatacaattaaattattatattttacttgattactttgttaagcagtagaaattgtgggggtagattatgggatttgtttgaaggatatgatacatttccccaaatgaaaacatccgtccgcattgatgttttccattagtcatcttcagagatgtgaatttaacttaaaacaattcacactactctgatgatgattacttttaaaatgatgtttgcattagttaagtcagagacatcatgagaaatgggagtaaaaacagatggccatgatgatgcatttgtactttgaatgtttaaagcagcccctggtgtttgcacagggattgagagcagagtagaaactaaaattgtcacaggttattaacgtgcctgacttggagagtcaaccaaaaccttgagtaagtctcatagaaactgcaacattatcacgtttcatatgattgacataatgtgcactctcctattattctgcagggctgtcaagtaagcagtgagaactcaatcccttttttttatatttaaggaaagtttttagaatcataaaacatattggaaaagatcatgcttttgttta

SEQ ID NO: 111945 - DNA, 1050 bp, Homo sapiens
agttgagaattaatatgctggaatgaatgtacagtttaacaagttgctgttgtttgaaggttttctgtggacctaagaaatgaaagtgtctttgaaagaatgctgcataccactttgacatctgcaatccagtatgaaatatttattaagttatcaagctaaggaaattatggacatattttctggtgtgttttctgaggtggtgaagttctccaaaatacttggaaaaatatttgaggaggaggaacgttcagttccaaaatactttctcctttggggagagtggatttgacagtgcgtgcaatacatagcactcttatatctgacccctgatgagggttcccatcatacctattagtctttgtgagactctcttgaatgaaacagaattgaccaaatgaaagatcttattttatataattatctttttggagtccaaagagggaaagagggattggagaaggagggagagaggaaggaagggaaggaggaaagcagagagggacagatacatgtttgacaccaatttcattatgaaccatagcatcttagaaatgaaaggagcagggtttatcttgttcagcctctgtctcattacgggaatcctcctttgagcttttctgacagatggctatgcagtctttgcttaaatagtttaaatattttcattgataggcagctcattcctttgtaggttgttatttgcatttcagcaagttctaataattagactgcaacgggcaaaacctgccttcttttagttattggtcttttggagcaatatagaataatactgctgccccactgtgattttttaagatagctttcacattttcttttaaatatttagggctttttaaggttaaaatttaaaatttctttaatcactctttatttaagctcttggcattctgattttttttttctggatactccctatacagtgtctctttagaaacttctttttaaaattgaggcttagcaaacatataaaagcatgcagctgttaaatgtgcaggtccataaattactgcaaaatgaacaaaccat

SEQ ID NO: 111946 - DNA, 1034 bp, Homo sapiens
catctttatgaacatctagtatcattaaattgaagtcgtattaactttttggttggcagagtaccatttagtgaatgccaaccaaactagaatttgctaacatgtaaaatgtggaataccctttgtctaacctgaaataaacaaaatatgaatagtaaaatgaaattaatattatgtatttcactgagatcattataaatcatctcttattatgctgtctcccagagaaatataatgtaatatgattacttatcaaataattgcagttttcttaaaacaggcactcattctagctttgtaaagtaatcaagctttataagtaatatggttttattaagttatataattcttaaaattataaggtagaaatgaatttagtgcagtttacagaaaattttcatttatgacatttcagatataattccagcttatctggaatttaatacaggtacaactaaacagaagatagcagaaattgcaattgtcatatgcaacttttcccatagaaagtgtctcatgagagagagataccccacagaatactgaatctgtaacaaaaccttcctatcacaaattagatttaaaatctacttttgccttctctcttccttcttgctatagctgtcttataactaacagactctcccacattacttcctttactcctaaccaaaataaacaataaagagaatagacttaaattttaatttttgttcaaatatagcattttattaaaatttaagataacttctccaaaacaaaatgggtcacagttttaatatatgttagtgactgctatgttctctttattctctgtgttttatccttggaattaaaattaataagagaaacataaagataaagtgaatggatttattttattattttacatgatcacttaccttttcacagcagtccttagattcctcccaggtgttacaccaggaatttggtagaaagcagatttttatgacccatgtaagtactgaaagtggtagctggcatttatttttcagttagtattctaaaaatca

SEQ ID NO: 111947 - DNA, 1045 bp, Homo sapiens
ataatgtacagtaaaaggagaagtgatagacatgcaatttttttcctgtgaaatgccctgactttggaaagaaatggttgtcaatgcctgtgcatttccttgacagattatgccagactgcacaatggcagcatttgtctttggtctgtggacctaagacagttgctatcggtggaacctttttctgtacaggtaataacaaggtggtcagtcatgcaacccaaagatcgagtttaaagttaaaattaaagaggaattcccagcactatagcatttcattttatgtaaggctctccaccagccaaactcgtttacttgtcatagctacccaaatgagaatacaaggttgacatgaaagatgcaaacatgtaaggtagtctcattccatagaaaaggacctaacagaaacactagaacaaacctattagatgacttaaaagaataataaaaagagtaattaacaaaagcatataacctctatcatgtccttcaaaaactaacatgtgcaaacagtagttcaacttgaggtcacgttgccttgcttccaactcttcactagagaagcctcatttaaagtcagtacaatctctgtatttcttttgtcacacaaagttgactatcctaaaatatttaatttaaaatatcctggttgatttctagcaataaagaaaatattttttattaactttctacatgtaattagcattttatgtgagagaaaatttggtggctacaggaaatcttcaagtgttcagagttcaaggagatccagctcatcaaatccttttttattgacagatgagaaactgagactcagaaagcctcattgccagagtcacacagagagtaggaacatggctggtagaccagaaacaagtaacttcaacttcctgctgcaggcccttttcacagtgccatcctgatccccctacttggagaacttttattcagttttagtaatggggtgtggaagggagctaatttatgccaacgggctccaatttgagaacattttcttcaacatttgaagattatgatgcacttt

SEQ ID NO: 111948 - DNA, 1055 bp, Homo sapiens
tattaaggcccaggcaaggaaaacctaattgtgaaatctctcccatagtccaccagtctactatacactctcagccatgaagtgaaattcaagaacaaggttattaattgaaggatgtaaaagagaagcctgccccttttggatctaggaggttattgaaatgggttgcagactgcagaaaggaatggagagctcagtgtcaaggatcatgttttcaagtctcctctcttctcctgggccaaccctaaggaggttgtatggtagccttggaagtatctaggggcttagtggaggcaaggcaagggaagaaggcttttagtcttcttttgaagaacattgttctcaggttgtgtctgtaccaattcaactctaaaattttataagaagtgtaatatttgtcaactcagcatgatagtgttttaatctgatccccccactaatccttgtaactgttattgttttgaaaaatagcccctctctctattgaatatgtactatatgtatcccctcctgtgacagaggaaatctcattgtgaattctgcatatgcatatgtctgttaatgttccatccattaggagattgatgatgtggaagtttaacgaaggatgaaagacaagctgtacccaggtgtgcagaaaggaatgagtcaggtacacaagagaaatcactagaagttagtgccagaggcaaaaaaaaaaactgagaaatcaatgaagaaaagaagttggaaagcctgtagaactgcaaagtttgggactaaaatgctgggaacttgggcatgagaggacatttctacttaggcatcagaaccagaattagctacccacttctttagttgcccaggaacctagagatgaagcagcagaaagacagaaatatttctaaagtgttaaaagaaaaaaaggagaagcataaaaacagaatcaaatttgaaaagaatgtaatgtggcataggcttagccaaaagtaatttaacagatggcaaaatgtataagatgcataatgtgatcctgagcagtgactatcaaatattctgtaaagtcttctaagccc

SEQ ID NO: 111949 - DNA, 1049 bp, Homo sapiens
atgcataccacattttttttttttgtaacaaccttactcttacttccatcacatagataagggaacaagtacttaaaaggttaagtctctttccccaaagtcacatttttactgcttaggtaggctagatcttacaccctttattataagaccaaagactgcatttaatgcctattcctcttagatttcacttttcaagtttcattctatcattctcacccattaggcctccttccagtcttgtttctgtcatcccacatattaaaacttcttcctagctcttgagacctgccattcgataatacctccagtgacatcatcctgattatagataaaatgatgaacagattggtaccaagcacggaaccctgaggtctttttccatgaagcttccaatttgctatatcaattcatcattcaacattctgtaagggtcattgattaattgatcatgtattacctctcattaatcccatttttcttcacctggtccacagattttgttaagttctttctgcttttcttctataacacctctatctccaagataagaatgaatttactattccatggactgatgtggtgatggtggtgggaaggggaaagttatgcagaatacaatgtaaatgtgaattctttataaataattattgatttgcaaagctctaaaacatctcagaaggcatccccatacgttctcctctgtacaggtgggttaattaatttattcagttcttaaatctctaaaggttcttatgcttcttgttaacaaaatctagtgccagatatgtgaattttcataatgtcaaaagttctgcataagttccttttggttatttaatctaatattttcttattctgtcatttccaagggatgtttaacaggggagtctgatatttattttataacataaaacttacaagtatacctggaaaatatctatcttctttcactaacctattatggatccattgatgacaaatttaataaaatatctcttgcacatatttattttttagtttaactctttaagttggtgtgttccata

SEQ ID NO: 111950 - DNA, 1096 bp, Homo sapiens
ataggatgtttagcctattctatcaagaaattgtagaatgagatggcaaataggtatgacaatagccagataaaaggagattacttaaaaataatttttaaaaatttaaataaaatgggatagatttaatatctacagactgaatttatacaaagccagaagaggggtaggagaggcataaacaaaaatcacaatgaaaactaataaatactaatgatttactaatagaaaaacatgtttattttgtgccagccactgttctaagcacttacatgcattatctttatagatcctcagaaccaagcaagattggtactagaagagaaagcatgaggtgtaagaggctaagctggagcgggtggccttgaaccaagtactgtctggtacccaagttcatatttttaagcactgtgctattttgccttccatactttgaataaaaaggttaatggataaggatcataaaaacattagtgggggttagaattgagaacacaaatggaaaaatcaagagcataaaatagttgaggatatggtttaagaatcattggattgggttagaaaggaagatattgagtaagaggatatagaaaacagatttctcatagctcttcccttgtggaaataaaaatgacattattggtattaaaaatatctgaattcaaacattcagttatcaaacaccaatcatcaaacaagtttaattacttactttttcaaaaatagctaaatgtgttggttttgttgagaaagtgctaagactcttttggcaaggagtgatatttaaaagtaataatcctttgaaagtgatatttaaaagtaataatcctttttttcttattcagagcctactcagatgtaagtccatttatctacactggttttaggcatgaaatccagtgagatttactggtgtctctattatttttcccacaaaagtttgagtgtggttaatggtgtaattgttagcagaaactttcttcttacagcagtgttggtgggctttaaaatctcttgcacttatcttttttccttcttgcttttagcactgcagtattttcttgatggaaaaaaatccctattgattcataccagg

SEQ ID NO: 111951 - DNA, 1035 bp, Homo sapiens
tatcaaatactagatagtacagaatgtttaaatgttaatagtaatgaacttacacaaggtaaataaatcaattatttgaaagtaacatgagatgaaatgaggtcaaatgcacaaaaagagagactggcctcggacagaagcatggatatcccagccattataacaggatgaaaggaagaacacagatctaggtgcagatggatcagcacatctgatgggcggaagacacagtggctctgttctgattgtttgtatttccagagagaaaataattgaatgtgagaaagggtgttcgtgaaagtttgatgagagagaagatatgtaaaaaaaattgggagcgtgggcgtttatggtcattaatttttactgagaccagtcatcatagtttctttttctagccaaactcagctgttgctatgaaaaaaaaaaaaaaaaaaaaaaaaaaacagaaaaggaaaattgggttgaaacggtatcagaattttctaaactagatagaaggatgtgtgcaagaaatttgaagtgctaaacaactgaacaattctgatgctacactgtggaatctaaatttaataaagagaaaaaatgagcaaataaagaagacaagcatactaaaatacgatggtttaatggattagtgactccaaagagccgaaaggattattggattgaatatgttagctagaaagacaagtgatggaggtcagaaaacagtggataaagacaagattttggaattgtgcagtcaaagaaagaatagatatttgttttagaaatttagaaaatataaacaaaatcaacttatggaaagcatatatattatatgcatacacatttgtgtacatgggtgtgtttctgaagttagtatttttcattgatctatattcatcactgtaccaatgatatatgatgtaattattgtagctattttgtctaatagtgcaagttctactgtttatttctcctttataaatcatcttattcttttttatcttattttctttttatttatttatttatttttattattatact

SEQ ID NO: 111952 - DNA, 1046 bp, Homo sapiens
ttcaggttttggcttgttaaatcagtgcttggataactactgccatctttaagatgttttcattttgctcatgattcacagataaaaaaattacttttaagaatatgtagatagtgcaaaatacatttgagacttttattattgaaatcctttgactacacagatatgttcacttttagaaatgaaaacacctcattcctttatagatcttttcactgaagaaataggggcacatcaacatggtatgaacataaagggagaagggctgttgctgaatagaaatgctattcatgtttcttaacagtagcagtacagcttcaaaacaaaaacaaaaaatcaacctgccaattttactgtatgtgttaatgaacttactcgacataaagccatgtattcaatactgtaaattcatattgagctctgccttaaggatgtttttagtaagaaagggagggaggaaacataggaaggaaagaaagataaagacacatgtagattttatagaatcaaaatgcttgtactattctaatgttctgtgctatcctttggattgccttcagctgtaaagctcattatttgtcttagattctaatttattttcttccagcgctccatgctgttatcacaatttcttttctcatcatgaaatgacacagaaacacactattcatattgaggaaacaagtgctctgtcaattaaagccattcttccaatatacattcttcctttctctcattatggaaggttcttcatgttatgctttggcatagctgggaaatagaagtgatatatctgttaacaggctccagcttagcttttacttctttacctgaggctcatttaaatgtagctgtcaaattgtcattagatgcacatgcaaattgctgctaaaggattttctcacctcagcatagcaataaagaattttgaatttccttccctgtagggattaatttgtctattccttcttaataggcaacattgtctttgctatatgtaatatagactctgagtgcagagtatagagttgattaataagatatac

SEQ ID NO: 111953 - DNA, 1075 bp, Homo sapiens
ctcataaaagagaaatagtttcatgtattacatttctcataggttataatgaattttaaacaaaacacttgccatccactgcttcaggaaaataacattgtaaaaataataatattaataatagctaacacacagcatttactatgcactagccattgttctaaattccttacctagattaacttatttcattcttgccactgtaaaataataataataattattattatcctcatcgttgatgaggaacttcagacagatagcgtaagtttctcaaggcaacccagctaatagtaagtggcagaggtgatttcagtctacacttttaactggtgtattataatgagaatcataaaatatcttacctgtatactttgtgtgctttatgattgttttattttactaatttatagtatctacacggatttcgattatttgtgtgtgtgttttttaaaattctgcttgatagagggtcgactagaggtgttccaaggggagaaattgctgtcctccatccctatgtggaccacatttggggagcttgccattttatacaattgtacaaggactgcctctgtgaaaggtaataaaagaggaaatgctccatctttgaattgttgtggcatgttaaagataatctagtccagtcacatttgcaccctgatccacagtctgtttcccattttaccctatatgttcttataatagaaatgctatgcctattaagggatttatactgaagcacttacctatataatttaagctaaaaagaacttttctggatacctgtgtataaaatgtaaaatggcttttaactattcacaacggtaaagacatggaatcaatccaaatgaccatcagtgatagactgggtaaagaaaatgtggtatgtatacattatggaatgctacacagccataaaaaggaacaagattatgtcctttgcagggacatagatggagctggaagccattatcctcagcaaactaacacaggaacagaaaagcaaacactgcatgttcttacttataagtgggcgttggacaatgagaacacatggacacagggaggggaa

SEQ ID NO: 111954 - DNA, 1029 bp, Homo sapiens
gaggggagactcctagctctccttcagtcaacaatattagggagatatgaagcacccatagaagccagagaataaaatttgatggcatgatagattctgaatttgaatattcagttcctataattcatgacacagtattctatgattttgctaaggtacctgtgcttagatatatcataagtggtgagtgagcctcttcaattgctaggcaccaccagctcatgccagctttattgtcctgtacccatcaaatatacttttatggtctgaaggtgtaacttaatttgtctaattgtacctccctactttatatggaggagctcataatgaaactctactggcattagggaattctggaaatttgtttctttctaatttcaaggatctgcattttaatttcaggttctagattcagtgctgtccagtagaactttcttcagtgatggaagtattctataatccatgctttacgatatggtagccaatagccaaatatggctattgagcacttgaaatgcagctagtgccactaagaaactggatttttaacttattttcttacaaagaagcttgaatctgatggatttttatttttaattaatttaaacattgaatagtcacatgtctattgcctactctactgaatactgcagttctaatggttttgactgtaactgctattgcctaagatgggaattatgacttagtttgggaaccctttgtagacaaagtgagacctatgttcagttttaggacaacgccacagaaaatgagtctatgcctgtgagattgaggtgggcacaatgtggagtcactcgtcagctgcacccaacctgcagtatatcatagctctttgtagggacctggctttgtgcctactgaccattttagatcatcaaaaccatgcagcatgcagtgggcatgtagcctgtttctataacaggcactcagctttattgaagtattataaatttcatgatgaatcagggtactacaatgtgtcaaatactctgatctctgacttaaatt

SEQ ID NO: 111955 - DNA, 1049 bp, Homo sapiens
tatgggtcaggccaggaggagcccagttatttccacttaactttactgattacaatttggtcatacaaccacaccttagtaagagggaagtgtagtttagacatcatggctaggaggaaaaggagaacccagatattggtatatcctagcagactttaagctagtcagctacatatgcccttagaacattagttgccaggtcatatcgtgcagagcaaatatctgtcaaatgactgacatttgtgagcttgtgagcccactcattggtattatcttcaacatcttcatccagggttgacttaagaccatctgaagttgaagcagtaggcagtacagacgtaggagggtgtttcctgccttcttgatcatgtctctgatagatattttatttctggcatagagtaatgactggctgaaaacattgagtaacttataatcagcagttggtgacagattaatttatttacgattttcctcttacttttctatttcttggaagatttctgagttaatgacagattcacctggccagttaagaaaattcaccctaacaatctgcatgtgtgaccatcaagattgtaagacataaagatagtctgtattactttacttctgactgaagttgaactattagggtatctggggtactaaacactagattatcagacatctactgcagattaaaatgaacttatgacatgtcttctttgcccattaggctttcatggctattagctcctggaggcctgggacttgttttatgcattttgctcctctggcacttaccttgttgtctctgacatggtagatcctcaacatatgttccctgcagtggttctcagagtgtggcctcaggacagccacagtagctagcactacctgtaaacttgttaaacatgtactcttgggcacatcacagacctactgaattaaaaactctgagggtaaagcccagcaacctgtgttttaacaaaccctctagggttctgaaatgtgtggaagtccaagaacccctccttaaaactgaaatggacagatgttaactctgc

SEQ ID NO: 111956 - DNA, 1048 bp, Homo sapiens
tgaataaatgaatgcatgaatgaacaaatgaacaatcacagagatttccttatagtcattacccagtaggaactatgtgtcaagactctaccaatggtttataacttttgtgtttacacaagtggataatgtgtcccctcacactggcaaacacaccagctactcagtcccaagagaaactcagctcttatttatgacagagccctgcctgagagcagaggtgatgtccaaaagtcccaatggtattccacatatgctgctgtctctgcccagcctgcctcccttttcctgccaagtcctatatcttttccaagccggagatggccagactgattttgaatgctctaagtataatgagaaacttgggagattctcacttctgaatttggagatcctcattcatagctgtttttatctgctcttacaagaggcttgtgaatgaattggggtggataattgggatgtagcccctcttaaggctgtcaccccaatgacagcatcactccctcacaaagctaaccatatttagaaacagcttatttatattgccatatctaaaaccctttttgggggctcatttccagatcttgtcttagtaaccttagaagcaaaggagtagtctcaccaagtctacaaacatttagggtgacttatattttggctcagcctgataatcccccaactcctcttaaaggaaagatgaccaagatgccagcagaccaggtgtccccagtaccttgatttccccttgatttatgcaataatgccatgggagcacactgtggaaaataacccctccaaaaatattcatgttctattgatcacttaaaatatgttttcttaggctaaagtggtattttgtttctaattttatagtgtttatattcacaaagcttgctagaatttccagtatggccctttagttaagttcctgtagcaccatattactaataaccaacatggaagcagaatagaaaatgacagggaattttctaataatattcaggagaattttcttttatctttatatcattagccattttgagat

SEQ ID NO: 111957 - DNA, 1043 bp, Homo sapiens
agtgagctttttcctagttactgttattactcatctctcaataggtcctataaagatcagttaagcagatggaatctaaatgaatgagtttagaggtttgtggggaaagttgatcaataggtttaaaaataattccttgtttcctggctctgggtcattttctccttcttttatacgtagctcaacagagcaaaatctctactggtttttgacaggaagaggctgtgtgattttttcagtgtattggtggtttccaagcttggttatgtaagaaaaattatctcaagatgtttgataaaattctcaaagctgaatttgaatgttgaaggtaaacatgtcacatctagcttttgaggaggtggaatggagtctccttcagaaatattaccagaaagggagaccattctgcttgctgtctgcctgccatacttcttaagggtgtgaaggaagcaacttctgttttaaagattcactggaaaaacagctacaattttattataaagtacatataaaatataaatttaatgctactaggaaatatagtatttttcctcttaactgtaattataccctgtattgtacacagaatatcctgtctgacgtgggaatgattaattttatctgtcaattttgctgggcccccatgcccatatatttggtcaaacactactctggatgtttctgtgagggtgcttttgaataagatcaacatttaaattaatggggctttgagtaaagcagatggccttccataatgtgggtgggccttatccaagcagtgaagactggagtagaacaaaagactgacttctcccaaacaggagggaattctagagcagatggcctttgggcttgaactgcaatattagctcctccctgggactccagcaggatggcctcccttgcagattctggacttaccagcctcaataatagattaaccaattaatgaaataaatccctctctctctttctctctctctctctctctatacacacacacacacacacacacacacacacacacacacacacacactcct

SEQ ID NO: 111958 - DNA, 1030 bp, Homo sapiens
attaattaatacatattgatggcctctcatggattatttggaagataaaagacaaatgactccctgtcataaatgcgctcatggtttactttaggggagatgaggctacttggatcaatgaatcacaatagggtaaactctataataaatgtataaataaaatgctttgatagcagagaaaaggttgtgaataaccctccctgggagagccactaacttgttctacctgtttcatttaaactcttactgggacaccatctaaatgcattcctggtttactgaataggttttggctgcttggtggactatttatattctgagtcaggggcttgagggaggtcttcttaaagacttgcctgccccatggaaatgagtggaataagtcaccaagttgctaatgctttaaatattgtcacaaaaggtcttgagctctgtcctgctctgtttggggttgagcctaaatttaatgctcttttaaaaccacagaccatgcagactgcctacatatgttgaaaaaaaaaatagtgctgctggtgtagaactgcaagataagcagagaacccagtaaatgactcagtgggagttttcctcaagggaaggataaagaaacgagtgcactgtttttttggcaaaggaaactggtgcttaacatgattattgtaactctgggcacttagcttttcccactggggagatcaaaagtgataaaggcagagctgctcttccaaagctgaaccttcatgagctcaagtgtccaactgagatgtcaaaatggccaatatctctagcacagagagcccttcaattaattagccctttgggctggcagcttgccacaaaagcacctgaacagagttgcctgtggaaagaactgcagagggcccttgccagcgacctgctgcttccccaaatcctgccacaagcatccacctgtctccatgggaaagacaggtgccatgtccttttgatgaggaatctgtttccacttggtgttctttgcaaagatgttcctggcaaagtattttcttcc

SEQ ID NO: 111959 - DNA, 1048 bp, Homo sapiens
aaaacaagtttcaagaatatgacctttgtagtctctggttcagggatatattggaaacagtaataattagcagtacaacccccccttccccacacatacaccttaaaaaagctattttaagctaccaataaaacacaggtttttctcatagcaattccagacagccaaatagtttaaagggggaacagaaataagagtcttgctaatcttgcaaactgtgcatgcaaagggcatttaataatagtactttttcttgcatttttttttgttgttgttgtgagcaaatgctgcaaactaccaagttcagctgtgtaatcactaacttgatttcactcatttctttgttaagtactaaagatattatggtgtgcttttggctgtaaattgtctttcccttgtgattctagagtttttctgcttggttgctatattattgagcttcaagggcactgtagcaactttttctccttccttttacctattttcctttcagattttccagaatcttacataatcaagactgggcagtagttattaaagtatgtgcacgtatacacatgcatgcatttaattttacataatgtattctggagggtgagctttcatagagatacagtcattcctcagtattggttgcaggacctctgtagatatcaaaattcactgaggttcaagttccacagtccaccctgaggaaaccatggctatgaaaattgatctttagaatccaggggttctacatccctcaaatactgtgttttcaatctactgttgatggaatctgtggatgcagaacccttattttcttagtctacagcaaaatgtgctagatgtgaaaagaagcagaaaaaaacgtaaaagatgagtcagtatgagaaatggagcagagttcgtgtaaattagatctctgtaatggccggcaactctttttcataaaagtggagtaatcagaatacttaatttacctcagttaagagtgatcactctggctattgttgctcaaaatggcaccaaatcactctacaattgagctaattgcaacctctga

SEQ ID NO: 111960 - DNA, 1198 bp, Homo sapiens
aaaacataatcacattcaacccttgctgttttgaactctggagtaactttagagaacacactattttaattaacacttatttataaaagttaaggtcaaaattccagtttgttataattcaattatagaaggaaatcagggatttcttttataaggttttcttctgctgctcctgcctcttttgagtatgtgtgtgtatgtgggagtcaaggttagccttgttagttaggctatttttatttaaatatgttgaagtctacaataaaacattacacagacgttccccaagttgcgggcatgatggcttcaaggttacttcgtggagctggagcactggctgcgaaggccctgagggcctgtggtcccaatggggtggccgtggtgtgctccatggcatctggaggtggtgttcctattgatgatgagcacacgactggattggagatggaggtcatgatggttgcagggaagggactggacctatacagtatatgacccccaaaggcagcttcaggcaccaaggaagaccctaatttagtttcctccatcaccaacaagagtatagtgggctgcatctgtgaagaggacaactgtgctgtcatctggttttggctgcacaaaggcgagacccagcagcaatgccctagctgtggaacccattataagctgctgccccactaggtggcccactgagcccatgcactaagttactcaaaatgtgctgtaaagtttttctttccaactaagactagctgttgtattggctgatataccagatcaggctgtataacttatctgtgaatgcttcttgtatatgtggtgccagttacaacataataactcctcctctaccttccccactgccaagctattctgctctcctttccttcttgccattcattagttccagagagcaatcttggggttcttggacactaatgccagctaaagtctgacttaggcaaatttctgacctacttacctcttctccatgactttccttctttcttttgaggcagttattcatgtagaatagttttcattgccttatctttcctttctttttgaatttttgctcaattttttgagaaaagctagttttttcccttttcattttctccccatttctgcattttccaagctaggggacaggtgaaaataggcaatagtccatctctggtgagagctggcctgggcc

SEQ ID NO: 111961 - DNA, 2003 bp, Homo sapiens
cagtatagttaagagattggctaaggcagtaaataaaacttagaaatgctcaaatttattgtaaattgcttttataatcattgatatataaagcatgctactgctaatcaattagttttatgtattaagacctatcagcatgtcttttttttagtatctggttgacttaaacatgatgttctctgtaccatttaacattttcaagacatattctccccaagcaaattctgttggaaccaagtgtttccagttctagaagtttacttctagagtcttcatatgaaatttacagttgggctttcatagggttttaatttgcactgaatccttccttctgaaagatgacttatgtttaaagtataatgtagcagtgcttttgtcttacaattaaactcttacagcactcatgcattttttgcactgtctgttttttttgacttaagcttttttctcttgaatgaatacctttaacatagaacttattagttgaaaaggtaaggcaactactggaatgttaacacatcacataaaatttttaaatgatgggattgtttggaaagttagcttatgctaaggagcaatttccagctttcttcggaatgtttatgaggcagggtattgagggcaggaagattttttggggatgttcaatctttgtaatctgctgggcttgctatcaaatgtgagaccactacaagtgctggtaggcatttaccattttatgttacaacatttttggaaaatggtaaattgaatttgatggctaagagcaataatgttagcaaaagtactcattataaatgcactattatttcactattccacttttacttttatgtctcaagaactgttaaaggaatgcgggtcacttagtgctggtctgttaagagagaagtcaccattatgttgggtcatgatgtggtgctaagcaggtctgctcctcaacaaacgacctctttgtctgtaaccagcttgtgatttgcctttttgttctaaaaaatcggaggccggccgggcacggtggctcacgcctgtaatcccagcactttgggaggctgaggtgggtggatcacctgaggtcaggagttctagaccagcctggccaacatggtgaaaccccatctcaactgaaaaaaaaaaaaaaaaaaaaaaaaattagctgggcgtggtggcaggtgccggtaatcccagttacttggggggccaaggcaggagaatcacttgaacccgggaggcggaggttgcagtgagccaaaatcgcgccatcgcactccagcctgagggaaaagagtgagacttcgtaaaaataaatacataaataaatcagaggccagaatttaatggtttttgttattctaggttctgccatgattctgtgagattctctgagaggccttgatcctatagtgggataatataaactttcaaaacaacttaaaataatcctttttagacttattaaaatatgtggggcattctatttagcagatttttaaaagtttctagtttaatacattcagtggaatagattatttcaaatgaatgcttttgtggcccagctctgtcatttgcccagtgatattgggtaaattaaccatctccaagcctcagtttttccaagtgtaaaattatattacctttcttaggaatggacattaaatgatagtcatgtaaaagtgcttgaggttagcagttctcggcctcattgtgaggttaaacaaacattttgaggccccatcccaggcttatgcagaatcctcaggggtggagccgaggaacatgtattattaagatcattaggtgactctgatgctgagaattgaaaaccaaagcttcacatttgttgatattaaccatgtttaagagctatggaaatcatgcatctgaaaataccaaatgttaatacttacatgtgctgggcatactgaatacaaagaggagtgtgatgtggccaggctcgggagtagagacagccatcaaccatgatagaaggagtacccttt

SEQ ID NO: 111962 - DNA, 1037 bp, Homo sapiens
agacggggtttcaccatatgaccagcctggtctcaaactcctgagctcaggtgatccgtccacctcagcctcccaaagtgctgggattacaggtgtgagcaattgcacccggcctaatttttgaaattttttgtagagatggggtcttactgtgttgctcaggctggtctccaactcctgtgctcaagtgatctgcctgcctcggcctcctgaagtgctgggattacaggcgtgagccactgtgcccagcctaagatacctacttttgatagggttgagaagggtatatcctttctttaatactagccatattcaaactgttactaggcatagttaggagtcgcctgaaaatttccatgggtaaaatgattctagcaagataaatattcagttgtgcaaatggagtccgcttgtcctgttagttggtaacagttgcttttaatctggtaaattgggtaagggttgattataagctggttggcatttcaaagaggcttgtaggcatctatatcagaatcacttagaattgtttgggagtgttgcctgggattctgtatttcacatacaccatgtgattttttttttttttttttttttttttgagacggagtctcactctgttgcccacactggagtgcagtggcacgatctcagctcactgcaatctctgcctcccgggttcaagtgattctcctgcctcagcctcccaagtagttgggattacaggctcctaccaccatgcctggctaatttttgtatttttagtagagacagggtttcaccatgttggccaggctggtcttgaactcctgacctcaggtgatccgcctgcctcggcctccctgtgtgctgggattacaggcgtgagtcaccgcccctggcctccaagtgatcttaattgcatactaatgtgttaaggactttaatgtgttaactctttaagatagagttaaacacactgtttcctaagggtttgtttttacatcttctgtaaaaacaaaggtatatgttttactaaaccagcattttagttgtgg

SEQ ID NO: 111963 - DNA, 1025 bp, Homo sapiens
tgtgcggggagggggtaaaaacagattgaattaaaaccaggtttagtgtgactaaaaacatgctaccagattaattttgattgttgtgttaaaatgtttacaagctgcacttttggcagttaattagtactaaatgagagacactacttagatttaattttaaggattaattttggagatcaaacccattcttgaaaaaaacttgtaacccgatttttgtactgttttgtttctgtatgtctgactcatttaaattgcaattctcagagccgtttctagcagtacctcttggcctagataattttctgtccagcagacactgattttcaaacggtaacaagaattgaaaaaagattttttatatacattaatttggtaattagtttcatgtttttcttgatggttttctgtgttctaatctgaactgtttgccctttttgaattgttgagtaactgttgagttggggctttgccattgttctgggtttccctttgcctctcaatttatgatctgtttcctagatctatggctttgttggtttggtgtaggatatcttccaataggttagagaccttcctgtctgtaaagttctattttgcattggattactaagtttagctatgtagagaattcaggtttggtgaagaaatttattttatttgtttttgagacagcatctcactctgttgccaggctggagtgcagtggtgcgatctcagctcactgcaacctctgcctcgtgggttcaagcgattctcctgcctcagcctccttagcagctgggactacaggcctgtgccaccatgcccagctagtttttgtatttttagtagagacggagtttcaccatgttggccaggatggtctcaatctcttgatgctgtgatccgtccgcctcggcctcccaaagtgctgggattacaggtgtgagccaccatgcctggccagaaatttatttattttttttatttttgagacggagttttgcttttgttgcccaggctgtagtgcagtggcatatcgg

SEQ ID NO: 111964 - DNA, 9474 bp, Homo sapiens
cttgaggccaggagttcaagaccagcctggccaacgaggggaaaccccgtctctactaaaaatgcaaaaatcaagtcaggcgtggtggtgcagcctgtaatccctcccacggaggctgaggaatgagaatcacttgaacctgggaggcagaggttgcagtgagctgagattgtgccactgcgctccagcttgggcgacagagtgagactgtctcaaaaactaagcaaccaaaaacagaaaaagatggaatggaattaatatgttccatttagtaaagatggaatagaattggtccagtttgtgttcattgtagcatattcacctatttggtcagcaaccatttttttttttttaaagcctaagcataccctgagaacaacaaccttttttgattagaacagaagaaaaagccagagtgttcttgggctgccaaaatattaatacgtttgtctcaaagacgagccacttaggtgcttgcttagagacttctactttacacagaatttgaaaagtttgacagctggctacttactctgcaaaacggaagggagactttttagaacagcaactggtgatctggcaaaaatgaaaagtagaacttgtgaagaaatgagatggacttggtgtattaatagctaattttagaagaccctgtggatattctaaatcagcataatagtgatgtctgagccatagtgttaaattatgattactgtatttgaagtataagaaggcagaaaagtgtgatgctgttagaaaaaaatctcatttcaaatgattgaaggttaaaaacaattggggaaagattagagagggcaggcggtgctttaagggaggtggaataatacttggctccttattctccaaaagtgctggatagctgaagtttttaatattctggataattgatatttgattattagtttaggagggatagcatcttcagtgaacccttgtagctctaaggtaggcatattaaacaactaccatactaaaggtggggagtacgtttggagagcactttgctgggccagctgatgatatgcttaggtgatatttaagaaaatctgcttcttgtctgaaaaacatttggggcttcagaataataccacatacctcattcttggtgttttaatttatttctttgtaattgttttctgtttcttaataattttaaattaagggtattttcccaatataaacattgctttttggttaaataaaatcaaaactagttctgtctccatatctgaatagaccagacagagaattttcttgcctttcaacagcttaaaaaatgtttttgttagaactgttgtgttcaggctgaaatactttcaaagtttgttagttattattgagaaatttctgtaataatcatggaaagggtaatttaatagttaaatctcaacttaattgaagttatttctgttgtggaacttatggtcatcttagcaagaggtcattgctttatagtcagttctctttctcattaaaaatatagtgtactcacctttacagggtgaatgttggtaaataacttctgtctgtgaaggaagtattctggacctgtaagttaaaaataaggtgtttatagcaaattatgtaaataaagattgtatattagaaggtacacactattcaaattaaagaaaatgtatattgagaaaataactcaaatttcttccatgaaattggcaagaagtaaacatttcaaatacacaaaacattatgggtatttttgttcatttgattataaaatgccaaagttgttttataaatgctacttcaagcctggaaactttgaggaagtcctgaacattaagcatataaatggcccagctctagaatacatgtaagttgaaaagctaacctgaagtgggaagcgcagtatatacctaagacttactctgcactgaaagtttgctttgtcactagaagtaaaacaagactgtggtaggatagtaagatcagtaacacctcagttaatcaggtatcttggaggaagtgaagaaagaccctaattcaagggacagttaattggccttttattccaagaatgggccttagtggcagtatcttaaaagcccacaagatggagatgtttcctaatgaaaggcctttaatttctttatagagctgagttagtgtcacatcccagtccccacccatgacccttccccagttaaaaagaagagaaaatgttgagcaagtctgatttgattcccatggtgacatttttagccattatgtaacaaattctgacagtttacccttaaaattaaaaacctccagtcctgtctttttaaagggtagaaagaaggttaggtataggatagctttttatttatttatttatttatttttgtacaaagggagcctatgtaaagctgccagatctgaactttctggtgttttgctgtaatgttagtaagatttcgccttaaaatattttattttgagtatatacgtttggtcttagagtgtcttggtggatttccgcttaccacccatcactttctgcattttaaaggcttaaatactttattgctggttaactgaggttctactgtaaacgaatcatctaagttaattagtggattgtacttcaatggataattttcactaaattgtttatattgcacattacttttgtcttaaggactcttagcacatcaaaaaaattggctcacaacttaattgtgagatgtagaattttccattttatgtgctaagagttttgttaatgagagaactgttaaaatagaaaaggagcttcagcatagacaccaatgctggttgctgagatcagtggggaactgcatagcattttaacaagtttaatgaacatttggaagagaaatttgaagctaagattctggtttttttgctgttaactttttaatctaaggaaaacttttatgtacagtatttttactttgggtatatgtttatcttttagcaagttgaaagacttaatttgctgcttgctcactattttgtaattatttgggagcagcagtaataagccagctttttggaataggatgttcctgatgtgtggttatgtaggaagaatgatgttttaatatactgcccagtaaactggtgcagtttggaaaaggtgtgttattgatgtggataatatttaaggcaattttttttaagcattttaatactgctttttgtctttacaggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtagtgtgttacgtgttctgatcagttaataatataaaatattaacatatggatagtttgatacaatgagtttgcctatttgtggttccccattttgatagtataggaaggaagaatagttcttgccccaatacgttttatgaagatagaggtaggttcaggaattatttcctgaataatttgtgttccaggctctgctaaattttgaaattaactttaaagatactatagacttaaagatgcctagttaaaaggatgtgttttagcaattcacagaagtccatattttgaaattttgttaggcaagcaacttttaactgaatcattattttgatcctgggctaaagggaagtagcagttatgtttgtatatagtgctaaagggaagtagcagtcatgtttgtatatattgaaggtaatggttatctagtaattggttaaatttgtgtatgtcctaccattcttacctttagatttaaacagtatatgttagttgatgttacatcaccaccatgacttgacagtttaatcttgagcaagtcaacatatgcttggcattatctgtatttatagttatttttaagtaagttaatagtctctgaacttcagttaagatatatattttttaaatgaaaacttcaatttccttaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtatgttataaatgttttgacccagtttatgtcaaaattagtgtgaatgtgattgtcccattatggactcagagtcacttggcttttcaaagctgttagggtagattatgtgatctgttttggaataaggatattgtaaatacttcattagcaggtctttgaaggttggataatgtgtttttctcattgagcacctactctatgcagagtattgctggggtagagtatacaaagatgaaatagacaaacattcttaaatacagacaattaagaggaagaaatctagattagaaggagacttttgttgaaaataggaaaggaattaagaatagggtgtagtgccttatcagttgaaatgcatgtgtaagtgcaaatttaatgagactaatcattatagactcattagtgaggctggacgcgatggctcatgcctgtagtaatcccagcacttgggaggccgaagtgggtggattactggagaccaggagatgaagaccatcctggacaacatagtgggaccccgtctcaattaaaagtaaaacaaacttagactcattagtgaaataggtagataatagaggtttcttttatgaattaatgaaagttgagaaatttgtggccttgggctccagatacgtcccacagacatttattgcttgattgaaacaataagtgcttttttagtgttgaggatttgagatattgcccacaaaactcagtatctagctttttaaaaaatacttgcaagagcacgcaacatgggaactgacgctgccctcctgtacggcagcatctctcaaactgagtagtagcttccatcttggtttgggcatatgctctccagtttttagtagtcctcaccaccctacttcctgttttctctcaaatacatttttattctgtttttcttagatttgactgttttcttcttgttctttgtgggcatttgaatttgtgacccttgagttaggtagtaaatgtcagtgcgtggtaaagcttatttttgtaaatagttgtgaagaccttagatggaatgggtgttctaatttgaagaattccttaaaaggattagaataaatagggagaaacaggagactagaacttcagtgccaaatacatgttttctttgtgtgttttcccccctctaaacttgtgtttcttttaaggtcaataaaatgcatgttagcatattaaaatttgttttttaataccaggtggaatccatagagctccccatggacaacaagaccaataagaggcgtgggttctgctttattacctttaaggaagaagaaccagtgaagaagataatggaaaagaaataccacaatgttggtcttagtaaagtaagttaagcatccatttacttgtagagaaaactagctgttgtaaagagcttaaccatttatctttctctgtaaaggcttaagttctttgcatgctttaaaaacttctcattggttacttaccattgaccaactttttgtggggagcaggatggacacatttgttagtgtttttgtctaggctttcacaaaaatagtttttagaacttgacaagtaaaatgaagtaacatcactagcaagtactcataagtgattactcttaagtactaaatattggtttaattaataaactgactgaggaaagtttcaaattagcctactctatttaaacatgttggctattctggttattagaaacttatttagcaacttttattttcttgagtcagtttaataatgtaatttttctcttttagtgtgaaataaaagtagccatgtcgaaggaacaatatcagcaacagcaacagtggggatctagaggaggatttgcaggaagagctcgtggaagaggtggtggtaagctagagcctaagtttactctatcttaagcttttctgctttttaattatcctgaagtaaagatctttgctgatcttctgactttagtgaacctattaatgtgctgcaggccccagtcaaaactggaaccagggatatagtaactattggaatcaaggctatggcaactatggatataacagccaaggttacggtggttatggaggatatgactacactggttacaacaactactatggatatggtgattatagcagtaagtactatactttttatattaactgctatttgacatttattttgtacaaatttggataggcagaaaggttagtgtagccttgccaagtgcaaatgtcttcaggtttcaaattcctggaaacttgaaactgcagccattttattgcttggttcctcccagcctatatcacacacacattataagggtagggtgtatgtgtggttctatatatgtttgctgggcatttgttttacttggatttaaaaattttaagctcagttcagatcttttaagctcaaggtattctaaatgtcacttcttggaccaaccaataatcttggcatgatgtgtcttaatcctataaaactgaataataccacatgttgccagttaaaactaatagtatcctcgctttaggattattaatgtagaaactcttaaaacagatgttgagcttgatagaaccaaaaaacttgacttttagacatggaaagccctgacttcattgtgcaactaaggtagttgctctccacctgatttgtagcaactgttgagtcgtcaggtaaagggttctactagaagcaatcttacatttttttggaggagagtggttgcattggttgcattgttttaagtggtttttcttttccttccttggttagaccagttcttggagttatatcctttcttaggtgactaggcctgctgcacaataataggttaattaaagtcagaagaaggtcagcaaagatggattgggtgagattggggcccttttcttagaagggcagagatactaagcactgattgtggttgacaatttgttctaaattttaagatattttttgctggtggttgtgaaagggtcagctgtccatcctttgaaacttaaaacttttaaactgtaagggtgaggggattgtctcccattttatacaataagtcaagtaatcagctcattctgaatgcctgccattgtatgcattcactacatatttggtaaattatttgataaatgattgctcagggtgaatttttcacacttgggaattaagctacccttaattttttgagattgtttaaaattaggtactgttctgattattagtatgtaaccactaccgttctggttctaacacttgttttattttagaccagcagagtggttatgggaaggtatccaggcgaggtggtcatcaaaatagctacaaaccatactaaattattccatttgcaacttatccccaacaggtatgttctaaaaatagtttttttttgtcatttacaatagtagtttttataatctatattgttcataaaacaatgcttaatttaagagtttcacagcacccagaagtgcttaccatattataacatagtgactttcaaagatatgtaacacaggtgctcttaagcttttgcctttttgtcctattattaacaagtcagtaaagttaacaggtaaagtactgctaatgggtacaaattaaggaattgcagcaaaaaagtattgcctactaactctgacattataccttgtttgtacccgccagcgggaacttcattgcaggccctgtgtcgcgctgacttcacgattctcacaggcccgctcaatgcggacagggtacgagatgctcacgctctcgaatgctgccgtttggtatggtctcttccaacatcctgtatcagcattataaaataaaatggatacttcaagctttgccttcacttatttctttgctttttaaaaactatttgtaatgtaattttaatgcattttttacaggcccagtaatggttaaatacgtcagcttactgaataattttaactatttattcttctaaggatacagcttgtctctggattttccagtcttaattttatattttattaatctattttaatgcttgcttttcccatttatagacgttgtagcagtaattgcaagaagttcttgagctgaattcctgttgtgacaacttcctataattacagtagataactttttcttttagtcgtatataacttttctataacttgtgatggacaagagatatgcttatccaataaaataagcttaaatattagatgctcttgggtcaaaatgtccttttaccaaattgacctttttatgagttctttgggtaaatactttaaagctttttatattttaaagaatacttgtaaaagcatatcacatcttaaaccagtggtgcacatgtggatttacagctcatggactctactgttcagctttaatttataaaacatatcacacatttaatgttatacagtatttacatatagtggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgctaatagcagttcaaactaaattttttgtatcaagtccctgaatggaagtatgacgttgggtccctctgaagtttaattctgagttctcattaaaagaaatttgctttcattgttttatttcttaattgctatgcttcagaatcaatttgtgttttatgccctttcccccagtattgtagagcaagtcttgtgttaaaagcccagtgtgacagtgtcatgatgtagtagtgtcttactggttttttaataaatccttttgtataaaaatgtattggctcttttatcatcagaataggaaaaattgtcatggattcaagttattaaaagcataagtttggaagacaggcttgccgaaattgaggacatgattaaaattgcagtgaagtttgaaatgtttttagcaaaatctaatttttgccataatgtgtcctccctgtccaaattgggaatgacttaatgtcaatttgtttgttggttgttttaataatacttccttatgtagccattaagatttatatgaatattttcccaaatgcccagtttttgcttaatatgtattgtgctttttagaacaaatctggataaatgtgcaaaagtacccctttgcacagatagttaatgttttatgcttccattaaataaaaaggacttaaaatctgttaattataatagaaatgcggctagttcagagagatttttagagctgtggtggacttcatagatgaattcaagt

SEQ ID NO: 111965 - DNA, 2007 bp, Homo sapiens
cccagcactttgggaggctgacgcaagcgaatcacctgaggtcaggagttcgagaccaacctggccaacatgttgaaaccctgtctctactaaaaatacagaaattagccgggcatgatggtgggcatctgtagtcccatctacttgggaggctgaggcaggagaagagcttgaacccgggaagcagaggttgcagtgagccaagatcgcgccaccgcactccagcctgggcgacaaagcgagactctgtccccctcccaaaaaaactgtcatgtttcatttattagatgtttattttttcaacttcgctttttagtagtcatttagttaggttcattctaaagtgtgaagtaatgagatttaatacagagaagtctctgaaaatgtttggtccattgtatattagtcttgaataaatggaattctttttcacacttaccttgaaaatgtcatctgtagaaagctgggggagaggaatacctattctttaatgatggggaaataataccaaaatttatatttttattgactaaagtgttttttggggaagatttgttattggctaaccttaatgtctcattagttttaaatagttaaaaaaagtgggctgggtgcggtggctcacgcttgtaatatagcactttgggaggctgaggtgggcagattgaacccaggagttccagaccagcctgggcaacatgatgagatcctgtctctacaaaaaaaaaaaaaaaaaaaaaaaattagctgggcctcgtggtgtgcacccatagtctcagctacccaggagcttgagatgggaagattgcttgaacttgggaggcagaggttgaagtgagccaggatcacaccattgcaccacagcctggcaatagagcgagactctgtctcaaaaaagtggttttcatgaattttataccagatcagatctaaaaaggctggttagtatttgaactcgatgaaagcttgtcaagctctctcccaaggtagttttcatacaacttgtaaaataccctaacgtgtgatattatctagttgcattgtaacctcctcccttccccttaggtaactagtgacttagctttagtttgtcattttaggattttagaagaataattatgatggataaaatactggaaaaattcagtaaggatttaatggtgtgcttgagtaacattactttaaaagatgacagtgattggtcatttatgttttatacctgaaatgtatatcaggttgacattctgttgtattttttaaactgtcagaacttgttataaagccatgtatgtaagatcataagttgttaggaagtgtttaaaagttaaaggattggctgggtgtggtggctcatgcctgtaatcctagcactttgggaggctgatcgctatgtccaggagttctgtgactagcctgggtaacagagcaagatctcgtctctaaaaaagtaaaaataatacgaagttatagaacatagaaaaagaatactattccaaaattgggagtgagtataatggctaactttttaccttgaataaggtgtttgacaataaagacttattaggggaggtatcttggaataaaatagttaatattgactgggaatgttaaaaacctagtgacctaaatagtccagagaataagtttattgatggggaaaagccaggattattaaatcggaacattttccaccagccaggattgctccatgtatatttccttttatgttttaaattattctttactaaaattactggcataaatgtagggtagaccaagtcatcaaggtgattttggaagctacatttaaagggtcttagttgaaataccacctaatttttagtttatatatttttttacatggactatttaaaaatttctgggttatttcaagttggcagcattgaaaatattagaatatgtttatataaaactcattgtggccttttccttttaatgttggaaagtttataaagcctatgcagttttaaaaaattaagccattga

SEQ ID NO: 111966 - DNA, 2842 bp, Homo sapiens
cgtatctgtcccttcctctttctcccattttgagggatattataagggcaacagttttatagtctcaatattgagggtaagactggttaatagagtatccaaattgaatttattaaacacagttctgtgtgcatttccttctgcaaatctgagaataaagtgattacagtttcatcctaaaatactttaaaaatcagttggttttagaaataggtttttttccttttgcatgtaagaatggacagctatttttaggaaggcatgcctgttacacctctagtggatgtttctacagtttactatgggactttagaataagtaattatttccatagtatgccctcctgagttcactttgatttactctttcccacattaacatccgtagtttttacttataagcattggaatttctcattttactttgtggtgtggacccattctgttctctgcagtgctgcagttcatttggggtaggtactttaaaattatttagtgtctggcaaaatatacatgccatgtagcaagctctctgagggcagagtttttaaagtttaaaaatcaatggaaactacaatgttgtgttaactttgagatagttttacaaggtaggtacatagactttcctgcattggattgggtaggaagcaaaaaagtccccccattcacttagccaaagtccagcaatgcttctttaataacaggacagtagatattgtcctgttaatggttagtgtataatgagcccaagtgtgattcttcccatttgggaattctgtgaatcctgctgtaggttgttgcctgtctgattataaaagactaggctcatgtttttgctttaaatgtttgagattatggtcttataccttagtgcttctggggcaatctgaacattgtttgctttgtaaaataatttcttttagagtagtctcatgccaaatttactggcctttgattcagtacagttgggtttactgtatgtagtaaagttgagaccctgcgtagattggtctcagtgttagcattcttgggagcctttgacaaatttcccgagttaaaaattccagaaattgatgtccccagatctttagatgaacatttaagcgaagagtattaaatacttctcactgtaaattttcatctattatgaaagatactaaaaataatctcgttttttaagtttggaattgggagaatgtcattgaagtttttcagtgcttgtttttgagatacacatactttgccttaaatctggggttttttcccttaagccatgtgaccctttctacaaactcagtgtatgtttttaatatttcctgggtactctgctatcgtcctaatacataatattagggtaaggctgccctaatacgagaacattttgagtatactattgagtatacatttgagtatacatattgagtatactatttatgccaacgtgaaggatgtgattagttttagccttcaagtcataatacataccatgcttgaaagcatttaaaaaggaatagagtaattttttttcccattccacttggaagctgtgtacctcaagtgtgtgcacatttacaaatgggtgaaacataacttatgttagtccaagcttgatttgacttcagttctgcttcaacgttttagtagatagggcactgaactggatgctgaaagcgtgggatctctttctgttgcttcacttccaacagtgtggtttcaggtaatacgacatgtttgttacttggtttgctgatctatgtgttggaaacaatgctcaccacaggaggattgactacatagcctgctttcatagcttgtgtgtatttatccagtgccctaatagttgatactgccagtgatttactcctgtggagtaaaggtaagcatgttttagtttctggagtattatattgtacgttggagctaggtatttaagaatatttgggggtggggagggaagactccaatttactggtggtgcttggccagtaatcaaggtgacagtttaagtattgggtcttgcactgtaaactcctgcttatctagacttcagactaccacagagcccacacagccaggaagtctgtctccccatttagtcttatgagcaagatagatgaagccatgagaaaatatactcaaaaagcaaccaacagacaatgtcatggaatgaatctcctacagatttttccttacacttttgaaaagtaacatgattttaaaacgttggaaaattcatcaaggtacaaatcattttctgacttcagcattgatacctaaattgatttccagtacacagttttatagaattgtgaatatgtagtaatctcagttaaccagaaccttaaccttcaggttaaggaaaatacctattccttaacctctaggtaaatgggagtttaccttacaaagctgattgagagcttatttaaaacgtaaacatacaagatgtcattgcttccttgtagtgaagtgaaaaggaggtattggattaagcatttaaagttaattaaagtagtggctcgtgcctgtaatcactggctactcagaagtcttgaggtatgaggatcatttcatgccaggatttctagaccagctaggcaacataatatgacccctgtttctttaaaaaaaaaaaaaaaaaaaaggctagtgtgttggggggtgtgtttgtagttgtagttacatctactcaggaggcagaggcaggagaatgtgttgagcccaggaaggagctcagggctgcaggaagctatgatggagccactgcattttgatagtgagacctggtctcttaaagtgttttatttttaggccaggcgtagtggctcacacctgtaatctca

SEQ ID NO: 111967 - DNA, 2975 bp, Homo sapiens
gatagtcaggcccaactagtccccctccccctctttattcccccgccattaggcctggttcccgctctcagcccgttctccgggcccccatgcagcctccttgcactggtctccctttttctatgttgggttccccggaccttcatttccttcttcctttgcctgcttatcgcccccctcccccatcacacacgtttccacctttagccgtcaccatgctgctcctcggcccgccctcctttcctccctcgccatgggtctcctcccaccgacttagccgccaggattttttcccgcctgtcgtggggtaccttttttctttccatgctgtcccctctttttccctttttctacagtcttgggcataaaaacacagacacaaacagcttctctgtttgtattactaaggtttatttggtgcttctccaccatcctgaaacgatgcgattgtttataagcacatgttttggggaacgcgtaggctgtccacctctgcctctcccttgtcggccttaggccgactgttttcttgggattttgaataagtttcgcctaaggatttactcattttctccaccatacgctatcgcacaatggcatactcatacaggccctacattttgacatgcagaccaaattgggtctggtgaaatgctccgagtttcttgttggtacattggttttgctccgcgggctctggttaagttcttagtcgatcgggcctgcacttgactggagctgttcctatctccggcctagcatctacccttcccccaccccactgagttattctaaccgcgcacccttttcgcgccctcagctattgggttccccaactgttagtacagattgtaccttactttttatgtgcaacctaattttttacaacccccagccccctttttttcccggtgcccaggatcctattttggtgtcttgatatctgtttcccgcccactaagggaggcctgtagtcctcttaagagaaacaaatcctgtattgtgctatgggatactttttttttctttttggtgcaaatttcttagtattaacttgcttcctccaattgaaataacagttgtatatactacctaaatctgcatttagtgtattaaaatgcagcatttgggattgggaacataatacgggagttagcaggagggactaaatcaggtttcttggttgagttttcttagctccgattactgaccgatgatcgtgggttcacgcttccattcctttttgtaatggggaggggtgtgtgtgtgtctgaatttttttttaactgtaaagagaaaggtgttggtggatataacaagatgtcgctttaatctagtattagaaaacacgatttcctttactgagaaagagcccaggatttggagggaaagttgggaggggagaagcactttggaatatagggtttattaagcccagcctaggcagattcttgtcaggctgtttgatgatagtgctggttttgggggagtggtggtgggaagggaagcaaacttttaaaaattaaacagaaccaactcgaattgtatatagcttatttgagaaaggaagatgttagatatttggaaacttaaaacctttaacattttggttttcgtttgctgaattctgttctttggacagaggcaccaaaatgattaattgtataacttcctgtttggggcaggctttctgttagccctgataattcaaatcgcaaagcagctgactttatagttacctactgttgaagtgtaaatgaattaaagtttttaaccctaacagtgtcaaaaactaaaactagaattttgattggttgctgtaccggttgttaattccctagccattcaaactcctccccacgacactctgaagcagcgacggcacagcgggaagaatggtaaaacttttaaattttatttctgtattataaaggtttcagtagtcataatatgtagaggctgtgtattggttagttgcccattgatccccaggaaattctagaccatagtacatacagtaggtttgtacctgggatatataccttttataggcatcatgtgtaatctttgggcaaaattgatgccgttacatggtatttggtctgtggtaatgcatgtagttgcagtttggcaatttaagctaaacaattagtaacgatatttttatatcgagcaagaaaaaatattaccgtaatcttcacatttgatttattttaagatgaaaaatatttttgttggaatttaagtttaatggctaaatatgaagactccttgatataaaatattgtgtttaaaatgtcatgcatgttatactgaaatattctggagatgtctgaagcagttctttaagcagcactgtgtattatggaaaaatgtttgtcttttacctagcatatttgtaaatagacctttaataagaagtgtgtgtgtgtgtgtgtgtgtgtatatatataccattaaaaggtgggctaatgtggctttccactacagctcttaccagattttttattttcagtgtgatttggctggaatattaataacagttggttgacatgtattcacaattgcatgacttctctttggaggctggtaggttgagtattgttctttttatccatcctttcccctcccctaaatgtcagtctttctgcttttaggattatatttgaattttcaggggtttatacaccaccactggagagtagaaggccactaacttgcaggcagttaacttatatctttacaagctacattctattttaagagcctatttagggtaacatttaaagatttgcttatcactgtattctcatccactgaaatcagtccagctttaccttggagaaaaagcagatgggaaacaggcaaggggaaaagcaaaaaagaggaaaaaaaaaagactggggtcacagtttcgatgaatgttattccctgtatttggtgagtggtgggcactagcagctcaatttcactgc

SEQ ID NO: 111968 - DNA, 1164 bp, Homo sapiens
taaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaacaaaatccaaacttttaatcaagtcttgatatgtatgactgagaaaaaatacactacatctagagatgattgagatgttttgcaaagaattgaagggggagtgagaattggtttttcttgcaggggctttgaactctagatttgggctttgaactctagatttaattcagatttcagggtctatcagttcaccaactgatgcaaatttgaacagatactctaaggctaagtgtcctaggttggatgaactgaagctactatcaagatctcgttcccaaggattaatttagaacaaagtaattggacaagtttattggggaggggatagaaatgaattctaaagtacctataacaaatactctgtgtatgttttttacatcgtatttgccttttacattgtttagaccaaattctgtgtgatgttatcctcgggaagaggatagaaattaattctaaagtacctataa

SEQ ID NO: 111969 - DNA, 5733 bp, Homo sapiens
ctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacgggtaccgcacgcttcttcccccgctccccctcccccagcgcgccgcacgcgcccttcgttcctcgtgagccgcgcgctgcccccattctttctcagagtcgattccccgcgtgccttctgggccccactagattggagggaagaggaaagtaagagatcgagggggtgactggagagacccgggaagagtgggggaagggcggaggggttggaggaggagggcggcggcgtctgtgtcccgagcgcgcaggcgccgcgtgggacccgggggggaggggccggcctcccagcgctgcacgctgcagctgccgccgcctcttcattgtgtctctgttaccactcggcgcggttttcctgggaagagttttagaggactgagttggggcacaagcaggcgactggtacccagattcacaaaacgtgttatgattgatgagttctctgggtggaacgttggcttgacagctgagaacgaagatggacctaagtaagataagatgtgagggattcatctaggaagttgtgccttctacctaaaggaatctgggcagaacctttactgtattttattggtctcttttgagctttgctttatgtagtgcggacagtgagctgtccgctggtttgagtaacttcgttgggatattgggatttttgtgtgacatagattaaatgtaaacatgaattaaattgcctacacttagggggtaaatgtccctgtttttatttcacgatttaattccagaactgaaggatcatttgagttattgttaattttttttaaaaacacttttatttctagtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggtaggaactatgttttgcattgtgctgcttttgtggtgttttgcaaatttttctgggggttatatggtgctgtcagattaaataaatctgtcttgtaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagaggtgtgtgattatgtttacacatgttaagcttgatgtgtttataaaatgttcaatccttgtccgatttatgcagggcagattcatgtttcctgtaagagtagaattaaatgactgctcaagtcgcttccagtgactgtaccttgatttcattgctgctctgatggaaacccaactatctaatttagctaaaacatgggcacttaaatgtggtcagtgtttggacttgttaactagtggcatctttgggtacaaaataatattaatttctctcaatgcttcaaatatacaacaaatcactgtaggctgatgttgatcataaagcagtgatgtctgtatagaagtcacccgataagaataacatgtttaagttgaagcctgaaaaggcctttggcattctgacactgtaacgttttacaattatgggatgacgttgagtgtgcatctcgatttcagattgaaaatattgaacttcccatggatacaaaaacaaatgaaagaagaggattttgttttatcacatatactgatgaagagccagtaaaaaaattgttagaaagcagataccatcaaattggttctgggaaggtaaagccatttaagcactttaaatgaaaatttaaataattgaaataatttcttgatgtggagaaaaataaaatgatttaattttagaacttcggtaaaaattatactttcatgttttttgtttatagtgtgaaatcaaagttgcacaacccaaagaggtatataggcagcaacagcaacaacaaaaaggtggaagaggtgctgcagctggtggacgaggtggtacgaggggtcgtggccgaggtgagacttaattcttgaaatatgactccgtggtttatttaagctgtatactgctgaatatgagtagtcctgtaccaaagcaaaactttaaacttaaaaccattccagcggaggggggactgttcagcttagtggaggttgtgtgtggtggttttttgttgtgagctcactggtttcaaaaaactgttaaaagtgtggccactttgacaattagtgtcatcactgataggaaaagtgtaccattacatgatacaccgtggtgtgataggttttcttgggcaggagtccttgttttaaacagaacagtgtacctgtcttcggctttaatggaaaattgaatgattttccattaagtttaggaagtttgatactggcacaattggactttctgcctccttttttataacagctggaaaaatagtttttcaagcagatagcaatatatatgtccattctgccctttaagatttgcagagtgagagacaagaacgcatcattttatgttagaattgggggtcagaagttgtttcctaacaatcattgtgcattgtttcaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggtaagaatatttaacttaattttataaagcagtggtattaaaattcattgttaacatacaatcctgttctgaaattgtgtgtatgggctttccattaaagtgttcggagttaagtgtttgaggcatgttacaatcataggatgattatactaacatagactggtggttataaatgaactaggatgtatgatttatgagtagcatctaatgggtgctaaaatatcttaatactttttatttagcatgcaaagatttgtagatttaatagtttgtgtttgtaaagaaagttttgtagaaaactatcttaatgagaattctgtgttttcaaaataggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggt

SEQ ID NO: 111970 - DNA, 1458 bp, Homo sapiens
gatcattagatactaccgttttctgaaggtagatttggggagtaagaaacctcatacaaaatcaattttgcaacaaaacataatacccctcccccacctttttccccaagtgtgtcttctgctagatgacattatgagccacttcttggaatctttgtgtctgtggcagacttattctgaaatccaaaaataaaaatgtcttagttgcctaaataaatttttctgaatttgacgctaggcaatgtgcaatttcaatgcaggctgcaaaagaatgatttagggatcttgtttaaaggataatttcttgtgccctgtcctataataatatctattgttattaatattgttaatctattataatctaatctattattataatttgttagacatgaatttatcaaaaccatttttcctaaaagtatgtttaaaagaaagttaggtctgtgtggatgtttatggtaattatgtaaaaaaggattccattaaatgcacttttgggaaatgctagttagaatgagttcaaatagatttctttattgcaagacttctcagaaccttcggtatcatacatatatatacacacatacacactttgtgagatttcaagagagtgacatttcacaaatctacttgaacaaaaaacttttagtagagtatctcagtgactaatcttttaaacaccttttaaagagatgctgagttacattcttgaatctgagcacggaaaggttgagcatgggagttgaaagataatctgcttggagctttaaagtcagagtaggtgtgtgaacttgtagcccttccttctgtggaatgatggaaggaaacattgagtactgtatacgtgcagtactcaatccttgactcattctaaaagaccatgaggtgtatgtactgtctacactttacttaggatgaaacaaagcctctgaaaagttgaacaagatgcctgggatttgaactcagattgtcttattcataaaaactcttattttttccattactgcactcagccttggaaatgggatgctactgtttgtcctgtctcctttgcttggtggttgtgtatgttaaatgacacagttagtatgagagttctttaatcaatgtgaagtactgtgctataaaagtatatggtaacaagccaggtacggtggctcaggcatgtaatcccagcactttgggacgccgaagcaggtggatctcttgaggtcaggagttcgaggccagcctggccaacatggtgaaagccagtctctactaaaaatacaaaaagtaggccaggcatggtggctcataatcccagcactttgggaggccgagacaggtggatcacctgaggtcaggagtttgagaccagcctggtcaacatggtgaaaccccgtctctactaaaaatacaaaaattagccgggcatggtggtgggcacctgtaatcccagctactcaggaagctgag

SEQ ID NO: 111971 - DNA, 1043 bp, Homo sapiens
atgcatgggggataaagctgtgagcaagacacatttaatccatatcctcaaggacctttggtctggccatctagttctgtagttgggagacttttcctgtaaaggaccagacagtgaatattttaggctttgcaggccctatggtcttggttgcaaatactgaattctgccattgtgatgcaaaagtagccacagacattatttaaataaatgagtgtggctatgttccaataaaacttcatttacagaaataggcagtggacttgatttggcctgcaggttgtagtttgccgactcttggtctagtttatttgtttcttggcctctgtctctctttcttgctcatattcacagcagcaattttcatagagttccattgatttatttgttacagttatgtaggtaagattgtggaagaactggatcttttacaactgataaaagctaactcttgtattttcttttactcttttatccaggacattttatttccttacatcgaagaaaatgttaaagagtatctgcagacacattgggaagaagaggagtgccagcaggatgtcagtcttttgaggaaacaggttgggacatttctgtcttaaattcccaagtgtcttagaaatgagggtacctggagatttaggacatgctctgagcattttgtaaaataagtgccctggtttgataggggatagaagttgcagtgacttagtgagttgcctgcttaggaattcacagtacataattaaaggctggatcatgtcagtttgttgtttctggagttgctctttggttgtttttttttgttttgttttgttttgttttttttgtttttttttgagatggagtctcacttcgttgcccaggctggagtgtggtggtgtgatcttagctcactgcaacctcgcttactgggttcaggcgattctcctgcctcagcctcccgagtagctgggactacaggcacctgccaccatgcccagctaattttttgtatttttagtggagattgggtttcaccgcattggacaggctggtctaga

SEQ ID NO: 111972 - DNA, 2070 bp, Homo sapiens
aaacaaaccattcacgagaagtctatccccgcgatccagtcacctcccactaggcctcacctccagcactgaggattacatttcaatgtgcaatttgggtggggacacacatccaagccatgtcattctccatatgacagtacttcatcattttgcactccctccttccttactgcaagcccctgctgccccctctgcagtgctcctgggtcctcacactcacactccccttccagactcctcaccccagctcactctggcccagccctcatacctcctttggtctcctgtgctttgttctaccctcttctccccaccagtcatcagtctgtcttttccttccacattgtgtgctatggaactcctgctctgttgtttttcttgttaaaattgcttcagtggcaaagatcttacatggtctgcagagctaactcactggcagttattttctagttctatattggatactgtggaatgctctctgtggatgttttactgttaggaattaggattcaaaatgtagttatgtcctttgggcatggaatatttgggattttaattttctggataactcagggttaatctgaaatacagtgagtccttacttaatgttgtctttaggttcttggaaactaagtgaaatgacacttaaatttcaattttcaattttaaaccaaccataacaaaaccaattttttctccacataaatgttataacaaaatgatgttgaaggaaatgacattacttgagaaggtcatgccacttgaagtcacagtttccaagaacctttcaatgatgttaaatgaggacttactttactttcctcccttacctttttttgttgtcaaaaccttgttgaaacatacatacatagtcccccattattgtatataaatatgtacacatgtatctttagaaattggactgctttgtcacaaggtcattgttctaagtggctactaggatttttgcaagatgtgggagattataggagactgaatgtgaaccaacctcattacttcactagcttctttttgctgaattccaggcataaactaatttatgagattttctttgtttctttctccattagttatagtgcagagaaaattatcagattgagttaaagtcctggtttgttgatcccagtagtgaatcaacaaatcaaatcttaattctatcattatgtgctctctcttctcatatacaacatgcgtctcagtttaaatttcagcttttagcaaaaggaaaggtaatgtaaatttattaatccaggttcttttaggaatcatttgtatcagctccaaagtatatgatgtttcaatttgcagccatactagggctaatgatggagaaagttgttctgctgggtttttgggtctcgttttaaatgactgttttttgaataagcaaaaaacaaacatcatgttgtttctgacttaaaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagtatgtgcttgagtcagcctaaacatttcaccagtcccaaatccaaatatgttttttcaccagtcctctctttccagcgtaagtcacaagactggtaaaacagataaaaatccacactctttttagtctaacaagtgagctttgtttcattttttcaaaacttggctaaaatatttcagctgactagattacccggacctgccagtctggtcttgtgggttgattgaaggacttgtcaaagtctccgtttaaaatagcttcctagaaaatggtgacttccttgaactaagtcatatttgattcttagcacatgagtgacagctccgttgggctgcttgcctggactgttaattacctgctttttgctctatgagacataggaaattttgtgccccaccgtgttgaggttactcagaggatg

SEQ ID NO: 111973 - DNA, 1031 bp, Homo sapiens
aaaaaaagctgggggtggtagcacatgcttgtagtcccaactacctgggaggctgaggtgggaggatcactcgagcccaggaggtagaggttgcagtgagctgagatcatgccactgcactccagcctaggcaacagagcaagaccctgtctcaaaaaaaagtaattccattttctagctaatcataagtttatagctttgagccttcaaactttgttttgattattttgggtgcagatctttctaaaagcatttccatgctttcttaaagcacagtggacataatttaaccttttcttgtcatgaagaacatcaaagattatattatatcattgctgttgtttgcttttttgagttcttcgggaatttaaaaaacactttcccatttcatccttttatctgtagtccctttttactgtcactagtggctgtctgttcaaaactatcctcctttccacatagattgttgcttctaatctgctgtgagcctggaacttgggcagtatgtttattagaactgcaggagtttgtagtctcagggagctgcttctcaggttaccatgtgggcacaaagagagaaacatatggcatctgttttgacaggtttttatctggctagatgaggtgttcctgtattttaacttagtggtcttccctctaggttctttgcagatgtagttccagcagtcaggaagtggagagaggccggaatgaaggtgtacatctattcctcagggagtgtggaggcacagaaactgttattcgggcattctacggagggagatattcttgaggtaggttacctagtttactttgttgttttgacgctatcaaagcataaaataatgaatcttaatggaaaactaattggaactaatagaatgcttttttttttttggttgtttaaaattaggtaagaagaaaataatcacttttaattatattgtatttacagtttcttctatataaggttgttatataaagtttattctgtgtcttgaaaaataaaatcagttaggatgcaaaatagg

SEQ ID NO: 111974 - DNA, 1026 bp, Homo sapiens
gagacatagacgagcccttgggtagaatttcaaaacgttttaactagaaaatgagaatttcttgtaagtaaaataatagcttattcatgaggcaggttagagaaattttttcatcgtaagattaaaggacagtgttcagaatctttcatcaggagtaaaattcaatccagtgagtagtttgagtgcaaatcatctttaagggtaggatgtagggcatgtttattttaaactatttcagatgtaaaatgaacggtagtgaaaaccaggtagattatgaaatgatcttatgtatgttgagctggtagttttcttcttccaaatgtctgttgctataaaatctttatttttactttgtatagcctccataaagttccctattaagtagattttcagaaaatactgaacgaatgaagtaattgtgattgtcatgtatttcagagaaaggcatgaggggcatgcaagtgtatttgtattgccagtctttccccttctctttgttcagcttgttgatggtcactttgataccaagattggacacaaagtagagagtgaaagttaccgaaagattgcagacagcattgggtgctcaaccaacaacattttgtttctgacagatgttactcgaggtgagtaatagacttcttatattatatactccaggatatgaactgagcctggcactacaaatacattgcctctttaaagaaactttatatggggatccttgaaaaataaaacagttttacggttttatataaagaaacagtgtctggttcaagttcatgtttgaattaaaaaaaaaaaacacagcagtgaaggcaggcttggtggctcatgcctgtaatcccagcacttctgtgggctcaggcaggaggattgcttgaacccaggagttcgacactagcctgggcaacaatgtaagacctctgtctctacagaaaaattcagaaagttagttgggtatgatggctcactcctgtggtcccagctgcatgggaggctgaggcaggggcatcaggtgagccc

SEQ ID NO: 111975 - DNA, 1458 bp, Homo sapiens
tatcttctttgtgtttttatttttttgatacagggtctcactctgtcacccaggctggagtgcagtagtgcgatctcggcttgctgcagccttgacctcctgggcttaagcaatcctcccacctcagcactcttgagtagctgggactacaggcacacgccaccacgcccggctaatttttgtattgttttgtagagatagagtttcaccatgttgcccaggctggtctcgaactcttggactcaagtctggcgttcaagtgaactcctgggtccaccgtgcccagccccatatcattttaattcgtgttaccaacagcttgtcctttgggaaacagctcagttctcggtatgggctgatgggaggaagtggaggaaaggtgtaggacagaacatggctccatccttctgcattcataagtacttaataaagctcagaagtgtaggatacactgccattctcttctgtcaagtacagttacgtattttttaaaattttatcatggaaaaattaaaacatacataaaagagataataatatagtcaaccccagggtgcccatcttttagcttcaacagtcatcaaatcagggccaaattcatttcttccatccccacatccccctgctgactttgctgcaaatctcagacatcattttttggtgtttctgacacacacacatcctttgatttttcacagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagt

SEQ ID NO: 111976 - DNA, 1029 bp, Homo sapiens
tttttagcccctttttccagcggcagtgttaaaaagggattgttttcagggctttttttattcccacgagtacaaagttgagtataatatattccaaaagtttgttaacctaccacctgtgcccagatggcaaagtgatattatcctcaacctaatatttaagaataacgtggagtttttactaaaacacttggagtaactgacagaagtaaaatttctaccttacaaattcaacccaaatttattccttaaatatttattaagcatttaccttgcatcccagatctgctatgaggggacaaagttcctctctactcccattgtgcatacatttttcgagaagagaaacaatggtgactaagacaagaaaaaattagatactagtaagcgctctgcagagaacacagggtagaataactttacaggaggggtgatgagaaggtgacatctaatctaaatgacatggaagacatgtaggaaactaggagaactggtgttccatgcagatggaacagcatagcacagatctagggcaaagcttggcctttttcaggaattgagagcccagtggctggataccatcagagaagtgggctgaagccagatgatagtgctttgtactccagtaagaagtttgaattgtattctaagtatggtaaaaagcccctggaggactttgagcagaagataacctgagtggtttacatatttaaggaattctgtatggaatggagaatggtttataagtgggcatgactgcatgcaggaaggtgagttaagtatatcagggttgagtgctgcaggcaaaaatcacaaggagttaggtgtatacaacatcagtggaagaactgggagaagagtcagggcaactaccactggactgtggagttagaggacacctcacagtggttagctcaggaagcctgctaccattgccactgtagctcatgcccacgacgctggccagactctggaatgccaggccccattgctgcaacctctccaaacagaacacttccatctcttctc

SEQ ID NO: 111977 - DNA, 1031 bp, Homo sapiens
aaaactacaggttttatagttttaagagatgacaggattataaaaagcaggtaagaattagtaaatttgggcccttcctttgagatattatgattaagaatctttaatctcctttttgtgcataggagaattttttaaaggtctgaagctctcttaagtggagagagaaattagcatttcagtttggagaggaaatcgggctgcttttctgtaagaaaatacctggcttatacatgtataattcataaataacttatttatgtaaatcattttgttgtggttgtacttgataactgttgcttggttcaagaaactttctagaaatgctaaatggtttatatatttttataatgtttgtttcaaattccacttaaatatctgggtttaatgtttatggaggatctcatgggaagttatcccttaatttaattctttctcttggttcacttttgtttcagctttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaaaaggacagcttctcttccactcaatattgccatttttccaaagaaacatgttaaaaaaaaaaattataagacatggactagtcctcattagcatgtttgcatagcaaccagtcaagagcatttacactatttctgctgatatactcaccttagaactgctcagaaccctggtgctttatttttgttttaatcttttgttgccagtgatgattttcctattctgcaaatagtgtatttcctggattacacatagtatggtttcctgaagtattctgataaatgtgttttttaaaacctcaatatactttttagaaaaggagcatctggttatgcataaagcagagctaaaactaaatttctttcatgtcctccctacttcctcagtgtcaatca

SEQ ID NO: 111978 - DNA, 1443 bp, Homo sapiens
cagtggtttgtagtttctccttgaagaggttcttcacatcccttgtaagttgtattcctaggtattttattctcttagtagcaattgtgaatgggagttcactcataaatctgtatattcttacagaaaagaccatatgaggtggttacattatttgctgggcctattctcatttatatgcacagtatgaccccagaaattacagtttctgcagggtacagaccactggggcctcctaaatccagcagtgaaaaatgataccactgtgctaagataggcacgtttatccttatcaaatgcaggttgaagtctgtaggacatgtagaaatcaccccatttctccagttccctgctacttcaagagggtgttggaccagcagcattcgtatcatctgggagatggctgcaaagacagtatctaaggttctatcactatacctaatgaataagaatctgcggtttaacaagatccatagctgatttggattcacagctttgaacaataccaaaatagacacattaggtgaatatgctaggaagtgctgtcccctcagtgatatttctgagcttcattagttaaatagtagaaaaacaatccatgcaaacaattagggaaacattgttattttaaatatgaagggataaaattttctcttaaaaaagaacagtaagaaaaaagtgatgtttaagagttaattggatctaacaacttaaataaattccctctgtcaaaaaaccagttactttcttaattagaagacatttcacatgacttgattaaaaagtgagttttgttctcttattaaattaatttacactttctggggattaatgaagggagaagaaacaattataaaatgagtaaagtttagaatgtcttcagtaaacactgttaagtaatttttacattttgtctacagaaaaccagtctatccaagaccaggcacctatgttggaaggtgaattggttgtaaaatatacctttggaaatctttgaataattgaatacaattaatgaatggacattaacaataatgcatgtgaacttcaaagatgatgatatcccaaatctgatcaggatcattttttttatttggcttcttaattgaatcagattttacaactgattgaatttacgtgattacacaagtagcttggttataaaggctgtctgttttatatagacataaagaaaacaactatgccaagactgtcttgagctacgggtaagactagaaagtgattgcagagatttgaatgattaatctatgtagaaccagaagtttaagaatttgttaatcagaaagcagcatatgagttaatattttgtggttaactcttgactgttttgagccatatctgattttctgtctcctagtaaacttttaagaaatgaattctgtttttatttttttatttttattttttacttttttgagacgg

SEQ ID NO: 111979 - DNA, 1028 bp, Homo sapiens
cagagtaccaaaacttacacacatacacactgtatgcataatccttaactacacaaataagattccagtaatacactacagatacatcaatagtttgatattttagagaggaatgctaattcatttgtagagttccaaaaattaccttttaaaacttgggtgactgaagatagtatcctttctcggtagttgggtaagaatcagaattcttgagtgaaagaggtggcgtgggttggagtaaatccccacttaaaaagtggtgcagggaagtagggaagggaattaacatttattgagctcatattggacatgttctggcacttgttatatgttttcttatttaagtcttacaaccttgagaagtagtaataattatttctttaaaaattacagatgaaaaaactgagtttcttaggagttatgtttcaggattgcacagtgatagtctccaagttgagatataaaccaggtccctatcttcaaagcccatgttcattcttctataccaggtagtttagtcctggtgtaaatgatagaaaactatcatcattgcaatttcaaaaatcatccagcaacactgtttgaggcatttgttactttataatctaaattaaatgtttgcatagatattctttttctccttaagcagaagtgcctgtggccttgagattagtctttgtttatatacaaagtaacagaatgttttaacctggctgagaaacagagtgactaacaggaagaggaagccagacaacacttttcagtgttcagcatgcagtatgcttgtctgctttgttacctcttgcacgttagtagtgtgctatattttaatctactgacaactgtatcttatagtagtctgctgtattttaatctactgacaactttatcttattttctttttggatttcctaaaagtttttgcttaggttatttaaataattataaatgaggctgggcacggtagctcacacttgtaatcctgccactttgggaggccgaggcaggtggatcacctgaggtcagga

SEQ ID NO: 111980 - DNA, 1041 bp, Homo sapiens
cactgcacttcagcctagcgacagagtgagactccactccgtctcggaaaaacaaacaaacaaacaaacaaaaaaacaatggcctctagggcaagcaacatggtgtagtatagaaaacactggcctggaaatcaggtgacttggaatcaccattgagttgtacggtcccttcacttctctgggccttggttttgtcagcaataaagggtggggattagactggaagatctttaatattcagctttaatactctgattgtatgagttttaagcttcatattggactgatatgacttttgtggctgtaatgaaatccagaaaagagagcttataccactgtgtttgtagattagtagtagcttgaatactattaatgcttccaaaaaaaaaatcacttttttactcaattacttttttttttcctggaatgtcttttttccttctctacttacaaagcctcactttacccacttataattgacacttgaatggcattgttcttgtgctttgatttaggttttcatattgatttttctcctgccttcctctccctgtttcattgtgattgtgtggtttttgttgttgttgttttgttttgtttttttgggaattccagctaccttgaaagcagttgcctgactaatgtatgttatcttgccaatcttacctttggctttgcatctggctattaataccttttggggtttttttcttcttttaacgttttcattttttattttctgtgattggtatttctttgttcaattcaggttagaattgcccctactgtcactacctggagtaacaaaactcctactgcccttcccagccatccacctgcagcctctccctctgacacacaggtatatccttcattattcctctttgagcagaattctgctcacctaaatatacagttatatgttctctacttaccttcctcaagctctttcacccccactccccatccatctgcctgctcattgcattttaatgcttttaggatgcaagaagcagtttttagcacaattaatttatttcc

SEQ ID NO: 111981 - DNA, 1694 bp, Homo sapiens
ggggtttcaccgtgttagccaggatggtctcgatctcctgacctcatgatctgcctgcctcggcctcccaaagtgctgggattgcaggcgtgaacctctgcgcctggccttagttatagtttttaaagtagttttgtaatttatgagcattaggtaaccacaagaaaacatcaaaagagtagtaataagtgatattggtcttgcatagtaaccatgaggtaggtataactcagatctctgcctcagttaaattacaagttgcactgtatgtcatggacctttggtgccagtcttgagtagtagaaagcacaatgtcaaatctgtgtgtcagggtctattgtataatacccagcattatgaacaaaaagggatatcttgatgaataatctgattaagaaaattaacatgctgtcatatacctgggtgaactctcaacagtctgctgtttttccaatcctttttagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatgtgagtgatatggtccagatgaagtaggaacacttttgtatttctcttcaaattggtggttttcatttgttcagcaggagaccttctctgatatggtaaaactagacaatatattgttataatagatctattttctagaatcttgaagttgtatttgtgatctactttttgaaatcatctctctcatttagtcaaacagattatattttaaatatgaattggttttaagttctctagggagatttgttctatttctctgtcactcaaagttcacttaaacatgtacatctactattaaaatttctatttgattcatctaacaagctgtaaagtagcaggaaaaatcttggtgatttggttgttttataaaatatttttagaagatagtattttttgagtattcttaatcattagtataggtttaggcttagtgtattctgtatttgcacaatatgaagtgtatccagaatacagacttttttttttttttggacaatttagatattagagaaaaatgaatgaccaaaggtttgtgaaattttagattatgtggaatgtgaaaagaactaataattttatttaaattaccaaatgtttggtgtcataaaatgtggcttcttactattttttactgtttcacatggaaacttccatatttccagaccagcagataaccttcatgtacttaaatgaagaatattttttccataggtaataaatggtcttgattgatagcaaagttaacaggtactctgcctattttaaaatagaacaaattgctgataggattgatggagtctttttacattttgttatagcaaaagtaaatataaaatcttgaaaaacaaaaaaaattaatgcccttttgtctgttatgtttttgtttggtactactaaatcaggatagattacatttgaatgtaactgttaactctctagaatactctctattttgacttttttcattcatttgacaaatatttttttaagaccctgccatgagtgcctggcattgctctggctgctgtgggggtatagttatgaacaaaacagagt

SEQ ID NO: 111982 - DNA, 1082 bp, Homo sapiens
ggtcacctcatagtagtactatttttataggatagatggtgtgatgttgtattagtccattttcatactgcaatgaagaaatacccaagactgggtagtttataaagaaaaagaggtttaatgaactcacagttccacatgactggggaggcctcacagtcatggctcaaggtgaaggaggagcaaaggcacgtcttacatggtggcaggcaagagagcatgtgcaggggaactgccctttataaaaccatcagatcactgtcaagagaacagcactggaaaaacctgacccatgattcaattacctcccactgggtttctcccatgacacatggggattatgggagctagaattcaagatgagatttgggtggggacacaaccaaaccatatcagatattttcactcatagttcctcccatacaggctagaacacagtttctacctttagacatctgcctatcattttcactttgagtatttgcctgttttagctcactagacaagtatctggtagcttaaggatatttaggaaaaggtggtaaccttcctatcctaccctatccataagtaagaggccttcttcctccttactactttttcacttacctaaatagtggctgtacttttctaggagggatgataacaggtactatatttttagtgggttttagaaatcttagtaactcttgatcttttcctgcttcctctcatacatggtcttgatatttctgtttgttactcatttttttcatttaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccaggtaattagaattgaccatttttgtaatgtttgagtaaggtgagtccagtagataacacttagcattagatgtaaacatattagtaggtagaatgttttggagcagttgaatttctgtaacctgactgcaggtaaatgttattgacaatt

SEQ ID NO: 111983 - DNA, 1418 bp, Homo sapiens
ccattaatcattttttctgattctctctctcctcccaccctccaataggccccagtgtgtgttgttcccctccatgtgttcacatgttctcatcatttagctcctatttgtaagtgagaacatgcggtatttggttttctgttcctgtgttattttgctaaggataatggcttccagctccatccatgtccctgcaaaggacacgatctcattcttttttgtggttacttggtgttatttctacatcataaaaaaagtaatttttattgaaattagttttcataaaagttgtaccagtattgagtcccattagcctcatctcatctcagtctctcctcggttatcttttagccacagtggctgccttgtagttcctccctcactcattgcatgttcctttctcactggaactttgcatctgtcgttcccttggcctggaaggctttttccttcttgatgaagttaattcctgcttgtccttcagatcacgtgtcaaaagtctacatgcttgggcagtttttcctgatccatctgaccaggtcacacctttctattaaaggttctgatagcaccttatatttttccttctcagcactttatgaaatatgttgtcagttgtttttgttgttgctgttgtttcttgaggaacaataataccattattatgtcatttgattcaaaattatacttcattttgctgctgcatttggcatgaaatacttgacacaattaattagtcagaattaatttttattgctatgttaaagacttttaattcttcctttgttttcgtttctcaagctcatcactgcagtggtgatgaagaactggaaagagattgttgagtcttgtgatcttaaaaattggagagaggctttagctgcagtattgacttatgcaaagccggatgaattttcagccctttgtggtaagagatgtgctttatatttaactgcatttacatacgtggcagggtatattgtaaataaacttaaatgacaaattttattagaaactttttaaaatctacaaatcacaaaaaagaaaaattctcatttcagtgcctttctcagatttattaaatacgtcttcatacctactcttttttttttttttttaaatctactagtgattttggtttcagacagacaagagttggaatcttgcctctgctacttagtagctgtatgatctaggaagaactactttctaagcctcagtttattcatctgtgaaatagaccataagtaactctcacttaataaatattagctatgataaaattaataataacattagaatagaaattaccattataggccatgactaaactggtggccaaggaataaatatttgcaagaaaagcttaaggctactagtataaaaacaaatagccatttgctgccttgaaataatta

SEQ ID NO: 111984 - DNA, 1310 bp, Homo sapiens
atacatatttgaattttgtaaagcaggaaaaacagaattaatgactactcaaatacttaagataaaatttttttttttttttttggccaggaaaaaaaaaatggtaggaaagaatgggaaagtgggccgggtgtgttggctcatgcctgtaatcccagcactttgggaggccgaggcaggtggatcacctgaggtcaggagttcaagaccagcctgaccaacatggtgaaaccctgtctctactaaaaatacaaaaattagctgggcgtggtggcacatgcctgtaatcccagctacttgggcggctaaggcaggagaattgcttgaactgggaggcggaggttgcagtgagccgggatcgtgccactgaactccagcctgggcgacagagtgagactcggtctcaaaaaaaaaaaaaaaaaaaaaaaaaagaatgggaaagtgttagcagtaatagttctttgcttttcctctaatggtatttctcaaataaatttactcactgttgcttcttatgattaaactagctctgaatgttgttggttgggtcttttgtcttcctggttcactaatagccttttaatactacattcttcaccttcccctgtaattgttttgtgtaccaaaggctcttaaagactctgaccaagtagcacagagtgatggggaggagagccctgctgctgaagagcagctcttgggagaggtacttatttttttttcatattatattggacaaatttgtgatatttgtgtatctcacattaaaataaggaaaattttcttgactacttatggcaaaataaagttgaagtaaattgttttctttgagatgtttaggataggaatctatctacctatactgacagaagtatcatctccagactctagttctccaaccttgtttctggattatatggtttaaaactaacagttgatgtgagattaacataatttggtcagatgactctcaggatgtcaaactgaaaagagattttattcaaacatcctcactgcattgcattgcatgtaaagttaatgtttttcttggcctataattttgggccaactatcagtggctaataggcctctgaattagtactgaacatggagttgaagtaaaggatatttcactaaacttattgtcatgattttcaataaatgtgtccttagttgataatttttgtaaataattgagaagagtccttgaacacagagttacatcattaatttttccttttaattttctgggtgtttttttttttttaaccactaatgaacaaatctgtaatttacttttcttgctttct

SEQ ID NO: 111985 - DNA, 1048 bp, Homo sapiens
gtgaaatagtctgttgggcatttgttttcacttttttgctgtcatacactgcactacattgaacatccatgtatttgtaatgatcagatagcatatacgttactaagttgcttctgaaaatattgcatttattttatttttatttctttttttgtttttctttttttattttatgttgagatagagtctcactcactctgttgcccaggctgaagtgcagtggctcaatctcagctcactgcagcctccacctcccaggttcaagtgattctcctacctcagcctcctgagtagttggcattacaggtgtgagccaatgcgcccggcgctgaaactcttgcatttaattgtatttctgttaacaatgtgtgaatctacaaaacctaggcagaaatagttgagatttggttttctcaagattaaaaatttccttgttcctttatgttttttatagggggattttggcaattgcttggagcatggcagatcctgaattgttactgagctgtggaaaagatgctaagattctctgctccaatccaaacacaggagaggtatgggcaggaaatgtgtctcaaccttgtagcccttatagtatgttacttctggctacataagaaattttctgtgtggattctttagtggattactatgtgaagagtatgtggacgtgtgtgtgcagtgtttatttggcagcaattttatcaggaacataatctaaactcagctttttaaccagaaaaatcagtaattcaaatagtatattttaaactagtaaccatcccctcctcatttccaataatgtgtttattacctagactcagaaatactttgatttatttcacatgtggtttatgggaatcagtatcttcgatgtaggattgttcaaggtttgcatcttttgcctgctttaccgttcctgaggatcctctttcacttctggaaatcagtagatacagttttccaatctctcttctgaatgataaagcaagaatataaattatagcttttatatttttaccttttttatgtgaaggtagatgattgc

SEQ ID NO: 111986 - DNA, 1003 bp, Homo sapiens
tttgccctgcctagttttctgtcatagtcaccaacatctactttgtggtccataatctaccttgcagcagttgcaaagtaaagaaacagtacttggtttatagcagaaattcaataaaattcttgttgaatgagatattatgaaacaagataatacacttgaagtggtatgtacctgcattttaagtcatataattttatgtgttgagaatgtagagatgtaggactataaagcaaatttgtggcataaatggatcagatttttaagtaatacacttttcaaaatgaaggatccaattttacagttaaatttgattataatagagaaacaagcagtttttattaactgtttcttccttgtagccgccagaagatatcagctgcattgcatggaacagacaagttcagcatattttagcatcagccagtcccagtggccgggccactgtatgggatcttagaaaaaatgagccaatcatcaaagtcagtgaccatagtaacagagtaagtatgtgattgacttgtgatgaacatgttgtatttctgctgtaggtattcctatattgtttgtcagagttgacaacaaatcaaatttctgtgaagtcaaatcctgtttttttattaatcagtcatgttagaaggaatgttttgttttttttcctctaagggaaaatcataaaattcccaataaatatgttggatattattaatgatgaagagagattggttaatcaaggaacttattccatgatatactggtggttttgctttgctagctgttttaaaacattgcagcaactttttttttttttttcttgagacggagtctcgctttgtcgcccaggctggagtacagtggcgtgatctcggctcactgcaacctctgcctcctgggttcaagcacttctcctgccccagccttccgagtagctgagattacaggcatgcaccatcaagcccggctaatttttgtatttttggtagagatggggtttcaccatgtt

SEQ ID NO: 111987 - DNA, 1998 bp, Homo sapiens
gcctcctgagtagctgggactacaggtgcccgccaccacgcccggctaattttttgtatttttagtagagatggggtctcaccatgttagccaggatggtctcaatctcctgacctcgtgatccgcccgccttggcctcccaaagtgctgggattacaggcatgagccacccggcctcaagtttgtcttctttctaatgaatatatccaacaaatgacacctaaaccgatttgatttatttgcagttgggcattactaatgttgtagtggtttgttcagtatgtttctatttaaaatatctgtgttctgtgttagacattcaagtcattcaaggctgtttctgtataaaatattccctttagcaggatgaagttaaaggaagtagatcgtacagccatgcaggcatggagccctgcccagaatcaccccatttacctagcaacaggtaagttcaaaggagagaagatagtatgagttacctaatttcttctcttctgcacctagcttattcagtttaagctttatcttctctagaaagcctctctctccctggcaagttactgacattctatcagccaagtttagtgttcttcctctgtgttcccatagcattttgatcatgatgtgttacatctaaaatattttccttcacaggaattgtattttatctttattcctccagtattaagcacaatagatggcatgtaaaaaaaacagttaatatcagtttgaatgaatgaagagcaattttgatgttagcatttttatataaaaagaaatagttatatcatatatgtctataagcagatatagtaaatcacgggacttttttttttttgagatggagtcttgctctttcgcccagcctggaatgcagtggcgtgatctctgctcactgcaagctccacctccctggttccttccattctcctgcctcagcctcccaagtagctgggactacaggcgtccaccaccatgcctggctaattttttgtatttttagtagagatgggatttcaccatgttagccaggatggtcttgatctcctgacctcatgatccacccatctcggcctcccaaagtgctgggattacaggcatgagccaccgtgcccagcccccatcacgggaccatttttacagagatttttaaatatatacaggcttaaaaaattatttacactacccactcttataaacatcctctcctagccctgtgccagaatctcattgctatagtaatttaagcatctgctcaatggcatatgtgcagcattcatgagcaagagaatggaaaacatgcttttaacttctgttttgtatggtttctctgatcttttatttttgtgtgtatagttaccataaatatattttctataggaacatctgctcagcaattggatgcaacatttagtacgaatgcttcccttgagatatttgaattagacctctctgatccatccttggatatgaaatcttgtgccacattctcctcttctcacaggtatgaggttcagctttaaattcatgtgattatttaattatatattgttcttgattcctaatttgtctataattatgccattattagaaactacaaggaataccatcaagaacatgaaatattttgtgaaaaagcatgtgagtgaatttttatggaagtaaaagtagtgtttatgtgttctattgacttttttttttcttttttttttttgagacagaatcttacttcatagctcaggctggagtgcagtggcacgatctcggctcactgcaacctccaccttccaggctcaagcaattcttgtgcctcagcctcccgagtagctgggattacaggtgcacaccaccttgcccagctaattttgtgtctttagtagcgacagggttttgccatgttggccaggctggttttgaactcttgacctcaagcaatccacccaccttagcctcccaaagtgctgagattataggcatgaggaatcacgcttggccagt

SEQ ID NO: 111988 - DNA, 1055 bp, Homo sapiens
ataatgaaaatatacatcatcctaattatcagaaaaatggtaattgcacaaaaaagaaaacagacaatgaaagactttttaaaaattattacccaaagatattaaaccaaagtaaaatatggtaaaactaagaccaaccatgtctgtcatgtcaatacattttaaatgtccttagctaacctactgtgaaaagattttcaaattggatcaccagtaaaatctgttggttttttgtttgttattttgtttgtaatgatgacaaagtagttctgaagggcaaaagtatacatgtaaaggcaaacaagaggtggaattcagaccaaaagtcattatttgagacaaagaaggatattcataaagctaaagtgtatatttgacagtgaatttgaacattatggatatgcaccaaataactattaaataacaaagtaattttcataaagcaaaagtttcaggagataccatgagaaattgacataaatatattagcagtaagagacttaattcactgtttcggtccaaggcagatcaagtggacaaaaaagtaaggatataggagatctaaacaaatcaataaagaggacttagttaatatatattgagctctaggccctgaaaacagagagcaccccttctttctaggtcccaagaacaattcacaaaaattcactatataggctctattgaaaggaaaggaggaattataggcataggggattttaggacaagggaactactctgtgtgatactataatgacagatacatgttgttatacatttgtcaaaacccatagaatatacaacacctagagtgagccctcatataaattgtggagtttcagtgataatgatgtgttcatgttagtttatggatcgaaacaaatagacctttatgatgtgcgatgttggtggtgagaaaggttatgtggttgggaaatgtgtagcaattttttgtactttgtggctcaacttttctaggaacgtaaaactctaaaagataaagcatatagctttttttatttttaatcaaaatcctatgaaaggtgaaaagaaat

SEQ ID NO: 111989 - DNA, 1246 bp, Homo sapiens
tgtctcatcgtggtgtttgccttttcttaaggactcaaaagtttgcagatacaggcattcacttgccattttcttaaggtagagttgaaagtactgctgccagttcatcatctgaaatgagggctgttttctttcctgtttaattggattgcaactatttgcctttcctaaagatgaaatagtgtgcttcctacattattctgacaacattcctttaattgttaatttcagatgaatttctgaaaactgcttttatcagaacagatttacttaaatgaaggcaatagccgcaaggggtcactgctctagatatttacttctgcataggaaataagtaatcctttatagatggaatttttttttcttagttgtatttttgtatctttacatttgtttataacttatctatactttttttgttgttgtgattattttactgttgacatggaagttctcaatctgatcatttggttatatcattgcttcttctagtaacttcatatccagtgattaaaccttttcactgctgttcacataatgaaccgttgtgattattgaatacttaaatgaggatatgtaagctgtattaaagatagtgttatttgcaaaggcattgactattgcacaaaaaattttaaaagaaaatatctcttttcaggaattgtactctcagagatgttgagaaaagatacatgggtcttggaagataattactcaaaatatgcagggaaggtagtatatctttctattttaaatgtattaagtattcctggaactatagcagtgagttggaaatggaggattgtccaagtaaaaaacatttattaaggctttaatgaaatctacctattttatggtatataatctcattaattgtccacttggaaagaataataacagatatttatttattggccagttactatgggccacaaattatgctgagctttttttaatttcatttcattttattttattttttgagatggggtctcactctgtcacccaggctggagtgcagtggcgcaatctcagcttattgcaacctctgtcttccaggcccaagcaatcttcccacctcagcttcctaagtagctgggaccacatgcatgtaccactacacctggctaatttttttttgtatatttggtagagacagggttttaccatgttgcccaggctgctaagctttttatatacagtatatagaaagagttggttttcttaaacaatatttatttctcat

SEQ ID NO: 111990 - DNA, 1026 bp, Homo sapiens
acgccgacttttaattcaaggaacccttttctgaaacactttgccacaatgaaggaaataaggtaaggttcttggggctcctcagtagtaataggggcaggggacaaggggcaattaagtggttttggttgggaatgaggcattatgaatagctttcaggagatagagcttagaacaatgtcttagttataagctcttatgtttgaggaagagatttcaatttgcttagagaaggaaacgggccagtgggtttttgtctctgagaaggagatccttagcatacagaaaacagagaagggtttgcaacttttccgtttctttgtatagcacacaaaaataattccaaatatccaggcctaacaagattgcttctttttcccctttgtgtttactttgtccagattacagccgaagatacatattaaggtattacttattcacaccagttttccattataatatgcttgtatcttctctgaatggaattaatagcttttggttatggttccttaaaagtcacatggcctaaggatagatggtcaaggaactttggaaaaattggtccctgggggatgtgcagggcaaatactttttggctgtaaggtgtgtgcagagagtaagaactggatttaaatactgtaagttggttgggctgttagagccttttcctgctcaaccaattaagacccgagtgaggctgaataaaaataacattgtttttagctatctttaaggaaaaaattagttgccttatatttttgtaacagttttactcagatataattctcataccacacaactaattggtttaaagtgtacaattcagtgggttttagtatatgcacagaattgtggaacagtcacaatcaatattagaacattttcatcactccagaaagaaacctcattcttactagcagcacctccaaatattcccccaccccgctcagcaaacactaatttagtttccgtgtgcctctgcctgctctgtacacttcatgtaagtggaattatgaactaatatat

SEQ ID NO: 111991 - DNA, 1027 bp, Homo sapiens
cacccggagacccattggcaggttcctggattcgcctcaattttggtcctgcctctctgcttcgcattttcaggcttggcctcacaagaaggacgatggcgccagattgtgccagaatgggtgaaaacagaaggaaaataaaccggttgcagcaaaacccactattccgcctccaacgcggagggaggagcggtcaaatgcacgtcttcaggctcaggcccttccgattggctgctgggacacaacgtggcctgtcattggctacggcaccggcgcagggccttcggagaggaagtgtggaagtcccgcgcctctaaagcccgcctttcgtgacaaataaaggtcgtagccgcagagtcaacgggcggagctaaagtggtcgtgattcatgctgtcgcgggaaccccgaaggtggggccccacgtaacaagaagatgacccgaagttgctccgcagtgggctgcagcacccgtgacaccgtgctcagccgggagcgcggcctctccttccaccagtgcgtatgggagcagcctcgaagccttcgaactccctgcggggcccggcgggccgtggcgtggcgtggggcggggccgggccgcactgtgggtcgcgccgcgtgtgtgacgcgacgtgacgtgcgcagcgtcggggcgtgggagcggaattggggcactgtgagaattgagattctctctcttcccgcccagtgtttacctctgaatagccggttctcgcaccgcctaccgctttaaggagagttacgcgaaaggagtcctccattaattggatggtcttattatttgaagtgaggaggccgaaagggaaggcagtttaggacaacggttgaagtgtgtgtgtggcgtcttcctgagcacgagtacagatcagttttctcctgtactgcctgacattgcaagttcttaagtgctgttagccgagctgtgcaaggccggtccgattctggctggatttgatcatggcagggaagtttcatttggctcgacagtggggaagaatttcagatcag

SEQ ID NO: 111992 - DNA, 1031 bp, Homo sapiens
tgaagcagattgaacaagttaaaactgtgtccagtaacactgcttagtcttacagtagtaaattcaaagacagtacctgttggctagtttgctcctactgacctactgctttctatattttggaaaactcataaatgctgcaagccataccaaaagtataaggagattttgtgatatgcagaatttgaaattttaataagtcagaattgcaaacttgtccactgtgcagaatgcgcaatttataaaatatggtaaattgaacttcaaaaaatgttgatcaagtattcttaattaaaatgttaatatattttaggtctctcatttgaatggatatccatcgttacttagcaaatgcctgaatttactactggtattagcaaaacttgaacatttataatcctgtacagatgaccagtgtttccttgataaagttttcatatcagttctctctgaatgatgttttaaaggattctgtgcaacatttttagctctgatatttaagaaacagattattatatcctttagcaacttgacaaagtgattgatggcacacacttctccatcaaagagatgcttattcacatctacaaaaagattaatatgcccagaaagctcacataatattttctgttgaagatacaattccctttgtttagaaactagttcaaaaattgccattcttgaatgggttcttacaactcgctcacaaatatttatgacccgacacagactttctgaaggaaaatgcaaaccattcttctttttaacaaataatagtgacccaattttagaggctttgagatccgatgcatacagtgcagtgatgcagtcctcacaagttaaaagagctgataacttgtttgcaacataaccagcataacagatgagatttcgcctatgatctgacaggtctagtaatgcctcacttagtgaacaatgagaccagtcttgacaaataccctcttcgtgaaagacagtctttgtaacgctgacaccatactgacgttgaactgtccaaagcgccaagtctt

SEQ ID NO: 111993 - DNA, 4420 bp, Homo sapiens
ttttctacaaacagtatcagtgactatggtaaagtgctttatttttcattttgccgaagagatagtgctgtcaattcccagtattattcattcattcagcaactattcatgtagcgtctctatgtcatgcactattctaggcactggagcaacagcagtaaataagaattgaacttacagagcgtacattcatgatttaggaggattttagttaaagaaattctagtcttcgtgtagactattatcttttagttaaccacataaccttgcctaggtaataagtaacgtgttttatgttaaatttcctgaacaatattcttacaatatgtgaataaaaccaaatttaactttttaaagccctttttaggatgtgcttgtgctcactgtgtaaattgtgatgctcatcctgctggtgaattgtgaaagtgtcagtagagatttccagatgaaagaatgttatccacttttgttgttatttaacaccaccatcatctttctctttcaaaaatcatttcagattgccatttacatttgtaactaaggaagtagctgaagccacatgtaattgcctccttgcccaggcagagcaggcagacaagaagggaaaatcaaaggcagcagcggaacggatgatacttgaggaattcggacgatgtttgatgagtgtcatcaactctgcaggaaaggcaaaaagtgacccttgtgccatgaattgctaactcttgcacaaaagactgataaatggaactgtacagaaaatttaaggtgcagggacacttgattttctggaagaaaaacaattactgtattttaattcagtccttgttttaaaagacctgaaattataatactgaaggagaagaaattttaaatgaggaaattagtacattttaaatcttagttaaatctgcttatgccccttctaaattgaatttttctttattatatagattttttaatttgcttgggtttcttaagaattagatgttctctttctgatacctttgacaaaaaatgtttataaattcatataatttataatgtatggtgttgtatgactttgttaatagaaaagccaaagcagcagtggttagcacccattctttgggacttgatctagaatatctgcagacagaatgttacataaacaaattcttatgaaacacattcaaatgacattttgtatttagaaaaggactatcttttaaagaaaaagcagccttttagggccgattctggaataatatcctgttgtcactttgggaatgtcagaaggggaaacaatccccaggcacactaaaaattttttaaagttatttaaaaaaacatataaaatattaaaggacagtaaatctcagaggatgggcaatgtgtttctataataaggaaaggctaacagatgctctgggctgtctccattttctttcaaagaggtggtatgtatttgaagtaataaattgtcaaagtgattactgggtactattaaaatgataggtggatataaatggaagtaaacattatgtagtgataatatagaacctcacatagtaatcaagtataaaatttggcatgggtggagaaacaaagaatagggaagctgcaaaagatgaatttagagaagttttcatctatacaatcaattatttttacagacttttttttttttttttttgagacggagtctcgctgtgtagcccaggctggagtgcaatggtgagatctcagctcactgcaacgcctctgcctcccaggttcaagcgattctcctgcctcagcctcccgtgtagctgggactacaggtgcatgccaccatgcccggctcattttttgtatttttagtagagacggggtttcaccgtgttagccaggatggtctcgatctcctgacctcgtgattcgcccgcctcggcctcccaaagtgctgggattacaggcataagccgccgtgccaggccctttttatagacttttgaactaagaggtttcaaaccaaatcgcaactcttacttgatttacagaaatgggcctcctaacaaaattttcaaaattgtggtgggatttctttttataagggaagtttaatatggcattattttcagccagtgatttggaaggtctgttttcctataattactaaaataacctaaatcattttcagtattcaaaaactctatgaatttaagagcctgttgtgacaggactcttgattttatgacaagaaaaaaccatgttggaattcaggcattttgttaggtaccttaatcatcagtaattagtatatgattatttcatttcctacaaggactctatagttgtatgtattaagtgtgtatatatgttcatatgaacatgcaagatataggcaatagaaattaagtaatccaaaagaggattccgttattcactaaagtatcttccttttaaatttggatttataaaatcatagtgcagtaactttaaatgtagatagttcaaacattcttagcacctcaatctagtatgtttaattaaaatttgtataaatgtaaattagtgtaagagggtaaaataataatcaagttatttttcaaaagattgcaataagtttttggtctaaacttaaactttgttcattttgtacatactctgtgttaattctaattgcacctttgtgatgtgtatttatatacagtgtgcagaaaatgttcgtgaaattttgattacaattgtagattatgtatgatggcattgcttacgaatgttttgcttgtaaaaaaatttcaaggtgcaatcaaatgctactagtttttctgattttcaaaaatctatctatctaaaatattaagccttttccttcctgtgtagtacttactaaataactttttgtattcaggcatttgcatcaaattgctgaacaagatgaatagccacattaattcaatgattttaaaagactatttggggagggttgggtatataattttttagctctatttacatcccaaagtagaaagattaaatttatatttactagagctattcaaagaatacacttttctatattgtaaaaacaggacagcaaagtaaatcatacagaaaataaacatttatactattctgtaaaaaaggttttgcattttttctttagtataataacaccactttattaaccatttaatatgcaaaaaaccttttaaattatctgaagtaaatttgacattacttctgaaaacacacaactaaaaaattctatcattttgctcagttattactaacataaattgctttgaaatgagaatatgtcttctctttttttccccactgtttcttttaagagcagaaactcagccgggcatggtggctcacgcctgtaattccagcactttgggaggtcaaggcgggtgaatcacttgagtccaggagttctagaccagcccaggctacatggtgaaaccctgtctctactaaaaatataaaaaaattcactgcgtgtggtggcgcacacctgcagtcctcgctactttgaaggcctgagcctgcagaggttgaggctgtagtgagtcaaaattacaccactgcactccagcctggcaatcagagtgagaccttgtctcaaaaacaaaaatacctagaaaatcaatctactctgtcttttaatgtgaaatgttcttatgatagctatctttcttagtttcctttttttctgaagcactaaacacaacctgtaggtcttatctctggggtctgggaaacagaaccttaatgttacaggtacaaaagcaaacagagtgattagttccccattttctggtagtgaacaactgacattttttcaatcttatgtaaaatgtgaataaaaataattttagaaaagttatctatttttattgttctgtaacacaaatagttaagaaaatgaatacttgttatgtaaatgaagcttcacagcaggacctccggccataactttgatcatgttgtatctcttaagcattttatataggaattctggtgtggctacccaaagcagaagggaaggcaatcaactaaaaatccctttctattggagttattttcatcatgtaaattacttcaggcttttcttgttagggcttcttgaatgcacattttgtcattatctgtataccaaaggtgagcttttttttttaatccatgtgattttatgagttgaaagctataaggttttttttaattaaaaatttccttctaaatggcaaattttgtgacagcatttaagacactcagtttctattcaaaagcaataagaaaacaagtatgtttagggttatgtttattataaggtcactgggactttataaaactgtcatctatcatactggcatatgaaatctggtcatagtattataaaaagaatacatcatgaccaagtagggtttatcctgggaataaaagttgatcc

SEQ ID NO: 111994 - DNA, 1062 bp, Homo sapiens
gaagtccctcccgaactccctcttcagattaaaaatagcataatagaataataaaaatggcatctgtgaaatccctttaatgtgaaattgtatacatatgcataaatgggaggtcatctatatgttaatgatgatttgattgaggtggctggattctggatgacctttatttttgatattttaggatatcattcatgtttatgaaaaacatgtgtaactcatatctgaagaaaatctatattcatagtgggggaaaactgacatggaaggacacagccacaaacgttgtacagccactgtcagacttaagaatacctaacctagctagccacatgtgtagttactgtttgtcagccagagatacttccatctaatcttattatcagttgaccaggtaatgctattagctgttgatttgattgtggcatctacttatagtaatgtattttggttttgatttggaaacttttcttatgtaaatcttttaggcaaaaataatgtgttcctcaatatgcaaatgtattggctgtaagaattttgaagaaagcccggaaaggaagacattgatgcatttggcagatgcagctgaagtaagggtacagcaacaaacagcagccaagacgaagttatcctctcaaatttcagacttgcttactaggccaacaccagctttaaatagtggaggcggaaagtaagtcagtattttaatctttttatagtacttcccaaatacttttggtaaagtttcttttcagggggcaaagttgagtttatatttttggttgttgcaaacctgatttttgtgttttctttccatctttagttacttgtaaaggaatttaaaggtaacagaaaccactgtcagattattgtgcagttcgaaaatgcacagtaatgatttagtccactgtgcttaatttctgtctactaagatgaggtaattatgtaatttgaggaaccccaaagaaaagcagatgttcatatgtctcgctgaacgtgtaattatgtttttgcattttcctaccttctcttgccttttccatttcttggagcacttttccc

SEQ ID NO: 111995 - DNA, 1050 bp, Homo sapiens
aactctttaactgggtagctgagtagatttctgagatgctttaccacatatgtagtatgtgtacaatatatatacaatgtatgcataatcagataattagttttccttaataatgactttttaccttatactgacttttacctttcaggtattgtgattgctttgcaaatggtgaattttgcaacaactgcaattgtactaattgttacaacaatttggaacatgaaaatgaaaggcaaaaagcaataaaggtgattattttttatttcatttaactgacagaaatatccagtttcatcagttttataaaactcaattgtcttgcaaagaaacgttatcaattccttttgcagtgtttaaatttcatctactgtgatttaactctaactgatatttgatctgttttgctaggcatgccttgacagaaatccagaagcctttaagcctaagatagggaaaggaaaggagggagaatctgatcgacgtcatagcaaagggtgtaattgcaaacgatcaggatgtcttaaaaactactgtgaatgctatgaggtgagatgctgggtgcggaaaataatatcttttaaaaacagttttagaaaggacctactacaaaaatttacttgaaaattgggaaatcaccttgctattgcaatttgaaaatatgcacagttggtgcaaaggcccttgttttaggaaggccttcgagcctctgtagcagggcttcggaggaataccttgggtttattattacagcttggggtcttactgggtgatttaccataacttcttggtcattatgctcagaaagtatgcagatcagaacaccaatatattgattttcaataaaaataatatcaaagtggattggaaactctccagcagtgattctcacctgaggtgcagttctacttactgttcttcacaggcttcttagaaatatatggccgggtgcggtggctcacacctgtaatcccagcactttgggaggcagaggcgggcagatcacttgaggtcaggagttcgagacctgcctggtcaacatggtgaaac

SEQ ID NO: 111996 - DNA, 1728 bp, Homo sapiens
tttttgtcataagcatttctaatgtttagaagttggtgtaaaatagaaactcaactattgtgcatgtaacttctcattctctgtaatttgtagtgtgataaatgatcagtatagtacctattttatttgtaagtaggcacattgcatttttctagcccaaacaagttattacagtactttgagagcattcatctagcatttcctatcattccgacatacttaactcttctgtgaaatactttctttatatttgtactatgtagtactgtaaaatgttcacattattttcacctatagtattggtttgagtctttaaaagagctctgtgaagtatgtgtttgtgtgatattctccattgtgtttttcttatcttaatggatgaatttgtatttcttactgatcatcatacctgacagtattgtccatttttggaaatatgatctaaaattaattttctttacatgtagctacagcagtcttcatatgtatcaatagcaagcaactctacctttactggaacatctggtatccagacccaggcacggcttccattcaatgggtgagtattttgaaaataggtacataagttgttagatcagcttaaatgcaacagtaaatatatatattccaaactacatcctcttttatttttttccccttaaagccatgtgagcatgcctctaaaatacttgttgaaatatttcaaacagaaaaattacagaaatagtcaattcccaaatactctattcagattcaccaatttcactacactagttttattattctctttcattctgagtatgtttccaaaatgatgatgctaactattttttatctttatttttcaagacaaggtcttgctctgttgcccaggctggagtgcagtgctgtgatctcagctcactgcaacctcccaggctcaagcaatcctcctgcctcagcctcctgagtagctggaactctatgcacatgccaccatgctctcctaatttttaaatttttttgtagagatgcggtctcactatattgcccaggctaatctccacctcctgggctcaagtgatcctcctggctcagtctcccagagtgctgggattccaggcttaagccactgcacctgcccaactatttttaaaattatgtgaggtcctcattttttgttgatgtttatttgtttatctattaattactggcttttgcaatatcagcttagaagccgtgcttaattacccggaatcagtccacatcccacttccatttcctcctccacacactccttttcctcactgctttttataattgaatcccaagagttttgaggcaatctcaacttttgttttcttagaagggacagtgtttgtggagtgttctttagcagctattgataacttcttttaaaaaaattattccatacttgtctctacctctttcatgttacaacttgcctttgaacctagtgtaaatagaacaacgtagcaaactttttattttagatggacacatttaacattggttaaagctttatttctggagggatttatagattggagacttctctaattttaaattagttttaggtctaattttttaaattttaaattagttgtagcaactaaattaattttagttactattaattgattaaatgtatatctttttttctatctgtacagcataatcccatcagagtcggccagtcggccccgaaagccctgtaattgtacaaaa

SEQ ID NO: 111997 - DNA, 1044 bp, Homo sapiens
ctttcctgaatttcatcccagtatttctccatgtcaagtttcatcctccctttaaaatagctcatccttgagtttttagttctaataactgtcattttcctggtcacttgaaagctctgcagtgacttacattttcttcgcttatacctacagttcctaccattcagtggttggtaagtcatggtcctttcacctacaccaggtctcttgcatctgctctctcttttttattcccactgctgtcactccagatcactccagatcagaccctcatttttttgcactcttctgacttgtctcttgcaactccattctgttttatgcactgctgccaaatacaattaatttttcttttatttcaatataatttctgtatttaaaaatccctagaaacttctcattgcgtactgaattaaaaatacagattaaatacagagtcctaccctaacattcaaggtcctccataaatgtctgcaatctgcctttttgcctgtatttgtctgcgttaatcccaggtattagccagactggtttgttcaccaacatttgtaaatatgctttgcagcttcccaagattaagcttccacttctcatgcttccgtctttgtgtgaaatgcccttctccagtctatgtgccctccatgcggccagcctattgattggggcccatctcaatactgtgtcctccgtgtgctttttctatatttccatcctctgccaacgatatatatatatatatatatatatatcctcttaactcccacagctcttcatgtatcttctttaataatatttatcttatttggacacgtgcctaatctgctgaactagaatataatctccctgacagcagaggtctagtgctttagttttcctgaaacaatggctacaatgccatttatatagtagcagcagttgtaacaacgatgatggcagctaacatttagtgagcatttactatttgtagggcagtgttctgatcaattttcaagaattaacatatacttaacccttatatgccataaggtagatattccccatatt

SEQ ID NO: 111998 - DNA, 1030 bp, Homo sapiens
atcttttctctatattgaatatggggcttaattctgggaattttaaaataattcttttcttataaattttacctgatattaacaaagttgtgtaagtacttgcaaattaagtaataatttcttcatagcaagtcatctgaaatggactaccaaggaagttaactactagagatggaaggtagaactcattaattttggttttatttctgtatttattaccattcttttcatttctctttgaacaggttgttcctttcagcagcttttgatgcaatacaggagcatactttacaacttgagcaatggttataaattaaaaatagtaggaaagttacatcccagattaatgacagccatgttgtattgtttaataggcagtgaaatcaactgtgcagaccatcactgttggaggagtgagcacatcacagtttaagacaattattcctctggcaactgctcccaatgtccagcagattcaagtgcctggaagcaagtttcattatgtccgacttgttactgccacatcagccagtagctcaacccagccagttagtcagaatcccagtacaaacactcagcctcttcagcaaggttagtaaccattttttaaaaacagtaattcatgcttttaacatgattaaagaacatttgtccatttcttgctgaaatcctgatgaagagtggcatttcaactgagtttgagccagtaactggtgcagaaggcagtgaaatagaatgatagttgcgcataactgtagtattctttctgctagatgttggtacacagtgtggtattataccagataatagtaattatttgttaattcgtggttagccattttattgctggttttaaaacctgccatttatgccagtgggatacatttagatggaaccgtattatgtattttatttgctaaactataaagccccttgatagggtttgggtcagttgaaatgacaaataggcaaggtgtaagtaagaaagaacttaatgtcactttcagcttttacttattttgaatctata

SEQ ID NO: 111999 - DNA, 1040 bp, Homo sapiens
tgtttctattgatagaggccaaaaggaaagctgaagcactcacccttccctacccaccagcactcaacagtctcactgctatctgccttgagtctgctgagactcctctcattatttatctttgttgatactgggtagcctcaaccaccccgactgagatcatctttcatctcccgcatctaatctccttaaagctcttgctatcttctgaccccttttccacccatgcctctcttgaagtccttccactgtgccttttctggagttcataatcaaaataataattccctaaattcacaaccttttcattgaatgttccttttatctccttgctgtaatggatacctgggtctccctgaggaccctgcttcacctgcagacctattaagtgatagctctttttctccttcagctcttatgcctccaggcctggaagcctaggtgtttcccatgattattctcattacaatttcagactgttttcactccctcctccagctttgaatctaatgttactaggtttgttgttgggaaatcaagcatggctagtgttttctcaatttactttatattgtaattgtctcttattacaggacagatttattctattatatttattttctaaagtaatcctcggttttcttcaatatttattagatatgcaactaagcattaaactaataaaaatgtgattctgcttgttttactttattcttgattagattttagcaatgctgttatcttttactttaatgtgacttttgtaatcttattcttagactcttagtattattttttacatggcccttttcaatttctctcagaaatacaagaaatacagctttcttcaaaatttttctttaaaaaaaatttattttttcttgaagatggagtattttttcttgaagacggactctcacctctgttgcccatgctggagtgcagtggcgcgatcttggctcactgcaacctctgcctcccgggttcaagtgattctcctgcctcagcttccccagtagctatgccaccatgcccggcta

SEQ ID NO: 112000 - DNA, 1005 bp, Homo sapiens
ttgagactgttagggtatagatagcaggcaacggtggaagatggaggccatcttgaaaaatgaagaaaagaggtgacctttgaagccagaggcagtaacagaggtataattatatgtaataacagatatataaacactttcccatgtttcctgtgcatagtatataagagtagtacataactagcagtctggaacaatataactccttactagctcctgaatctatccaacacagtgccaaaaattacttgtatatattatttgatgacatattttactaccttatttgtaagttttttttcatgtttatcttaagctgctgattctataaacttgttaaagtaatctttgatgctttgttttacttaataattttgttccaggatactttagaattcatagtgcaaaaaaatcatagttccttaatggaaccaaaagttattattttcagcaccactaaagaaacataaccacaagggcaagatgagattgtttatttgaataattaatgtgcttctggttgtactgtttatatttttttcttactgataagtattcatatactcatgattgtgaaaaatcagtttaaaatggggaaatactttaagcccataattgttatagctaaggttatttattgctaatatggctttctaagaatattaatacttctacctctagagattgttaatattatagatacaatagatacaattttgactgactttagggttttaagtctgtaaacatacttgagaaatttgtatttctctaaatttcattagctttctagagtataattatagatttatttgagtatgttatagttttgcaagtcggccgtttttaaatacaataatgggtatgtttttttttaagtgatttgtattttatatacagttggtttttgtcagtaatgtgctctgagtataaaaaagtaatatattgtaggtgtaagatgtgttatttagtttaatttataatttgagcacaaagagctaatat

SEQ ID NO: 112001 - DNA, 1748 bp, Homo sapiens
cagttttcaagtctgtcaatgagaggaaaaaaatctgggtagaaataagatcagatacatcaaagattacaaattttattagagggcgttggaaaggagtttcatgtgattatgtgacttagtgttgcctgagtgcaagatacttgtggattgagacgagagtaagaatgtttgcttctagttttgtgttcccatatgacttatattatagattcttgcaggttgaggatgtgttaacatgatttaacccagataagcttcaggaatattcttcattcaattatatatcaatttaaaaattgtcattttgccatttgcattttttttgaatttttttcttacatcttttgaaacctagtaacttgttcatttttcaacttttattacagtgcctgatcaactttctagcgggagaacgatcatggaggtggtgccagctgaggtgaatagtttgcttccagaggaaataatggacactggtataactttagtggatgatgatagtattgaggctgttattgtttcatccccaattcccatggagacagaactggaagaaattgtcaacataaattctactggtgactctacagccacgcccatttccacggaaccaatcacagtgtacagtaaccacactaaccaagttgcagtgaataccacaattactaaagcagattctaataccacagtgaaaccagcttttccaagtggccttcaaaaacttggtgctcagactcctgtgactatatcagccaatcagattattttaaacaaagtatcacagacatctgatcttaaacttggcaatcagacccttaaaccagatggacagaagttaattttaacaactttgggcaagtctggttcaccaattgttttagcactaccccatagccaactaccccaggctcagaaagttacaactcaggcccagtcaggagatgctaagttaccaccgcagcaaattaaagtagttaccattggagggaggccagaggtgaaacctgtcattggtgtctcagcattgaccccaggaagtcaactgattaatactacaactcagccctctgtgttacagacccaacagttaaaaacagtacaggtaaaagaaaaaagggggcttactaattaaaatgcatgtttaaaaaaatttaactgattcatagttgtgtttatagggttactaaatacatagttgttactgaattcttttgaatgttgttttatgtaattgtgtgtgtgtgtttttaagtttgatatgtctaatgcttatgaaaatttttaccagataacttagaaagcaaacttaattttggttaaattccaaattagtatatttatagccttttactaattttaaaatgcattttattcttagtggtagtttgattacaaggatgttttgctggtataaatatgccagacttgctgctgggctatcaaaaaaatcatgtagacaacatttttttttttcagttcacagatggccaaaggctaggagaactttgttgctctgagaaaccctcagagccagtaatagtgcgtgtcagccagcgtgtgccttttatttggagtttactgttcattgccattattcatgtttgtactatggaaaagacagtgacatgtgatggaagataacatacaggctttagagttgtaccaactgggcttgagttgcctctatcttatcctaccagttatggaaaactttcgtaggttacttatcttctctgagtttttga

SEQ ID NO: 112002 - DNA, 1056 bp, Homo sapiens
caccaccatatttggggattttaacaccctaaaaatttattaaggatatcaaagatctgaataactctatcaaccagcttttgctaactgacataaatagaatactaccctcagcaactattaaaaaaaatgttcttggctgggcaaggtggctcatgcctgtaatcccagcacttcgggaggccaaggagggcggattgcctaaggtcaggagttcgagaccagtctggccaacatggtgaaaccctgtctctactaaaaatacaaaaaaattaactgggcgtggtgccatgcacctgtaatcccagctacttgggaggctgaggcaggggaattgcttgaaccggggaggtggaggttgcagtgagcccagattgcgccactgcactccagcatgggtgacagggcaagactctgtctcaaaaaaaaaaaaattcttttaaaatgcacaaggaggattcaccaagagagaccgtatactgagtcaaaaaataagtctctaatttcaaatgatgagaatgttaaagagtattatgttctctgacaatactataattaaattagtaatcaataataatagcatagctagaaaatctccaagtgcttgggaattaaatggcacacttctttattatccatgtgtcaggtaaaatcacaagcaatattagaaaacatttgaagtgaatgataataaaaacgtattgaaattaatggaatacatctaaagagctttggggaaaagttttcatattaaaggcttactgtaaaaaagaagaaagttttaaaatcaatcaatcatttaaaccaggagttgacagactttttgtgtaaagctccaggtagcaaatattggaggctttgtaagtcatgtaagtctgtcatattcccccttgccccaaccatttaaaaatgtaaatatcaggccaggcgtagtggctcatgcctgtaatcccagcactttgggatgctgaggcaggtggatcagttgagatcagaagttcaagaccagcctgaccaacatggtgcaaccccatctctgctaaaaatacaaaagta

SEQ ID NO: 112003 - DNA, 1033 bp, Homo sapiens
acgcacactgcgcgacccaacaagccacccgtggcggccccaggtttctgggaaccggttttgctgctgtgtcattttgtgccagtccctcctctccctactgcccgccgccgcgttcttcctatgcccctttgtacaggctcttgttcgtgcgtgtccgttttcctcgcgaagcccaccagccaaatgtcataatgttcccgaggtgcacgggggaagggagcgggccgggacttagcttggccagcaacggtaaacaaccaagcagagtgcggatggacggggccgtcagtggggaaatgaagtttaaagatgaagtaattgagaacactttatactctcagcatctggtagtctgcatataaaaacagcaattggggtgggtggtggacagcccttgttgaaggctgaatctaccgacttttatatggagttgccattgaaacaaggtagggaaatgaaatgactttttcaacttcaacttcaaccttactcttcctacactaacttagacagtagagtggccctgttcgcagccttgaaattcagtttgcccagagcttatgttgtggttgaatgatacagaattcagcttttggatggttaactctttctaaaattgacaaaggcagccagtttcctttttttttttttttaatgctgatctcttcagaagccttgcagcttatgttttgttattttttaaatgattaagaattacctctgttctcttttggttacttattcaactgactgatgacaagagctggtaactcttacctacctagtaggtagctctaggatcttgttctgaagcaagctgtttatttttactgtacagaacaaatatatcagcagcagatggtttttttttaatttgatgacttagatcctaaaaaaacatttggcaaataattttagctaagagttatattttcaatattttagaaatcgatcattcatgaatgtttctacaattagttcaatcatttcaaatctagttgcgctttgacgtcttaaaccgatgacagat

SEQ ID NO: 112004 - DNA, 2054 bp, Homo sapiens
agactcactactggagttcatcagccaatccaaagtccaagcgtgagagccagagcctgtaggagagacctgggcaggcctcagacctgaggagtggagctccgcatcactcaaccctgggggcggagctagcccaggctcccacacccgacgctctggcccacacagacgctactctgtagcatctcaggttccctctggctgcactctggaggaccacactcgttttctttttggctgccagaggcccccgcatccaccgctgagctgggagaaagatggcggcagccgtgcgacaggatttggcccagctcatgaattcgagcggctctcataaagatctggctggcaagtgagtatttcccaggaacgcgggagtacagaggtggggaaagaaagccacagccttaatctccttaggttggccacggctcttgggcgtgaagctaggagccggcctgacgtccaagggggcgggcctgaggtcggctggggaggcaaatgttgggagaagcagaaagctggaggggaccttgtgcaggggccttcgaggctatagacttgaaatgattgtcagcttgttcagttcttgatagaatctttctggtcccttaggattttggaacagcggtctgagagacgactgctaccctggccttagtagccttccctggtacctcttcccatcgctggccggcctcacaccgaatctggcctctctttggaccttcctcctctttttttttgattcagagaaatgtatattctggggccttgatgctgcgtttttcggggagatggcttcttggggctggctgaggttgaggcggtatggccgctgtcatgtcgtccagaccattcagactgtcttctgtgggtccttgtgtttcgggtattttctctgccaccaactctgatggcacataggcggaatgtgctcatatcgtgggtcaggatgtctacagtagtgatgtttgcaggaatctgaattttgtcgaaatttatatagaatgcttaggttcactccaagttaaaatgtgtgacgtgcctgttctgcaagcagttgtcaacagtattaagcataggtaggtagacgtatattgttcattttctctttgtagatgtcacagcatttctcttttgtaatgaacatgctttctgtttaaagtatgcctctctaggccgggtgcagtggctcacgcctgtaatcccagcactttgagaggctgagatcacttgaggcctgagagatctgagagggaggatcacttgagggcaggagttctagaccagcctgggcaacatagtgagacccccccccccgccgccacccgtctccgtaaataaataagtaaataaagtatgcctctcaagttgatcttaatgtttacatcctgacagctgaaatcactttgatgtatattaatgggatacacctgttctaacctggtcattgaaattctgactgttttaagtaggctaggctgccttttctctggtggcaaacgtaatctacttttatcagtgggaaattcagccgtatattttgggcttaactactttgtgctgcattttcccactcaggaaaatgaagataataataggacttattcttgtctgacattatctgaggacaagatgagtatgtgtgtgcatatatacttaccacacttatatcacgtagaacagtacctgacatatagaaagtgcggtaagattgttgttgttactattaagctgtcagtaaatatatattcacttattgtatgggttggaaataagttaaatatgtcttcatggctcaatcctttctgcttgtaatttttatatggatgaaagtaaaatcagcttatatttttccccatgcttcctttactttttattttgttaaagaagaataagtgcattagttatcaaaagaaatagagctttgcaagtatttgcagaattctgaaacttaagtatttacttcttcaggtctgaattggagataaacaatagtacttaaagcgtgcttcagttatctgttgctttgtaacaaaccaaaaacttaa

SEQ ID NO: 112005 - DNA, 1057 bp, Homo sapiens
acatacattacgtctgtaagaggaaaagattcaggtcacctcaaataatgtttttgtgtgtctatgtattgcacagttgaaggaaatatagcttatcttttaaggcatttgaaaggaaattgactttgtagtttaaattcaaaaataaaaccttcaagaaaaagtgacaccttagattcagtaacagaattatagattcattctttcttgtgatgagcttgaaaacttaaaaaattctggtatactatactgaaaactagatgaagtggtaccttatataattatagatttaatatctcttgtgatagactagaaacttaaaaaaaaatctgtggtatactataaagaaaaccacaaactatagtactatgaaagaaaccaaggtatgtagaaatgaataaatacacatcaaagtttgcattagaaaatatagtaccctcagaacattattttcatttggtattgttgtaggtatcgtcagatcctggaaaaagccattcagttatctggagcagaacaactagaagctttgaaagcttttgtggaagcaagtaagtgaaatggaaatttcatgcttgccttgtattactgagctaggactttaaagttctctcaagccttgttttgtatcaaattatcaatattaaatatgcattgagattgattgattttagaatttaaactgtttacaacttgattaattttcagtgaattatcttcagaattacaatcctaattaaagttttgtatgtttattgttataatagctgataagggacaatatagcataatagtaaagagaatagtttggattcaaatcctggtatgctattttatgagctgtgtgatcttgggtcaattatttaacctctctgtgcctccttttcctctttaaaatgtactctgtagtacatctaatgtacctaaaatgtactctatagtacattactgtactacagggtagtacagtactgtactttgagaagtgtctgcttatgtcccttgtcaatgttttaatggggttgttttcttaatgttcaacatcactaatcatcag

SEQ ID NO: 112006 - DNA, 1116 bp, Homo sapiens
aaaagcagctaagatataatgtgattaatgataataaaaattcaataaaactttttagtttttgtgtaatgcagtaaaaagtttgattcccggccgggggcagtggctcacgcctgtaatcccagcactttgggaggccgaggcgggtggatcatgaggtcaggagatcgaaaccatcctggctaacacgatgaaaccccgtctctactaaaaaatacaaaaaattagctgggcgtggtggctgccgcctgtagtcccagctacttgggaggctgaggcaggagaatggcgtgaacccgggagggggagtttgcagtgagccaatattgcaccactgcactccagcctgggcgacagagcaagactccatctcaaaaaaaaagtttgattcccttacggtaccagaatatatatcaggaaaaaacaacatatcttctattattcctaaaattttcttgacaaaatgttgagtcattatgtgtttttctgttacatcctagacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtaacagatgagttgatttggaattacttttgtattggagaattgtaacatactaagatgttccaggacatctgatagatgctcttaaatattagaaattgtttctctgttttgttttgttttgtttaactcttgctttttaatttgtcccctaattgaaatattttccctctgttaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcaggtaaacacgtaataatttatacttaaatgaacagttatctttgcttaataactttaggttggttactgttggaaaatttagcaaggaactattcttcaaaaggatgtcttcataatacagttatggtaaatgt

SEQ ID NO: 112007 - DNA, 1028 bp, Homo sapiens
acacttccgttctgttaccagtgattttgctgtttaaaatggcacccagccatagtgctgaagcgctgtctggggggtgttcttaagtgccctatggagaaaatatgtgtgttagatagcttcatttaagtatgatttatagtgttggctgtgagttcaatgttaatgaatcaacaatatgtattaaataggatgtctctaaacagaaacacacataaaacaaggttacagattaattcattgacaaaaatgttgtgaccagatgctcacaggaacctagctttgtattcccataggagcagcagtttagtgtttgataattcagcgtcggcagtgactgcagaccataattaccatgaataatgaatactggctgtatatttagtagacaaaaatgaggtcataagataggtttttttttcctgaagaaacattgtgaaaataacattgtgaaatttgatgctcatttatttctcttagggcagcagcgttctcggatgctagctactctttttaaggatgaaaggtgccagcaacttgctgcctatgggatcctagagaaaatgtatctagataggatcatcagaggaaatcaacttcaagaatttgctgccatgctgatgcctcaccaaaaagcaactacagctgatggtaatgatcctgtcttatgtgtatatggtagtcaatgtttaggtacagactagtgaaaatcatgttaaattagaagtatcttttaataataattctacataacacttcctcataaaaaaagaggaattgtttttatttaaaattttttttttaatttataaaattttttttgagacagagtcttgctctgtcacccaggctggagtgcagtggcacaatggcgtgatctcggctcactgcaaactctacctcctggcttcataccattctcctgcctcagcctcccgagtagctgggactacaggcgcccgccaccacgcctggctaattttttgtacttttagtagagatggggtttcaccgtgttagccaggatg

SEQ ID NO: 112008 - DNA, 1078 bp, Homo sapiens
gacatccacagacctgaggattgttggaataaatttatctccaaccgaacactgggactaatagtttttttagggattgtccttgggaatttgtggaaagaaaagaagacagacaaaacaaagaagggtatagagaataaaatagaaaattaatgaatgaaatttatctaggaatttttaaaacattttttacaaaatataattagatttgaatacaaaatctgatacaatatgttaaagaattaagaacctgaagatgaagatttagagcatatttacctggattttacttatttgctagcaaaattcccccttgtcacagaaaccagggactcttcaggatttgagatggccttgagtattttagttgatacattcttctgcccattataattctcacctgaagttatggggattgcacgggttttggcactttagaaaaagcctgatgtgggtcttacataaatgaatgtctgtataagaaaatggactcttttttttagggaaaaataaaagcaactatgggaagttgggccttactgttctttattgtgacctttagtcactgccaaaaactgtaatttaggaaaccaattctgtttttttatgttttaggagaatttaaataaccaaatagaagtatttagctattatagccacatgtaccactgtttaccaaccctgacttttatttgggagatttggtctctgtgtgcagtcacagtgaccagaacagacaagtgggcagtcaccagagactaccttgattttctgtctatatcttttttatcttatcccattatagtttataggatagtgatatttaaatgtttactgttttttcctttacctgccctcaccttcacaatgttctcaacacagtaaccagagtaattctcttaaaacctgagtaaggtcatgtcattcctctccccagaaccctccaggatctccctaggtcactcagtacaaaacgaaagtcctaccacctgccaggccctccatgacttggcttcatgtctgacttctcacactcacacctgtagccccactggcctcactcttccttaaacaggct

SEQ ID NO: 112009 - DNA, 1024 bp, Homo sapiens
tttgtttacagtcctcagagatgatgccattgtggaatagatcagtgttcgtatgtatattcatgtttcagtagctgataggggaggcagagtggtaacagaaagaacatgggtttttgagtcagagagatgtaagttcagatcccagcatcttctgttattggtagtgccgtgcaccatattaggtgggataaatcttctctttaaacctcctatttacttaattaggggatattattctttttattagctctgttactttagttgttaattaacctctctgagcttgttttgttttttgtaaaatggagctaataagtaccaccgagagttgaaagggtttaaggaaggaacccacagaaagcagcacacacagagtctgatacccaggagcactgaacacactccgatgccactccttccctttaggattctaaagtacatacagactttccccctttttgtgttttgctaattgtaggcttgacatttaattggggagcgttacttggatggtctgctatcaagggttcctgtgatccatctgtttgcctgcctctttatttttctggagttatgtggacactaatatatgatactatttatgcccatcaggtaaagaaattatcttttcttaactttggtttagttgttgctgtttttaaagaaccaaattaaggagaaagcatttttttctaaaatttgttgttgttttttaagaactttaagaaccaaattaaggaggaagaattttttttttctaaaaagaaagtcattcacagttccatggctccaacaaaattttttttatgtttatgtgtgtttaccaaaattcaactcatttattttatttacaagcaataaagtagtatttactatgtgccaggcactgttttaagtactttacagacttaatcccccaacagtctttgaggaaagtacttacattatcctcatttaacagaagaggaaatatgtgaagaagtatttgtccatgtcacacagttagtgggtggcagaactg

SEQ ID NO: 112010 - DNA, 1045 bp, Homo sapiens
aatatgtatatatatattatatataaaatatatattatatataatatatattttatatattatataaaaatatatattatatataatatatattctatataaaaatatatatgaatgaggcttctggcatgtatcacttcaagataattcttgaacatgttaatagtagttcttcactttaaaaaatttgtagcttagtataagccttccagaaaatgaaaaatagtcccataaattagtaacagtttatgaagcatgggtctgtttagataactgaacatttgagattaaatatttgaaggcaaactgcaaaattctgaattgctttatcttatttggtagacagactctcctctaaacgtttacatcccacactcttgactagagttaaaactaattacatagattttgacttctgcttccaggaagatggaatagatgtattttccctattctttccactaagtatgtctaaaacacctggagattatacataaaacaaacataagaggactgtggagaaaaggtggcagactggctagggacctcaggacccaaagaatttcctagattttgtttttcttcatatatcccagacttggaactgaagaagccagaaatctggaaatgtcattgggcacagataggaaaaaaataaaaaataattaaaaaaaaaaaagcctacttggcaggggccagtggaaaccaggttgggaacgtgagcttgtaaccccagctggtagcaattaggcagcatctcccacccccttcttttgccagagcagtgtcaaaaaaagtcaactgaaataaaaggtttaaataagattcatagtctcatgacataatacttaaatgtccagatttcagttaagaatcatttgtcataccaaaaactaggaaaatctcaacttgagtgaaaaaaagacaatcagcagatgaacaacactgagatagcagagatgttaggatttcttagaaagatttttaaagcagcaatcataaatatgcttcagtgagcaattacaaacattcttgaaacaaatga

SEQ ID NO: 112011 - DNA, 1031 bp, Homo sapiens
tgacttaaatttgtaccttttttgtctttttatttttgcttaggaacctggcttctgtatttaccatgtacctggagcattggtttggcagctgaaccaggttgttttccagattggtacatgctctccctctttggcactggagctattctgatgcgtggagcaggctgtactattaatgacatgtgggaccaggactatgataaaaaggtaatttcatcctgaaaaggaatagagaggctcttctcaattctgcagaataacatagtggtatcacttttgaatgccatataaagcaacaagatcattcagtgaccacagaaatccagcatggaaaatgccaggatcagttgaatagctggtattgcaaagtgcagagtacaatatttcctttctcaacacaagagtggccccaggggcaaggtgtgtactttattattataaagtgaattgagaatttggaagactgagggtgagggagttaaaggttaggagtgaaagtgaaaaatccatcctgaaccttcaagtgtccaaagatctgtcatcccttcctttaagatgtattttagagccctaactattcttacgtaaatcaagtgaatcaaggcagcacttgttagtgtttcctataattgtttcttttaaaaacataactttacccattttttctccttagaaaaataatacatgcttgttctgaaaaatgtagataatatagaattgcaaccaatgaaaagtgcaagttgtccttatctcctcctcttatctcctagagaaaacttcggttaagaacttgatgcattatttttcactggattttttttttgtacctgttctaatgcatgtgtataattatttccttgttcttcaacagacagttattttctcaaggaaaggggccatcttatttgcctttttatcttagcaactatgccataattagtacaagatcattaaatgcttgagtaaataatcaattgaaatttgattttaaaagaaacccacattgaattataaaaagtgaataatct

SEQ ID NO: 112012 - DNA, 1024 bp, Homo sapiens
agaaaattgtacttacagattgtgtatgtttggaagataccagcctgcatggtttggttctaaataaggtgatcattacaggatttttcagaaaactaaatagtactatgttagaattcgctcaacaaatgtattttgaacccctaccatatgccagaaacaataattgacaggagtagaattccaggtttgataattctttatttaaattcttattttgtgggataattatgtgttcgttgttttactttgttgaagttatatcttgttaccttcattgatcaatagtaggttttcgttgtttttgagaaggcaatacagcttctttcaaatgggctaaactaccttattccagaaagtgtcagcaggtggcactctttccaccaaattggaagtgtaattttttgttttaccacgtttatgggtgattatgttgtcttgaagatcatctgtttttgatctgtccatcacccctcagaacttgctcattttatttcatctcccatagagtttttcccttttctacaaaaacatttctttttgcaatctacttgtctcttgtctttgctacctctgcgtctttcttcacagaaaagtatggggaatgaaagtgtcatatggaagacaaaaaaaaaaaaacattgctaggaatcagtagggacaaaagaacaggtgaaactgaagtgtatggagagatttagggagtacagagtgacagcattggacttaggacacagactgcagccagactgtctgggttggaataccaccttagcctttttttacctgtgtggtcttgggcacaattactccctctctgcgtcagtttctgtatttgtaaaatggttgtaataaaaatagtgcctatcgaataggcttgttgtgagagtcaaaagtgttctgtgaaaccacctggtacagtaagtgccatgtatctgttattacggttgtcataacatcattaatattgtcatctcttaacgactctgtgaggtagctgttctcttccctcatttacagatga

SEQ ID NO: 112013 - DNA, 1070 bp, Homo sapiens
ggaatttgcaagtagcagcctccgagtcggctccgcggagctgtccgcggcggccggccggggcgtgatggaaatgagaacctgaaagcttgggcttggctgccgggtgccgtgcgccctggggcgaatcacctcgggacactttgaaatgagagcctgaaagcttgagcttggctgccggctgccgtgcgccctggggcgagtcacctcaggacacgcagtcgggacagtctcctaaaggacccgccagtttcacgtctgtctgcatcctgagcacctgaagcgggcaagataattctcattccacaaacacttgtttaaatggtgactcaagcggaaggttccgttctcgtggccctccttcatttattagaatgtttgatcctccccgcaatcttgtaaggcccacaaagacaatccttaagacagttaagacgctgaggaaactaaggctcctcgtcagagccagaccagaagaactctgtgttttgatgctgagtcggagctcttttacctgcatcacccataaggcaaagatttaattcatttgaacgcagcagggacagcgcttacggactgcctgtcagcttacaatcgcccccgacagaaagattttcctgaccttcctatcttaattaacacctaccaacctcactttctatcgctttatccgcaatttttcttaatagcactcaccactaactaaccttatgcgcttgttgattgattggcttctccagtagtgttaagtgaattaataagttcctactacgttgtccggccatagagatagaaaaagctatggaaaccctttgctttcaaggaactctggtctagttgaaaaagactatttggtgagctaggaaaatatggatcaaatatgagtgatacaaaagcaagtgctacaggaaaaagagaaattactgtggatcccttgctggaaagtttcgagaagaaattatactccaaaggacaagttgattttgcagaggagggaagagatcttagtgcgggaagtacttttgcaaagacccaagggtggagtgttagaacactaagaatacgagcct

SEQ ID NO: 112014 - DNA, 1391 bp, Homo sapiens
tggtacattaattgtgttagttaagatgcttttaactacaagttacagaaaaacccatcaaggtttaaacaataagaaaaaataattattttatataacaggcatgccagaactaaggcagcttcaggattgattgattcaatagttctgttcaaggttttcttctttttactctgccatcttcattacgttgatttctttcttagtagtcacaagatggctagctaatgctgttccattcatcatgtacattcacagtgatatccaaaggctagaaagggaactttaaaataaaataaactactataatagaatattgcaaatatctatgacaaaatattatattgaattcccatttacccttctagctttaacagttattgactcatggcttccagtatttttattattgtattgttgcattgaacatcatgttacatttgaatatttccatatttaatattcatcttccagataaattccagatgtaggaattgtttttagtcacttgggaaagaaaaactatgcattttcttccaggtattttgattaaaatgaccagaactctttttattgacttatttttcaattttcaatcttttcctcatcctaaaaccagttcctcaaattcctcagggtcctccccatgtttcttcacatctgttttgcttagaatcatctttcatctctggcttaactcaagttccagaacttatgtaaggaacattctctctgagccccctatcacacaaaccaaactttgaaataacttacaaaatttaaattttatatatttctttgtgttctacaggagcttgaggagttttgggtttacagagcccttttggtagaacttaccaagaagctgacttactgtgtaaaggcagaattaatccctctcatggaagttactggagttttagaggtcagtagcttgttggtttcccaattgaaattatgttgaattaatacagaagccaggttttattattttctgaagtcttaatacagaggaagtgatagcaagagccttaattgctcatttgtcatgggaatcttttatttaaaacaaatagctgttatggccttccagaaatccgctgttactagatggcatacctgatgaaaaatctcagttgtgaaaaaaaaaacataacaggaagggtgggagtgactgtctccaagtatgttgtgctaccggttgtccttaacacttcttccttcctccactcctttgaagaattaccttctgtcagtttggactcagtgcttgtttaagataatggtgattcagtggcagaaagggtcatttgtattttttctaagagagtaagaagaaagggttcgcaactggttttccagctttctattttcagccaaccctcaacttc

SEQ ID NO: 112015 - DNA, 1101 bp, Homo sapiens
ctcactctgtctcccaggctgagtgcagtggtgctatctcggctccctgcaacctctgtctcctgggctcaagtgatccctcagcctcccaagtagccaggactacaggtgcgcgccaccacacccggccacgttttttgtttgtttttttgtggagacggagttttgccacgttgtccaggctgatctcaaactcctgggctcttgtgatccatctgccacagcctcccaaagtgctgggattacaggcatgagccactctgcctggccttatctttttattgtagttggaaaaatgataataaattttaattaatctgaagtacatctgttagaaattagttttgtttctatggaattattctatccttgctattctgtaatacaacttcagttttccttttgtccaattttaataacatacatttttagcaggtctagtaaacgaatttatttgattgtgtctttctagaaggtggacaagaacgttgtcaacaggctatatctgtcttttgttctttataccttgctcaaagagaccaacatttggactgtatctgaaaaatttaatatgcctcgaggatatatacaaaatcttctcactggaactgcctcattctcatcttgtgtgttacatttctgtgaggtaatttcattgaatatatgatatgtactttgtgcatcttctggttttaactgttactaaactaataagccagttagtcagtatgtcagcattttctccttgttgacatattctgttattacagagcactaaaaaactatttaaaatgtacgtttgtttttatctgtttatgaaactactattatgtacttatggtaacaatacaaaaattcctgagtcaactaaaacacataatgaaaagtgtctttttgacccaactcttaaagccaccattaatagtttcaggtattcagaattaactgttaaaaacaacctattgatgtagattccatgtgaatgtctttcacctgagtaataaaaatgtcaggtgtttggttagaaagttacctatatccaacagctaccatgtgactatttagtaccatattctctttttaaaaaaatttaattttgac

SEQ ID NO: 112016 - DNA, 1308 bp, Homo sapiens
gagagagacaaaaataggtagagatcaactatttttaggtaacattttaggcaaaatattgtctgacgctgttttagtggaaacttgtattttttttttcagttctttttttaatttattttgttttttgttttttttttattatactttaagttctagggtacatgtgcacaatgtgcaggtttgttacatatgtatacatgtgccatgttggtgtgctgcacccagaaactgttgtattttcctttttttttttttaatgcaacttttagagctaaaggatgtttttacagttgggtggaatgcagtgcagggaagatccctaaaggaggctgagtgagaattagtgaaaattggttggggagtaaatagcacagttctggagatattgtgaaaaattatttaaagatctatccaaaggagttttggaatgaaaaatgagtacatgttttcataaaaagcatgaatataataactatcatccccctaaattttttgttaatttttaattgccattataaatttatatatgcaactgtgtagatttaatactaattttttatttaaatagctttgaggtatggaaatgagttatcttgattaatatgcattcaaggtgatgccttgaattaaggaaaatgctccaatgatatcctgaattgtttcagattgcaacgaatcttgatgacatctatcatttcatgaatggtacattttttggtgttcagcaaaaggttttattgaaagaaaaaagtctctgggaaataactgttgaatcacttagatacctgacagaaaaaggactcctacaaaaagacactatttataagtctgaagaagaggtccaatataattttcatattacaaagttgggacgtgcttcatttaagggtaagagtttacctaaatcttattgatcataggaaacacattggaaaaaatgaaaattaaattatactttctttaagctgggcacagtggctcacgcctgtaatcccaacactctgggaggccaaggggagcggatcacttgaggttgggagtttgagaccagcctggccaatatagtaaaaccctgtctctactaaaatacaaaaaaaattagccaggcatggtgatacatgcctgtagtcccagctactcgggaggctgaggcacaggaattgtttgaacctgggaggcagaggttgcagtgagtcgagatcacaccactgcactccaggctgggcaacagagccgagactccatctcaaaaataaaaaaataaaaaattatactttctttaagttgtatttataattttatatt

SEQ ID NO: 112017 - DNA, 1012 bp, Homo sapiens
ctttcacccaggctggtaggttcatagctcattgcaacctcaaactcccgggttcaagcaatcatcccacctcatcctcccccatagcctggaactgcaggtgcatgcaccaccatgcccggctaatttttgttattttttgtagaggtggtcttgcttcactgcccaagctgatcttgaactcttgggctcaagcaatccttctgcctctacctcccaaagtgctgagattacaggcatgagccatcgcatttcgcctttccttagttttgataagattttcacagggttctgtaatccacaaaaagattgagagactgcctaatagttaatgaagtcagaatcaaaattctaagaacatttaatgtacttaactcaatggaaatagtacattaaagaatgtttacattagcatctactaaaatgaaaatggtagaaattttgtcactaaaagatcaagggctcatatttctaacagatctttttcatagggaatatctgaaacataaggagaaagaaaaatgtgaggtgattaagaacttgaagaatattggcaatggcaacctgtgtcctgttttaaagcgcactatcccatttggagttgcctatcaccacagtggcttaacaagtgatgaaaggaaactcttggaggaggcctactccacaggagtgctctgtctttttacctgcacatctaccctagcggcaggtgtcaacctaccagctcgaaggtaagagataagtaagtgttgaccaggctcagaacttttccatttctagcttgcgaggagttttgttgttttatgctttctcagtagtggatgagaatttatcaaatgttcttttagcatatgctgagttgattggttggtttattttctttaatattttaatgaatatgtaatgaaatatgtaatgaaaaataacgttaatagatttcttgatattagaattccatcctttctgctctttatatctggttttgatgttagggtctattaatctggttttg

SEQ ID NO: 112018 - DNA, 1398 bp, Homo sapiens
aaacagaagaagaagaaatggtaaagcaagaacttttaagttgaagcatgttttatgtatcttagaaaagctaaactcttttatagctgtcctttcttaacctattttacaatatttaaaacactggaaagatgaatttatatgtcgtattaattgcaaatgtccttttaattcaaggttgagttaaaagaatatctgaaaataaatgatacaatatatgaagttgacagcaaagctgagaatggcatgactttttcacgtcttcttaattataaggtaacattgataacatttaaattccaggttaccagactttgtgtctggggcacaacaagagtttccaatggattccgtagaatagtctagatttttcagagaaacagctgatgcttgacatttgttggacaccatgcagactgccagttcaagatagctcgtttccagtttcaacattagatcacaccatattcttttctatgacatcatatctttgtgaagttggggtttttacagttgctgtaagcaagtaccgtgtgaaaatcaatctggaacagaagagaatagctgtgtccagtcttatttcagattttgaaagacagtaccaagttgtgcacacatcccattagtgagctgttgtggttatttaagaatgaaataaaaatattttttcactcaactgatgtgtattatttattctaacagctactaaattgtgaggaagtacgtatttattaagttgtttggacctcactatttaattaacaaaactgtaaagtatttctttgggccctggggctgtgaacaaagaaaatttggaaaactctcctgtaaatgtttattcatacaacaacaacaacaaaagaataatttatggaccatgtagttcagatattggtgtataaaatgttaatgtctactatgtaaattttagtgttttatgacttgtatgaaggatattaaaaaggggaagaagggattatacagtagttttagaattctgtgaagatgtgttattctacagctatgtctttagtaaagttgaagaaatagattttaaataacttcacattttttcttcatgttctttgtgttcctcatgtgactacaaaaattgtcataattcagtagtatgattgaatctgtgtttttgaaaacttaatggttgtaaagggcatgtcttatttacacagtccgttaactattattaggatcaatctgtgtttctctctgtggacttttttgttctgctgtggtggagatgggcatgtagtgaggctattaataacattaactattttcacttctttaattttctttaattcacttgtttaattctaggtttttttttagactaactagacctaagaaaatcataataacctaaaagaaaagtgagat

SEQ ID NO: 112019 - DNA, 1055 bp, Homo sapiens
tttttgtttagtctgccagaatgaatatcctgaggacaaggctctatctaactcatctttttgtttttgtttttgtttttttgtttttttttgagacggagtctcgcgtgttgcccaggctggagtgcagtggcgcatctcagctcactgcaagctccgcctcctgggttcgcgccattttcctgcatcagactccccagtagctgggactacaggcgcccgccaccacgcccggctaattttttttttgtatttttagtagagacaaggtttcaccgtgttagccaggatggtctcgatctcctgaccttgtgatccgcctgcctcagcctcccaaagtgctgggattacaggcgtgagccaccgagcccggcctaactcatctttttcttaactagcactgtgcctggtatactctggtaggttctcaactgctggggattgtcacttaaaaatgcaaccttagcactttgggcctagttcctcatctataaaaagggataatttttttttgcaagttagagtctgtgttaaggacatgccaaattagatgttggtaatgattgtcagtaattacattggtagcttctaagtaagaacttcagtaaataacaactttttaaatctttttacctctaaatctggcttaataacatgaccagattaaagcataaatgcatgtgctactttttattaagctaaagcggtggttctcaagtgtggttcctggactgcagcatcaacatcacctggaaatttgttgaagtgcatgttctcagacacttccctagacctactgcgtcagaacctctaggaatacgacctggcaatctgtgatcgtggctcactacagcgtcaacctcccaggctcaagcaatcctcccacttcagcctcccaagtcgtggggactataggcatgcgccaccatacccagctaatttttttatattttgtagagatagggtctcattttgttgcctaggctggtcctgaactcctgggcttaagcagtcctgctgtctcagcctcccaaagggttggaattacagatatg

SEQ ID NO: 112020 - DNA, 1009 bp, Homo sapiens
tgctggaataaaaaaatttttttcctatcattaccataatattagtgcaagtaaatagaagcaaatgctttcatggtccatactgtttctcattttgaaaacaaaagatcagtgatctctcagccccttccattcctacctgtcctgctaccactgaacctctttccttccctcacagtcacacttatcaaaccagttatcctttctgtctgtttccttacctgacataattcctctaattcctcatctataagaaagggataataagttgttagcaagtcagattctggttcaaagacatgccaaattcaatgttggtaatgattttcaataattatattggtagcttctaagtaagaactttagtaaattaccccactctaattctgggttctgtgctctcattctctcacttaagatctgatgactgagacgtctaaacacagtgttacttttaatgtttaccttacctgacttctcaataacttacctgatgctattgactacacccttcttgaaattcttgtttctggatgtccttacaaccactcctgttttttgaccccgattgtctagtagagatcctcagctttcttagttgtatttccttggctggctctgtcttctctaccaaaacctagctgttgtggtatgtctttgacactcacatgtcttgagtgaaagaagtcagttattagtaatactgttgattaaaccaaacatctttccccccacaccagcagccgcagctacctctccccacgggtgcatccctgccaccacccagatgctctgccttgtgctgcctttcccaaagctagacatctttaaagacagctgcaattaagttttaagtcagggatgtccaatcttttggcttccttgggccactttggaaaaagtattgtcttgagccacaataaaatacagtaacacgatagctgatgagccaagaaaaaaaattgcaaaaaaaaaaatctcataatgttttaagaaagtttacaaattt

SEQ ID NO: 112021 - DNA, 1001 bp, Homo sapiens
tctatttacatataggtctgtgatccatatgtgaccatataattatatacttggtacagccctaggctgaagtgttttttgggggttttgtttgtttgtttgttttggtttttttgagacagagtcccactctgttgcccaggttggagtgcaatggcgcgatctgggcttaccgcaacctgcgcttcccaggttcaagcaattctcctgcctgagcctccgagtagctgggattacaggagcatgccactatgcccggctaatttttgtattttctgtagacacggggtttgaccatgttggccaggctggtgaagcttttattcttaatgaaactggaattgaccataagcgtttttgttctctttgcagcctaatgacagtgaagtggacatgtttggtgactatgatagctttactgaaaactcctttatagctcaagttgacgacctggaacaaaaatatatgcaactccctgaacataagaaacatgctacagactttgccactgaaaatctttgctcggaaagtatcaaaaacaaactcagcattactaccataggcaaccttactgaattacaaactgataagcacacagagaaccagagtggatatgaaggtgtcactattgaacctggagctgatcttttgtatgatgtaccttcctcacaggctatatactttgaaaatttgcagaactcttcaaatgatttgggtgatcattctatgaaagaaagggattggaagtcatcctctcacaacactgtgaatgaggaactgccccataattgcatagagcaaccccagcaaaatgatgagtcctcttccaaagtcagaactagttcagatatgaacaggagaaaaagtattaaagatcatctaaaaaatgccatgactggaaatgcgaaggcccagacaccaatattttctagaagtaaacagctcaaagacactctcctatctgaggaaattaatgttgctaagaaaacagttgagtcatc

SEQ ID NO: 112022 - DNA, 1831 bp, Homo sapiens
tcatctccgggcacgagctcggccgcggtgggagcgccaaaaatacaccccaagcttggacggttccttttggggagagacacccgccggcggatgcgggaaccacattcatccatggcaaggacccagggccctattcagacgtcgttctcagtgacccagacgctaagcccatatggaagggagagtgggacgccggagcccgcttctacatccaccttgggaaaagaccccaagttagctctcagggctcgcggaccggaagcacgcataaacttctaccctgtccaatcataagcctcacgtgacctgccgcgtagggagggcacgaacagaaaggtgctgcgcatgcgtattgaaaaacctcacctactctcgcgggtcctcagcgttctcctgcggaacctttgaacggggtactcgagcccacaggggaagagcagcggaaggggcctttcggaacgatttggaacgaaaggaagtggaagaaacgcggaaccatggccgctgtggttgctgtttgcggtggtctagggaggaagaagttgacacacttggtaacggctgctgtcagccttacacatcccgggactcacacgggtaaagtctccatatcctatgctccattgtagcgctgcaggcattaaccttagtcctaatggttagagtcgtccctgttagcaaaacgactctggtttctaggcgattaagtttctccaagatgggtgggaatctgtaattgcctttgactgttttagtgtcgtctaatccactcctttaaagtatttaaacgtatgaggaagttggagtggttcttaaaaagcagagactttcctaagatctctggataatcttagtgaggaagggacatttccagagtcgcccagcagcaaattccagatgtctaaggtccccaaacagaacaaaattgcataatttttgcaattttatcttctctgtgcttctctataaattctttctgggacgggtctgttactttctttttggtatgacagtgcctttctgttgcttctcctataagaatttgcattaagaattttctctaaccatggaatgaagggaaaataaatgtcagaaagagcaggtatgggcgggaaaatatgttcttttccccctaagccctggaaagcacacccatgttgagtcttactctgtcccaaatataaaagtttttaaccattctgaatataatacaaaacctttctttaatatcgtgtcccttaattcatcctgtctccataaaaacaaaaatctttagctattcagctaagaaaaagaaatggttaattgctgtttctgtttaatcgcagtgctttggagaagaggttgttcacaacaggtatccagcaatgaggacctggtaagaatttttttttctattagtaaggcctttgcaaatatgaccaaaatgtttttctttttaaaacgagatctggtattagactctaacatcttttattttagctacttgaatagagttctgccgtaggacaaaacaatttgataattactctgagttcagaaatgatgatgaattgattgtagtcatgtagtcagctgagttttgaagtaggggaattcctagattagaagcaaagctgctataataccatatttttcttcctagatcttaaatttaaggatatgtgatttgggaattgttttttttttttttacatagccctttgtaagcaaatgatatgggaattttaaaaggtagtttgggtgagcagaattttagataactgaaaagagactgtacaaagcttagctataggttggctatagtattaacatggactttctgaaa

SEQ ID NO: 112023 - DNA, 1123 bp, Homo sapiens
atgggccattatctgtgtataaaaatagtgataaaatacttgatagagacatggggatggataaattagggattgtactcatttaagaatggcatatgttatctattgtgttgtaagtttccttaaatctaaaaattttttcattatctacaatctgagcaaagcattggaacactttcttatcagacatcatttttgttctgccataaaattttattctatgaagattgtactttattccagaatcttcccatgcgttaatccgtaggctaaactaaaacaaaataaagtgcttatacaaaatatgtacacagtaagaaaggtataactaatcctttgaatggatttgaatgtagaatagtaaccttttaaaattcagaattaacacatcctattatcagacttttcgtttttttccctagcccatttcaatggaaaatccttataaagaacctcttaagaaatgtatcttgtgtggaaagcatgtagattataagaatgtacaggtgagatctggttttacttcactatattttagggttttgcttctgatagatctgcttaaagagaatcaagtcagtttatagcaggcttttgtagaggtaactgttttagcaacttcataatttcaaatttggttataattctatgtataagcttatctctgctttattcaagtaaaagcaccttggctttcccccacttactgttatttccactctgtttttttcactaccccaaacatcttaatagctccctgtggcagtaattctcaattggtgagggtcagaactttggaaaaagctcatctggtgaagctgatctctttatctcaccacccatatcactgattcacatattacttatctcttgtctaactctcagcaagttagaagttgcaaatttggggcaagtgaatagcgctagaattctgtatgttggctgggtgtggtggctcacgcctgtaatcccagcactttgggaggccaaggcgggcggatcacctgaggtcaggagtttgagaccagcctggccaatgtggtgaaaccccgtctctattaaaaatacaaaaattagctgagtgtggtggtgcatgcctgtaatcccagctacttgggaggct

SEQ ID NO: 112024 - DNA, 1092 bp, Homo sapiens
cctgcctcagtctcctgagtagctgggactacaggcatgcatcaccacacctggataattttttatatttttagtagagacagggtttcaccatgttgcccaggctggtctcgaactcctgagctcaggtagtctacccacctcagcctcccaaagtgctgggattacaggcgtgagccaccgcagctggcccatgagttaatatttcagtttatttctgtatattttcagcgaactaactggcatgataaaagctgtataaatgagaagttacatgtgaaaaagcattttacaacctataaggcttatttataacctacaagtgcttgttactgacatcctccagaaaataaataaaatttatataaaaggcaaatagttttgggtattatataccaccaatgattttatattatttgtgaatctagactgtattagtacacagcttgaaatattacctatgcccttaaattactttattttgcagagtatatgcaaaaaagtggaagacagtgaacaagcagtagataaactagtaaaggatgtaaacagattaaaacgagaaattgagaaaaggagaggagcacagattcaggcagcaagtaagtaaacaacacatctctactttctgtgctaaaaatttttatttatttatttatttttgagacggagtctcgctctgtcgcctaggttggagtgcaaaggtgtgatctcagcttactgcaacctctgcctcctggggtcaagcgattctcctgcctcagcctcctgaaacgctgggattccaggtgcctgccaccatgcctggctaattttttttgtatttttaatagagacagggtttcaccatgttggccaggctggtcttgaacttctgacctcaagtgatccacccgcctcagcctcccaaagtgctgggattataggtgtgagccactgcgctcggccctttctgtgcttttaaagaacataatactatggtagctatattgctgacatgaaagaacacaactttaattttgtcttagaatactgtggcatataaattagaattcagaattatgtatgttatcctcactttagataatacaa

SEQ ID NO: 112025 - DNA, 1072 bp, Homo sapiens
cactattatactaagcacatttcacagctttacatgtcatctgggcccagtgtggtgactcatacctgtaatcccagcactttgggaggccaaggcaggaggatcactgagcaacattaggagacctcatctctacaaaaaacttaaaaattagtcgggtgtggtgatgggtgcctgtagtcccagctacttgggaggctgaggcaagaggattgcttgagcacgggaggttgaagctgcattattgagccatgatcgcaccactgcactgcagcctgggagactgagtgagaccctgtctcaaaaaaaaaaaaaaacagttgtttcaagtcagtaaattctattttggataagtagtaaagaatgggttttggggggtgtatttttttaaatcttgtaggggacaagtaatctattccagcaggtagatactaatctttcttttcattctaagtttatactctaaagttttattttgtcagactttttcacagggtacctttagtggttgccaatctgggcatgtctgaacaactgggttataaaactgtatcaggttcctgtatgtccactggttttagccgagcagtacaaacacacaggtaagattcaactgctttctcacaaaacttctattcatctttgaaattaattttcttatttctcaaacaacagcagaataaaaattcaagggaaaattaatccattactcaagtaaactaggctgtttttaccttcctcatactcctgttactgcttgtgtacttacaagatacaaaaaaggtagtggttagtccaggcatggtggctcacacctgcaaatcccagcacttcgggaggctgaggcaggaggatcacttgagctgaggagttggagactagcctgggcaacacagcaaaaccccatctctacaaaagaaaatttaaaaaaatagtactgggaggatcttgttgcatatcctgtaaagtttagcatatctattctaggttagaataagtatatagcctaaaaattataattttctaaggcaatggttcggattaaaggcgtgaaattagatatttgtaaaaa

SEQ ID NO: 112026 - DNA, 1026 bp, Homo sapiens
ttgaagccaagtttgtcgggtaggtgatatcattcccataaaaattttaggtaaaagctgtagggttcagcttaacttatttaacaaaccaagtgtccatacaggcgattaatttattttcagggagggattgccttttaagtgaatcaatggcattgatatttttttcatttaaattttgactaaagagtgagattgcaagatagcaaatgccataaaagaaactacagaaagtcaagaatttatttctcccttttaatctatattgatgaaaaccgtaccctttcaaatgaatggaaagtaagtcagtttgtatgttttacaaaagtaaagcatatgattaaatgtattctttgtttatatatgccccaaatctttctaaatattaagaaagccattttaaggttgtttattttatttaattataatagtaagacatatcattgtaactattaagatgtatatcctttttattctgtatttcagaatgtggtaggttggtacaaattccgtcgtcattcagatcagatcatgacgtttagagagaggctgcttcacaaaaacttgcaggagcatttttcaaaccaagaccttgtttttctgctattaacaccaagtataataacagaaagctgctctactcatcgactggaacattccttatataaacctcaaaaagggtaaatgttggccagtcactggctgtattaaactaatagaaaaatatatctaatacttagtactttttgcagcttacaaagtgttctcatatattgtcgcatcagattgtcacgataaccttcagaagtagatcttaccatctgttaatttataggtgggaaaataatggtcagacaaggaaattagaagcccagtgtggaatgatgacttgtattctggcactgaagatttgctcttatttactacttaaggtggaaaaaaactttttttttaattgattgataaagggtataatttagaatttagaatttaagcctagatacttcagcagtttttctataactg

SEQ ID NO: 112027 - DNA, 1065 bp, Homo sapiens
acaccccagctaatttttgtattttttatgtagacagggttttgccacattgcgcaggttggtctcaaacttctgggctcgagccatccacccccctcagcctcccaaaatgctgggattacaagtatgagccaccatgccctggcaaaaattatttataaaggattttgtataacatatttaaccatcatagaaaatattgttgatcttaatgagtggtaaaaagaagaaaatattatttgcagtctctgttattggaagggaaagaaagctggaagtagaatcacttggaattatcttttaattcttcctacattttggatattccaactcctgaacaaactgttctaaaccaaacaaaacctattcccttcccccaccccaaaaaacccagccacctcctaaaatacatagcttttgtaactagcagtgaataatagtctttttgttattgtgcttcattactggttatacattcttttgtatgtatcaatgttataaaaaatataaatgagtaaactgaatgaattgtgaaccggttatgtgaacttacattttaatacctgtatttcatggatagtttactgttttaggttcaaaaaaaacgattcccaaaacttgtctcttaagttactcctttttccttttcattgctttatggactttatgtttctaccactttaagtcagttaatttgagaactttctctactgtttattttaggacttcatctgacaggcaaataggtatatgggctttggtagttgggttaggaataactaaaatttaaaatactaataaaattacttatatttttagcgtatttgaaatacctttaattttggcttttacagcttttataattcttcaggcgaagtaaatgagcaagcactgaagaaaatattatcaaatgtcaaaaaggtattctctaatttatcttccctttttttggtattatttgcattgtttttggttcttaaaaacacacagtactttgacagaatttttaagcagtgtttgacatcatagtatcctgtaaagtaagtaagaaaaggtttgttcttc

SEQ ID NO: 112028 - DNA, 1034 bp, Homo sapiens
tatttctgtaatcacagcactttgggacgcggaggcaggaggatcatttgagcccaggagttcaagaccagcgtgggcaacataaggagacctcatgtctacaaaaaaattttaaaaattagcccggcgtggtggcacgtgcctgtagacccagctacttggaaggctgaggcagcaggattgtttgagcctgggaggtcaaagctgcagtgagtagtgattgcaccgctgcactccagcctgggtgatgacagagctagacctcttctcaaaaaaaaaaaaaaaaaagatataaaatcttcattgtcaagcacattgggtctttaagtgtgcctagagaaattgaattccccaaaactcagataaattaccactggggtggcagaatacaagtagttttaaaagaatcgggctcacagcactccttttagaaagcagactctgaaattgaatttaaatctttcatattgtgcatgagttttaatcagaaaacactaatcttgtcatttcgtaccttagaagctttctgtaactcccagaagcacatgtggttaaatccagagtagtcattcggggtgtcccattattggctcgttcttatttatctttgatttccttctgctccaaggcaaagtgctctgctcattcttcagtgtgtgctcatttctggctttaagtcttatatgcttccaagtgtgcccagtgcttcatgctctgcctacacaaatattgcccatagctttagtctaatctgtagcctccccagggctacagggctaatctgtagcctccccagggctactctgattatttcaggctagactaatctctttcccttcctctcctctttatttctactttttttcttttgaggcagagtctcactctatcgcctgggctggagtgcagtggcgtgatcatagctcactgcagcctcaacctcctgggttcacgtcatcccaagtagctgggactacaggcatgtgccaccatgcctaactaatgtttctcgtattttttgtacagacggagtt

SEQ ID NO: 112029 - DNA, 1025 bp, Homo sapiens
ggggatggtttcaggatgattcaggtacattacatttattgtgcactttatttctattattattacattgtaatatataatgaaataattatacaactcaccataatataaaatccatgggagccctgagcttgttatcctgcaactatacagtcccacctgggggtgatgggagacagtgacagatcatcaggccttagattctcataaggaacatgcagcctagatccctcgcatgtgcagttcacaacagggttcaagctcctgtgaggatctaatgctgctgttgatctgacaggaggcagcgctcggtggtaatgcgagtgatggggtgtggctgtaaatacagaggaagcttcactcgcagaccactcacctgctctgcagccgggttcccaacaggcccagttcctaacaggccggtactggtctgtggcctgggggttggggacccctggcttagaggacatcatcagtagtacttaggaataagggctgagatagaacgtggagtttagcaaaagatctaagtagaagcaagtttaggttgaggaaattgagaggtgaaatgttggtagttattgttataaagtggcagtgaaaggaatacaggatggcaactagagagacaggaggattaatgaagatttttcttttcagaggaggggagatatatatttgtatgaaagtcaaatgagtaaagatgttgaagacaatgggtaggccctaggaaaaagaaagcaaacatggggtagagactatggattattgggatatccaaggaaagaaaagagggatgcatgtcttttccttaagaaaagaaagacggaatgaagagtggatacaggaacattttgaaaagcagaaaggagaagatcaaatgttggatgccttcagttagtaaagtaggaactcagaaccaatgagcttcaagggatcttagaaacaacttggtttaactcaattcatatatatttgtatttgtatatatttatatataatttggtatatatacaattaaattt

SEQ ID NO: 112030 - DNA, 1031 bp, Homo sapiens
gtgaaaagaaaatggcagggaaaagaaaaaaaaaactgatgtgtttcccttgttctagatgtccaagctctgtggcttaccagactgacggcaggtgccctgccattttctgaagggatgttctatctggttgtttattagttaccatctctctctatttaagcagcttcagggccaactgactctcggtgtcacagtgggaatttgacatttctatttctcatttgtaatttagggtacgttgacacatttaatttcgtaattgtgtacttaaaaagtgagtaaactaaagtttattagtgctttatgaaaactgaaaatactcccgaagactaacattatatttggtgagcctcctaatgaggaattagaagacttgattcaatcataatattatcttactgcttatttgaatttactaagtccttggcattatactaaatgcttcattttagggatgaagaaacagttcgaaggggtgatgacatttgccaatgttttggagctaataagggctgagtttggattgagaatcctcaacattctgaattgttgggtgcttttattcctaggattatttcaggcttgatatcctgctcaatgctctatttgtatttgcctccagggaatattctctttcctctatcccagttcaacaccctcactccagtttcctcctctgtaagccattctcccaaggtttctgtgtgttcaccactcataactgaaggttgccagggtaggatggaaagggtagggcctgaggcgggagaggttgtagaagaggaaagaacatggcagtggagacttacagcagaatgaacaactttaaaactgagcattagatgacatttctgttttgaaaattgcattgatcaccctatccctggaaattctgcagtgaccacctttgttgaaaggcctagagctccctgccatctccaacatactcacgcagctcctgtacatgcactcagaagtcggtttgtgttttaaataacttctttaaaaatctcatcaccaaatgctgt

SEQ ID NO: 112031 - DNA, 1032 bp, Homo sapiens
gaaagcaaggaatgtaatcttttttttttttaagagacagtatcttgctctgccacccaggctggagtgcagtggcacaatcatggctcactgcagccttgacctcctgggctcaagtgttcctcccacctcagcccccaacatgccccgcctcctctccccccactccccccgcccctcagtatcggggaccacaggtgagtaccaccacgcgcagctaagttttgcatgttttgtagagctgggtttttaccgtgttgcccaggctggtctcaaactcctgggctgaagcaattctataccttatgaaggcagctaatatttctgttctaagaagggaatgagggctggacatggtggctcacacctgaaatcccagcactttgggaggccaaggcaggaggatcacttgagcccaggagttagagaccagcctgggcaagatagtaagaccctgtctctatttttttttaaaaaaaaggagtgaggacttgtgcttagaatacactgcatatatgttactagactttaagttgaatcaaaatctcttgtaacataatttaaatgctaccagttgaattaataaaaatcagaaaagtcctaaagaaaaacagcgacaattctaaatatagaagtcatcatttgtatataggagcattcagaaattctggatttttcatacagagctgccaacagtttatatgacatggtaacacaaggagtgattatttgtatggcacaatggggatgaagtgtgaggcttgtggcggtggtggggtgcggtcgggcatgccaggcccttacagcgagggttgagggagaccagttctcagcatggcaaggaccagctggtgtaccagcaggaaagctctgctctgaggagcaaagaaaggcccaaggataaagaaatactttgttttttggagacggagtctcgctcagtcgcccaggctggagtgcagtggcgcgatcttggctcactgaaagctccgcctcccgggttcacgccattctcctgcctcagcctcccaa

SEQ ID NO: 112032 - DNA, 1025 bp, Homo sapiens
tgtaatctcagcaccttgggaggccgaggcaggtagatcatttgaggtcagtttgagaccagcctggccaaaatggtgaaacctcgtctcttttaaaaatacaaaaattagccgggtggtagaggcgtgtgcctgtaatctgagctacttgggaggctgaggcaggagaatcgcttgatcctgggaggtggaggttgcagtgagctgagatcacaccacggcactccagtctgggtgacagagtgagatcctgtctcaaaaaaaaaaaaaaaaaaagaatattaaagatctaagtaaagtaggtttgaactgttattggttatttaagtttattacatacacatacatgcatagatatatatatatatattatgtttttatgatatttgtgttaagagaatatggatgattcacacatatagttggtactcaattgatattactttatgtgttttaaaaccttgtttctattcctattcttaactagatcatttatattttgagaaggacatgttgtatctagcttgcagttgccttataatgtcagcactcaaaaatgactaattcaatatagttttattaaaaacttctaggaggtcgggcacagtggctcacgcctgtaatctcagcactttgggagggtaaggcgggcagattgcttgaggtcagaagttcaagaccagcctggccaacatggtgaaaccctgtctctactcaaaatacaaaaaattagctggatgtggtggcgcacacctgtagtcctagctactcaggtggctgaggcaagagaatcacttgaacccaagaggcagaggtttcagtgagccgagatcgcgccactgcactccagcctgggcgacagagtgagactttgtctcaaaaaacaaacaaacaaaacttctaggaaattacaggtactattttaatatggaatgcatacccatgttccttaaaaggccttctatttgtagtttttaaattgtattcacagcttagaatcatactttctaagtgatggagttact

SEQ ID NO: 112033 - DNA, 1013 bp, Homo sapiens
aagctaaatatcacatcaaaaattttgtggccaggtgcggtggcacacacctgtagtctcagctattcgagaggctgaggcaggaggatcacttgagccctgaaattccagtctgagtccagcctggataatatggcacaaccctatctctaaaaaaaccaaacttttaaaaaaaagttttgtgttgttctgtggtctttataatcattagctttactagattgtctgcttgatggaatgtagttcatcatggagttattcacttacagtgaatgaatatctgaattcattcagtgcatcatttaaagttattcaaatcattgtgttatttgtagacattcaggttatgttcttttttttattgtgaataacactatcatgaacatattagaacataaatatgctctaactttatatgtgggagtattttcttagaaaaaatttgcaaagtgaaaatagacacttatttgaataacccataggtactcaatatagttcatactcaaaatgaccagatctgaacttctagtccatacctcggccatccagagtaaatctgttgtcaaagttaaataacaatacacagacaaatctctatgcaaagcattttatttgggaatgtatatatattttttaaaaaaacaaaattgcacttcagagcatatacccagaccagggtggtctttgatatgtctaaagaataaagagaaggttgggagttttattaaagagagaaatgctacatattgttttgaaagaaagcccattagcactagtgcacttttggggagttggcaggctctgactggtgagtgacagtggtggcaggtaaaattagtcttagagtcatggcacattgttgtttcagcagccaccaagtaaaactggtctgacggtatggccagctgtttcagaagctgggctttggataattcgtggagcaggtgctgtgtgccctgagtgctttttccgcttggcccctcaactctgatcttagttgaatatgacagttg

SEQ ID NO: 112034 - DNA, 1049 bp, Homo sapiens
ctaccacttcacctggatagtgaagtggcatcttgcctcctgactgccttgactcttgtcaccgccccagcccactgtttccaccttattctcccaaactctcatgtccagtcatgttgcttcaactcctcggtgcactgcttcctgctgtttcctaggattccaggaccaggctcatctctctctccttcttacccccacctttgtcttccagcaactccaccctcctagtagttcccttaatacgccccattccctctacaggtggtgactctgcagatcctcctcctctggctctgccgttgcccaccccctccccctgccacaggtgtgtctgcctctacacacgtccatttgcctatttcacatgggttgtagtcgtgtttcctccctgagagactgtacctctctgtgaacagatgccctatgttatttctataagtcctcagtaactagtaaagagtagacacttaaatactgacttgtttttaaggttcttgaaacattaattgggccaacagagtcctatgagtgtacattgctaccagtgttgatggtgtggagtattaatttctgtgtaatcctccagtcctggaagatacacatatagttgaaggatttcaacactactatttggaaccttttgttttctgttttcctagaagttccatattaattgtccttgcaagctatagttgatgatcatataaatataatgcgtgttattaaaaatacttttgttctctcctctcagtaaaagaaatacaatttatagtgccagtggatgtaccctagcaaatatgttcatagaaattacatcagtatgatattttaaaagccctttggatctgactaactttgctttaccgttttatcttaatactaaacattgtctccgttctgtatttttgttagaaatgacttgatattatatacaaaggttatttgaagaaggacacttagatttcctcctgtctttataacacatttatgacttttgcctacaagtactgtttatggtttgacgtacttttctttatcatgtggct

SEQ ID NO: 112035 - DNA, 1023 bp, Homo sapiens
tggtttagaacactaagttggtaagtaagcttgaaactatttcagatatgaaaagttaatttctgaagtttgtaaaggaagcgtcttgatcagtcagtatccactcaatttaccctatagattgattctagagaaagataaataaaaataatgtaattgaattttgaaaagatcacctttgtctttcctactccaatacaacttttttcagatctcatattttagtctttgtagagatatctaatatgtgaatatatacaccattcttgtcctttttttaataaaaaactaaacattgtattggaaacatttttgtatcctttacaataataattttagcaaaatatttacatataatcttttccttcattttccttcatttcctctcagttgacatgataacatacaacatattgtatatatacaaatgcacataaagttagtaacaaaatcaccataatgatattaacatttaaaattttatatcttttaaaacttttcatatataaatcattgctctcagaaccttgactaggaaacatgataacattatagttcatatttaacccaagtggccatcctttttaatatagttgataaatatcaaccagggagtcagtgtctttttaaaacagatggggtttagaatagtcaaaaagaagtgtcttgatttcggtgatagctgatttttccttctagcaggtttcttcacgagtggcaaagtatacaggaaatgttagatagataaagtaattggagaataattaaatgtaaaaccatgcagtattgattctaagtattattaagaagagaagataaataaggatgggctccagtgattgtagaaggtgtcaaacaagaggtaaaagataaactggtatttgaaatgaagacaagttttggataaagaagagttttctagttggggatgtagcacccatcagtttctagatgtgggacagatgtacttatactaccgttgatgagacattcctggcccttctgagcagatggtattgatta

SEQ ID NO: 112036 - DNA, 1504 bp, Homo sapiens
gactgcagttcgtgccgcttgctgacttgggcactgacctgtggcccctccatgtggcttggatgggacaggcagcccgggttctgaatggggagcatgccaggagccaggtgtttcaagaggcctaaactagttttttttgctgggcgcagtggctcacacctataatcccagcactttgagaggccgaggcaggcggatcacaaggtcaggaaatcgagaccatcctggctaacacggtggaaccccgtctctactaaaaatacaaaaaaaaattagctgggcgtggtggtgggcgcctatagtcccagctacttgggaggctgaggcgggagaatggcatgaacctgggtggcggaacttgcagtgagccaagatcctgccactgcactccagcctgggagacagagcaagactctgtctcaaaaaaaaaaaaacaaacaaaaaaaaaaaaactagtttttttttttaaatgaaaatatatgcccatgataaaaatttagactagaaaggagtattccatgaaatcctcctccacctcagtgccttacttacgatatctggaggcttactactgttattccagaaattgtctgagtattcaagcttttatgtttatatcccccctccctttttcttatgcaagtaagagtatctcttctgtaccatttttccacttcatatattaatagcttatagatggatttatattggcacatctacatctatcattgtatccatatctgcagttacatctatattgatatacagcaatagctgagaggtagaatgtcagcatataaggtgattactgttttcccctttggttttgctataatttatgcttgagaataacatctcaattgagtgtggaccgatagtgtagttcattttctttgttgtttctttttatatattttgtctttcatagcctcctaaccagcccctttttagtaattctttgttccatatatgactttttggactctacttctataaaatacaatcaatgttgtgtcttttttttttgaaacacagtctcactccattgcccaggctggagtgcagtggcgcgatctcggctcatggcaacctctgcctcctgggttcaggtgattctcatgcctcagcctcccaagtagctgggactacaggcatgcgctactgtgcctggctaatttttgtatttttagtagagatggagtttcactatgttgctcaggctggtgtctaactcctgagatcaagtgatcctcctgccttgatctccaaaagtgctgggattatgggcatgagccaccatgtctggcctggtatttcttcatttttctaaccgtatacttatttctgccatagacatgttttaccatttcttattttacactcttagaatcacagaaacttactgaaagtcatcaaagtcattcttagagcaaacatttcagtgttttccaaaagctagatactgtgaatgatgttgaggatataaagggagatgaagtga

SEQ ID NO: 112037 - DNA, 1459 bp, Homo sapiens
ctactcagttaaatgatgtaacttccagtataaaacaggcatagaatactatatgtctattatcattttaagcgttgcctaaaaatggctcggttagaccaaaagcacccatggtgtacctctcttgtttatttaattcccagagcgcagtgcaggcctggcattgagggtccgactatgtatttgttggataaacgattaagaggctgagaacatgcacatccacacacagtgcttcttaatgatattttcttagtatcagtgttttgtttgctgagtcttgaggccttagtggctactcttgaagtgcttagcaacatttgtgagcttagtctagcaaatggagttagactttgaaacaggactatggaaatagaaagtatgctaacattgagatatttgtacctttctttcaaattatgttgtagaaatctttggaatccaagtctttctgttaaacaatattccaagtgccctgtgaaaattttagttctattacagtggtcaaatgacttcagaaaatgtatgtcttaccagatttaaaaagcagagacagttcaaattacttcattgacattgaattttatttaaataaaatgtaggtatctccaattctgaccccctcatggaggtccatgaaattaaatgacttgtttaatattatacaaaatgtctcactgactaggacctagaagtcatattgacatttagataattttgttgcaaaatgagtttgactgatagcagagaaaatcagggagactaaaaataataaaacaaacgttttctctagagtctagatatatattaaaaagaactcatcaacttggtgatttggaattggggctctttagaaaccagagcagtcatgcaattatatggttagcagtgatgtgtaaacagacttaaggtgtttgacccttaatatcatcaccttacatttctttatccaactatagtgatgtgcatattatatttaataaattattttttgcttgtatttgtgcatgcatagctattttgatttctttaaagttcttatggagataatatgacttgaatataatgctttgagtccaagaaaattgatggacatataaaactaagttatagccaaaattaatgcataattaagatgttttccccaaacatcctgagtatcttttatatcagaggatattaatgaaatctttagaaaagtgtcacaaataattcacaaaggactgtatctccaaaactacttaaaatttctgaattaaagactgctaaacactatacacatgctagtattggttctaaaccttagactaaccattcagattaatagaaaactttttaaaatgttaactaatatgatgattggtttgtatggtaatctccacgatgcatattcatttaaaactttttcagaacaactcagttatagcctggtgtctgaataaaggcacacaatgcagtg

SEQ ID NO: 112038 - DNA, 1004 bp, Homo sapiens
tttattttttatatgttttaaaagttagtactatataattagaattctatttatatataaattaaggttactttgttaaatgttttcattattttaaggttccagtaggcaacaaaacaaacataatttactaacagtgtttttattttatatgactctaacttgtacattttgaccaaaagtcatggtagaaatttgggtttcaaatcgctgttgcttcttcagctgcactgatcagttgtgttcactaatttttgtattgttgggctattaacagttcgcatggactcatgtcactttactgataactgtcactcagtcacaccttgtcatccaaaatctgtttgaaggcatgatatggtaaggcaacagaattatgctgctttataagtatgtcatagcacttttatagttctttaacgttggatagtgtcttacagatttctactaaaatgtactgtttgttgttcttatattccattaaactatcttactgagttttgcttactctttgacaactaaagacaaaatgcttcattaacaactggataccattcttattcaagttccaaatataggaagttcccataaaagacccaaaaaattaattacattttcaggtgttaataaatcctagtgtaacttttcacaaaagacagactttaaatataatatttattaagatattatttacatagaatgcaaaaaaatataaaactttgcctactagtaactactgtgaagaaatgcatgtttttctaggtgaaagttgggtaggttttctactttgctcctgtgtaggagtgggtttccagattgtagaagttaattgctctatggcagtggcttgcatattcagaaagcatttttgttaggtaaaaattataaaacttattacttaaaaattagttggaatggagaaaaagcttaagattaaaaaaaaatctgactgtatttttcccccactcatttaaaactcattaattaaaatcttttacagttga

SEQ ID NO: 112039 - DNA, 1088 bp, Homo sapiens
tgtcaagataaattgtattcccttgacagctttatgtctttttaccaagggtgtggttgtgtctttgtgtgtgtgtgtctctgtgtgtatgtgcgtgtgtaaagtaattggaatcattttaagattgtctttcatgtattgtacagacttttcattgatggggcagttactgaagtaagtaggttctgtacattcagtagggtttactgaaatcataagctaagatagaattaaaattaataattgagaatatgtattaagagcttgatataaatttatcagattatgttctgtctaaagaaatgactcattttcatattaaaaggctggttttcttaagattagctttcagtctgccttttattttttattgtaacatgttcctcataaaactaaaatgaaaacatccataactgtagaaatcaataatttaatattttcctagcatgctagtttatttttagattttgctctgtttaaattggtaagtgggcaaatttggttgatatttatcatttctactgttttggcaagtgttatgttctgggtaggctgcagtgcaatccaaagggttattctgatggttcattatgaatcataacctttccgaatatctgccacttactcaggtgaacttttttctgctgacttttttttttttttttaaaaacaggttccttgttccaatatcaagtgttatctgcaatgacataactgcttacctttttggatttttttttgggagaactccattaattaaggtaatggaaaaattttataagcaagccactatgtaaccttaaagattagccactggagaacatttccaacaactgtgctgttgtgcattttttatttttgaggtgctttgattttccttagctgcatggtgcagaagcagcaaaccatatttctcagtacttccatctgggttcttcatcagctcttctgttggctcctcaggaagggcatgactccatcagtctgcctgcctgcctgcctgcctgcctgcctgcctgcctgcctgcctgcctgccttccttccttccttccttccttccttccttccttccttccttccttccttc

SEQ ID NO: 112040 - DNA, 1053 bp, Homo sapiens
aattgcaatggtgtggccagggaaagaataatttagtcaaagttttctgggttggctaagaacaatggtgtttttaacctgtactattttgtactattttattgtaattttgaattactggttaattattaactgatgaaattaatagaagcttgtgtgcagtatacttcagttctttattctcctgtaccgtataattgtgattatgcagagattacaatcttattgatttcaaaaaaactttttttttctaaaggtcttttaagtcttttactaggataattatgaccatttaactttgaaaatacatagcaaaatattaagacaaagaaattctggcattctatctctggcctttctgatgtataacttaaaagatatatgtttagtcaatgtgttatgaacttttgctttgttttttgttttgttttgttttgtttttaatatcaggctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggtacagtaaaagttcaagataaacatggttagagatcttccactctgaagattaagcttcctttattatttatttatttatttaattaatttattgttgttttgagacagagtttccctctgttgcccaggctggagtgtagtggcgtaatctcaacttactgcaacctttgctcaagtgattcttaggcctcagcctcctgagtagctgggattacaggcgctcgccaccacatctcgctaaattttgtattttaagtagagacgggtgttgctatgttggccaatctggtctcaaactcctggtctcaagtgatccgcctgcttcggcttcccaaggtgctgggattacaagcatgagccattgtgcctggcctgaagattaattaagctttctttaaaagtgggattcagatttgtacaagaaactgatttctgtagaatttttaat

SEQ ID NO: 112041 - DNA, 1006 bp, Homo sapiens
cagccagcacctcctcacatgcacacatgattagacataggtgcactcggtaccaagagtccattttatggtccagcatatactccattgattcatcatcactgcatgtgttcagccagtgtatctcacactatccatacaaatctaaaattgatactggaaatgttattataggaggcagtgatcgcatttaaaatcaggccacctacaagtttaattttcaacatctcatgtttttatttgtcccattacagcctcaaatgttggtcataaaaaaaatttaggctaccaaagtttaaagaataaaatgaaaattttataagaacttacattaaaaactcagtagtttgcatgagtaagaactccttgagatacacagatccccccacatttgtatttaaaataattggtgaggcattgaaatccagaattataagaaagcattactgaatatgtgtgttataaaatcaatattattataaacaaaataggaagctagaaatatttgggatcacagtaatagcttttctcaaatatacttttagaattgaatgtacattatcctatatgtaaaaaagcaaattattaattttaatggagctctcgattgacctttttagcatacttttatagcatgtatattaaaatagaatatattttagcaaaagattgccataaaaccctgacttggctcattttgatatttgcactgtgaagagggcttaaattccaatgtagcaatgtggtggcagacaaatgaaaaactaggaagttctttcacagtaatgcctagttgttccaaatttgctatatttggaggtgctctactggtacttcctgcttgactctctgacctgtgggatgcacattcttcctcagcgctttttccttgttgtggtgacgtacattcactatctgagagtgaaagaccacacacacccctctttttaaaattattgtatctcttccttttcactttggtttgaacaaagatagtgtcaccttg

SEQ ID NO: 112042 - DNA, 1713 bp, Homo sapiens
taactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccaccaaaagaaagaaaaagaaaagttgttaagtcagttattcagggaaggaaaaacagagatctaataactccctaactttatgtagttcttttctagttgtaaatactttcagaagcacctgcataagattgcagaagtattggctgttaaggttccagttccagttctagtttgactcatccttaaaaatcaggctttctgcagtctgagcttctcaattgtgctggattcccagggctaatgagtgtatgtggatggcagtaaggagaagcaagccccttctgggagacgtgaccctcaaatttgactggacctgtggaaaaagacatgtctgcatggttttggctcttttttcctgagctttattctccagccaaaaagtaagcaacagtgtgtgtatatatatatatgtgtgtgtctcttgcacccatactatagtcacataaggaatattccagtgtcctgcccctcacctggaactacagcagccgctgttagcagctggtctttccagttcagccttcagtctgagagtgttagaacttacaatccattgttcttgttatgagcttgtttgggtttaaaatagcctttctgtaaagaagagtttttaagtttatttaggctgttttgatgatttcactttccctctttctaaagatattaaattcattttaagcttgaacagcagagccccaaatttgagtatgttttgcttattacaaattt

SEQ ID NO: 112043 - DNA, 1368 bp, Homo sapiens
aggaaaatcttaactctgtttttttgttttcgtttttttaattcttgtcagtcaaagaaatagcttccctggtttaatactgcttttcttcatagactgaaacaaataatacagctttccttttagtccttgttcagccacacaacacaaaccagtatggcctttggcattttactgcaagctttccattcgattattaatgtttccggtgcccatgatcaagcatggagaagacctataattaattgacttttcctttcctttaggtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataat

SEQ ID NO: 112044 - DNA, 1048 bp, Homo sapiens
tcactgttggcgattcttctggagtagtaatatggtcatcagagtgctggtgtggagcaaggagtccgttcctctggggaatgacatgaccttccttgaggaagtctaaggtctggctataacttgggaggtactaaagacataggtttgttgataatctgtgtccctatgacattctggggagcatcccagattactctgtacaaccctagggaggcaaacctgaatggtagtacccaaaccagagagtgcccagaaataggaaagctggaggaaagtcctgcagaggccctgttaggttgaacattccacccagcaggtcttgtaggagattcaaaagcccagctctatttcagagatcattttttctcaacgtaggtatcaggatgcttgatttatatgaatatttgaaattatcatgctctatgagataatgacattagtttttcctgttcctgtcctaataccatgatttcttttttctagaactcaaagaacctgtaggacaaatcgtatgtacagataaaggtattcttgcggtggaacagaataaggttcttatcccaccaacctggaataaaacttttgcttggggctatgcagacctcagttgcagactgggaacctatgagtcagacaaggtttgcattatttcctgcctactcatttaatattgctcttttgtggtctggctatcctatatgactaatagggttggggagaacccagtccaagggcttgtcagctgttcctccaaagcccaaaagaaaagtgagctttcctatttggggaaaggagagcttcactgaatgagagcaggataaaggagctcatagagatgtcatgttccctgcagaacaagcctcttttgcaaagttgtgtaacaggggctagcagtttccttctcactcaaagaattcctccgagagatcctagccagcaaggagctcagcatttctgtcaaccagaatagcctccttttgatgagtcaccatctgccccacttttcattttagtgctccaaacaagctggcagaaaacctgttgc

SEQ ID NO: 112045 - DNA, 1031 bp, Homo sapiens
caatctcggctcactgcaacctccacctcctgggttcaagcgattctcctgcctcaccctcccaagtagctggaactacaggcgtgtaccaccacgcccagctaatttttgtatttttagtagagacgggtttcgccatattgcccaggctggtctcgaactcctgacctcatgatccgcctgcctcagtctcccaaagtgctgggattacaggcatgagccacctcacccagccattaatatttttaatcctgtagaaatacagaatgacgatgtagcacatttttgttttcttttttccctttacaacatagcaaagcacaaagaagatgataatattcacactttcagcaaatcagtagcacctttttaggacaccaaaatgatatttctaaatcacataaaggccacattgaaaccagaaataatccaactagatagagtgtctgcctgccttcaatggcacagaatggtattaggctactgagagttaacttttgaatatcattggaaaataattgtcaatcaactgtagattgactttctttgagaaagttattgtgaattcagcttagcatagaacaagacaatagcccatgctttagtatcatagtcctgtccctgcttattcaggtgtgagttctctggccaccttcatagcgtctttgaatctctttcctcgggtgtaaaatgaggataatatagtacctaatagttcttgtgaaccttaattgaaataagaacacaatgcctggcatataaaagggcttataagtgttatctttcattataaagtgagtcatcttctttcataccagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaaggtaaaataatgagaaataaacttttgattaatgatttaatgggattgttaataatcccagtttaa

SEQ ID NO: 112046 - DNA, 1007 bp, Homo sapiens
ccagaactcatatttcttacagccttgtcctctctttaaaatctactattttttggatgactttttaaaatctttacatttggatttcagtttgattataaaaacaaatgcagagagaaccctctgtaaggattaccccaaagagaattagatgttttatgtttattaaaaatttgtgcgtatttaatgtaggataatgggaaattgaaatgtcaccaactatagttggagttttcaagctcttgaacttgacagaagctgtcaggtgggaacggttctctaatagagaggtgtcttattctgcccacagggtggccactttgacctggctgaccggatgtttcacagtgtgcgcgaggcctggtattcagcgtcaaagcacaatatggcagatgtaaaagaacttatcccagagttcttttatttaccagaattcctgttcaattccaacaactttgatctaggtacgtagagctatggcactgtcttaggaatgttagccaggaaaagtccaatagaaataagtcacttctctgaagattgtctgcagcacacattaacaagaaaaaaatttgatacagtttcttgcagtcatttgctgtaattgggtgtggttacatgtgatttttgtcgttacaaaaattagccagacgtggtggtgggcacctgtaatcccagctacttaggaggctgaggcaggaaaattgcttgaacctgggaggtggaggttgcagtgagctgagatcgtgaactgcacgccagcctgggcaacagagcgagactccgtctctaaataaataaatattgagacagattactcccaacatttagaatttcgttgttttgatgaaaacagaggtgaaaatttattgaaaagtattactattgaaacccattaatagctaagagtggtacatccaaattttccatgtattgttttaatcttgtttattgcctaatacattctcagttcataggctaatgtgttttaaaattagaacttcaga

SEQ ID NO: 112047 - DNA, 1129 bp, Homo sapiens
gagggaggacacaagggagatctgatcctccagttatgtgagtgatgaagttaacgatgaattggagctattgtgtccacagtctcctgctgggtccttgtcaagacttggaagtattttccctcttaatcctcatcccctaaacctggatcctgagtggcttcctctgtgaaacatataatttccaaagcacttgtcttccaactgaatctgttaaccaactcccatgtgcctgtctgtaaagtgtgtataaacagtacatatatagcattattttggagtccagttataccagtttgaccccacagatactagtgcgtttataaatcatcatcatccacaacagccactgtatctacgttagtgaggctagatagtgtatagtaacttggaattgagttacattttgtattttaggaggtggatcttactaatcccaagacgtttagaaacctggctaagccaatgggagcacaaacagatgaacgattagctcagtataagaagcggtataaagactgggaggatcctaatggtaaggaactttttctgtcattggactttgtacccaagtttcaaaagtaagtcattatgtagcggtctgacattcctacatcctccttcaaattgcttatatatcatatctatatgtattatatgtccacacatatatgcagattattatagcagaggaatcaggtttgcatgccaacttatggccatgcttagaaggcattttaaatagcttatcagagtattggtggaaaactaagtattcctgctttgcatagggcagaaatttcccatcataatctgcctctgtctctaatcatgtttagtccaggaaccatactttaatttattgtctctctttaattttattgaggcaattttggaacccttttgcatttaaaaaaaattactatactctaaaaccttatagtttacttgttatttattatgtttaatgtttatggtgtttctccctcaaaaaggcaaaacaaaggagaaagaaagcctaagcttgtagtcctatgtgaactcttttttcccaccccctctctgccaaggagaatatgtagtaaaaatacataaaagtgcttaacattcataaacaatgatttagaga

SEQ ID NO: 112048 - DNA, 1091 bp, Homo sapiens
aggactacaagcttaggctttctttctcctttgttttgcctttttgagggagaaacaccataaacattaaacataataaataacaagtaaactataaggttttagagtatagtaattttttttaaatgcaaaagggttccaaaattgcctcaataaaattaaagagagacaataaattaaagtatggttcctggactaaacatgattagagacagaggcagattatgatgggaaatttctgccctatgcaaagcaggaatacttagttttccaccaatactctgataagctatttaaaatgccttctaagcatggccataagttggcatgcaaacctgattcctctgctataataatctgcatatatgtgtggacatataatacatatagatatgatatataagcaatttgaaggaggatgtaggaatgtcagaccgctacataatgacttacttttgaaacttgggtacaaagtccaatgacagaaaaagttccttaccattaggatcctcccagtctttataccgcttcttatactgagctaatcgttcatctgtttgtgctcccattggcttagccaggtttctaaacgtcttgggattagtaagatccacctcctaaaatacaaaatgtaactcaattccaagttactatacactatctagcctcactaacgtagatacagtggctgttgtggatgatgatgatttataaacgcactagtatctgtggggtcaaactggtataactggactccaaaataatgctatatatgtactgtttatacacactttacagacaggcacatgggagttggttaacagattcagttggaagacaagtgctttggaaattatatgtttcacagaggaagccactcaggatccaggtttaggggatgaggattaagagggaaaatacttccaagtcttgacaaggacccagcaggagactgtggacacaatagctccaattcatcgttaacttcatcactcacataactggaggatcagatctcccttgtgtcctccctccctccacccccgccctgtctccctccaacgttacttctgagcattttcttctcagag

SEQ ID NO: 112049 - DNA, 1071 bp, Homo sapiens
gcagatcatataatgatctcatgcagtatcctgtcttcccctggatccttgcagattatgactcagaggtaaatcttaagtcattttgcttacgtagaacacattttcaaaaataattttaaaatacgacaattgaagtggggtgcagtggctcatccctaaaatcctagcactttgggaggctaagagaggcgaatcacttgagcccaggattttgagaccagccagagaaacagggcgaaaccctgtctccactaaaattacagaaattagccaggtgtggtgccagaccccagatgtcccagctactcaggaggctgaggtgggaggattactttagcccaggaggtggaggctccagtgagccaagattgcaccactgcattccagactgggtgaccaaccaagcaagactctgtctccacaaagaaaaaaaaaaaaaactacggttgcctaaatgttttatttggtttgtagtttaatgttctcaataggcaaaggcacttaattcaaatagatgagaagcatttagcacagacatataaaaagtttggataattgacccacttactgagtactggctattaattcataatatctcttcagtttctttaagtgcggattaatttgcatctattggtggatgtcagaatccatctgtgtagtttgaagtgtttgttaggaaaacacaaagtaactcttctacaaaatgttcctgccatataaaagaaattttttatactattccaagaaggcttggtagaagatttccaacaattcaacatgtacatgacttaagtctcaaaatcaagaacacatagatgcatatgaatattttgattcccctcttcctttgcctcctgtctgatagacatctgattagttcagaaatgaaccataacaggcaaaacaaaagacacttagccctaggtaaacaaacaaaaagattgtttttaaaattcagaaattcagtgaacgttcttattcactagaatcatgactgcttatcctttcagaaattttagacatcaacatattaaggggaaagataaaactatcctcagaaaattt

SEQ ID NO: 112050 - DNA, 1035 bp, Homo sapiens
cagaataagaaatatctatttattgtgtagcttaatctgcagggaattcatgactctaaaagtgttagcaaattaacttcttttttttttttttttttttttctgagacagagtctcgctctgttgcccaggctggagtgcagtggcgcgatcttggctcactgcaagccctgcctcctgggatcatgccattctcctgcctcagcctcccgagtagctgggactacaggtacccgccaccaaggccggctaattttttgtattttttagtagagacggggtttcactgtgttagccaggatggtctcgatctcctgaccttgtgatccacccgccttggcctcccaaagtgctgggattacaggcatgagccaccgcgcccggccgcagattaacttcttgaacattgtagaaatttatagtggaaaagttaatatataattttatttgtgaacttctgttttttcttaatgtttttctctctgatcatttcagcctattgctgtggaagttttctctggagatggacggaattacctccttgcttttcagaaaggaatcagaaacaaagtctatcaaaggtcttgtttattcggaacactttgtatactattatgggaagatatgggagggggaatcttttctcagttttgctggtttttaaaaatctagatcaatgagccaacatctttgaagaaaataatttatattatttttgccaccctcttgaaacaattattcttctgacttttaaaatggtgcaattctattgtgacataccatttttccttctggtaacttatagtagagatcatcaaaaactacttttatcactaagtcctgtgtctctaaatacaaaggatgatgaaactgtagctttaaaaataaaactttagtttctttttttcttcttctttttttttttttttgagacggagtctcgttctgtcgcccaggctagagtacagtggcatgatctcagctcactgcaaactccgcctcccgggttcacgccattctcctgcctcagcctcc

SEQ ID NO: 112051 - DNA, 1096 bp, Homo sapiens
cttccttttcttctaccagtcctgtgatgaaagtggtagtgagtagtggaaaactcaggagacagaccaacctagaagaaagttaagaagcttagggcttagaagatcaacaggctgcttctcttcctttaacattttcctagcacccttgaacacagacattgtttctgtagttcattcctaggagatatttcaaataattactgtcaacaacaatcagggtcacatgaagtctttcgtgggtcctttttccatacaaaaatatttaaaattgtatgttgtggctaatggtataaatataatcttatattaaaatgtgtttttctacctaaaagttgattttttttctgatttttaaaagaaattaagacattttcttgggccccaaaatatgtgagctgaggcactgtgctaaccatgtctggtagataacttggtcctgacagtaataaggggatttttaaaattatattcatcaaagggggttccttgtatctcaggtagctaacaaattcttcttgtaaatatattttttaactgaaaattctgatatatattactcctccatcctgttcatgtgtttaaaattagcacgccctttatggaacagtgaatttatcccttgctgtgtttttatttgctttttctcttggctgcctgtagtatgcatgagcctattattcctagaggagccaggcaaggccctagtcaactcaagagaacatgcagcatttttgcatatgaagatatcaaggaagttcataaaaggagatatctcctgcaggtgagtcaatttagtagtactgttttatcatgtttctttattctgaaaatgtattgttttattttattttattttttattttttatttttattttttgagacagagtctcactctgtcgcccaggctggagtgcagtggcatgatctcagctcactgcaacctccgcctcccgggttcacaccattctcctgccttagcctcccaagtagctgggactataggcgcccgccaccacgccaggctaatttttttgtatttttttagtagagacggggtttccttgtgtcagccaggatggtctcgatctcctg

SEQ ID NO: 112052 - DNA, 1076 bp, Homo sapiens
gcagaactggaaatttaccctgagttagcaggccctgcaattttcactctgtatcatcttgcctcacatagaacacaatcctattctaatctccttacatgtatgcctcaattccctttcctgccaagtttgctgtgtctgtctcccttcatgagagcaggagccttatctaatgttcttgacttttagaagctagcgcatgtttgcctggcctacataaagtacacccggaatattgagagagatgggattggcagatgagtggatgggtatgagtgaattgtttagttttactctagtcagatgtaaatcagactgtaatctaagcttaatcttctcaatatgcttaaactctgatttaatatgcttagctctagggatgccgtagtagtctaacaaaaattgatctttacaaaaagcctatattaatgaatgtttgtgggcttctttatagatccaacacatgtaccgctgtgctcgagtccagggcctagataccagtgaggggctccttctttttggtaaagagcatttttatgtgattgatggatttaccatgacagcaaccagggaaataagagatattgaaaccttacctccaaagtaagtaaatgaatgaagagacataatgtatggctatctttagaagacagaaaatgtatttgcagttttcttttttaatcaaaaaattgtgttctaggtaatgttatctctcggtttgtgtgcattcatcattacatattcacaaagatgatattcagttattttaaggtaataatgaaaatgtttggcttatttatcaagatgaaagctaaataacatttatttctgtgcattctgagttatttatattataatgtatatatttacaaatttattctgaatttataaatggtccttttaaaaaatatagcagatatacaattgtagagaaaatactcttttttttttttttttttttttttttgagacagtgtctcactctgtcaccccggctggagtgcagtgagtggcagtggcgcaatctcggctcactgcaagctccgcctcccgggttcatgccattctcctgcctc

SEQ ID NO: 112053 - DNA, 1030 bp, Homo sapiens
atcagtttctcctgttgttatgacatacctgttctctcatgtgatgactatgacttactaaacattttataattgatccaacattttcatgaaatcactgaaactgttcgtagttgaacagagattaaagccttctaattttgttgacattgcaccagcatagttattgaattgggtccaaagctgttgctggatacaagccaaggtataattcacagagtttgatagattatttgtgtttaggtcattggcttttaacttctctggcctgattttcctaatctctaattgagctaaaagcgcaaatatacagggtattatgctagacatagaaatggaggttttgattcattaagctaaaaataaagcagctgtaagctttccaccccttgtggatgttctctgcaggatttgatctctcttgcttacttattacacttgttcaaatatgaaaacaaggctcttctcaaggcaaagcagaacctctgataagtaatattcaaaggataagactcaggctgacttgtgcttttccaaagtgcttagagcaactgtaacaggcaggtatagtgttactttggatggcacaaagaatattaatttaatcaaaatgtgtgatttggcatgcattttaaggacttctcatactttgggtcctcactggttactgtcaactgattttaaattatcgtactgtgattattaaaaagttgtcaaaatgtaggtagtaaaatgtttccttaatctgcaaattacattatatgtccttgtattataaagaattctgttctttctgacctggtattttgatcaaattaattcatgtatgaaaagccatactgccacttgtgaaatgaggcatgaaatagtcttcaagagccctccaagtaggtgggatatcttgtaatcatgtttattttttactttttttgagacagagtcttgctgtgtcacccaggctggagtgcagtggcgtgatctcagctcactgcaacctgtgcctcccaggttcaagcgattctccacctca

SEQ ID NO: 112054 - DNA, 1032 bp, Homo sapiens
tggaagtgaagttccaggctcctcacagactagacaggctgtttgcagcttgatgctcttcaacagtgatcattctctttaccggatggggaggttttctcatacaccaaagaagacacactgcactaacacagaaacattttttggctagagattatttcaggaagaacaaagctgctaatattgttgttttatgtatgtcttttaaaaaatcaatagaattttaaaatagagaaacttaacccaaaagtgtggatttactgtatatacatacagtctatgaaaagcccctttaaaaaggtaacacaccttgacaccataccttccctcaagaatattacgttttaattcttggtgatagttatcggagtcattttcttttgtcatttcttagaaacctgctcgatatagaagagccgtaagttatgacagtaaagagtactacatgcgactggcctctggcaatcccgccattgtccaagacgccattgtggagagttcagaaggtgaagctgctcagcaagaaccagagcatggggaagacactattgctaaagtcaaaggtcagcctgcctttttgattttgattaaaagtgattttggaacattcttgtatttgaattcatacaaaaatttgagcaactataaatagtagggccaactttaaaaatatccatacacattttaccatctcacccttcttaaagattgatttctttgtcagaactaaaaagacttgctcttgtttattgcctacaaatgaatatcacgtgcccattggcttaatggttttttaattgtatttctcagaattctcagtggcacttgatatttagtttttttaatacacatatgtattttttcatgacacagcatcaggaggtattgagaacatgtgccttggcacttgatattttaagggcttaataactaaataaatatttatgaaattaaaactaaacctgtcattagtgcatattagccaatagtaaggaataatggtctttcttcctatgagttgagagagattat

SEQ ID NO: 112055 - DNA, 1034 bp, Homo sapiens
ggggctgatgatccagtctaccctctgctttcaccctttctgggatggtaaaggtagtgaaggaagtagatccttatgcttttaagggaggattcttaaagagaatgatgtctgtggtatggagtattgtaaatgatagcttaaatcagccgtttgcccctgttacaacacagatttagggataaccccagggaaaggaagatggaagatactagctagcattaggttctattatcctgatttcaggttttttgttttttgtttttttttttaaacaatgtaaagagttgcctgtaaatcatccaagtcaatggcagcctgtgctgaagttttgcctgtgtgatttgtaagagtttgtcctgttcagtagcactgagacgtttgccgtatttaagctttacttaaaactgcttttgatctgtgagacagtaaccacaagatgcttagtgattatttaagctgcttaggctatcatgttaattttgtttgagtaactacatctttcatatttcatacaatcctcaagaaaaattttatttttgtgttcctctttatgtttttttttctgatatgtctatacttaataccctgttttcagtctgagatcccaagtaaacagcctgagacacccgatgatattcctcaaaaggtaaaacacaaattacagtaaaagaatgtaaactacttgtagttttgttttttgttttctggttttttttttaagtgcatggtagactagactaacttaaaagattggctttcaatttgttcttcctataagttccttagagttgaaccgttggtttcattcaggctgagagatgttgttctactgttgctcagctttttctaattatctctttttaggatttatatgccactcactaacagactgagttttcactgctctcactataaaaacatcttttgcttcacacataaactaacaaattatgaggcatgttagtaatgggcagcctggcatcttcaacttttcagtgactcatttaattcttctaaatactaaagtgtat

SEQ ID NO: 112056 - DNA, 1833 bp, Homo sapiens
tccaaataataacttgattttcagtgacttgtagacttgttactgttactcctgcttttgcttgaaaaccgacctggactctttcctgtcagcgtcagcagaatgccctgaagtacgtgacagaagagtggtgtcagatcgagtgcgagctgttgagggagcgggggctgtggggccctcccatcggctcccacctcgacaagtggatgctggagatgacagaagggccctgcaggatgaggaaaaagatggtgcgaaatgatatgttttataaccattacccttacgtgccagaaactgagcaagagacaaatgtggcggtgagtatgcagaattcaatgatcacaatggctctttcaagtttttattttcctctgtaagcgttttttctctatttagtcaattacctcaaatagctaattttaaaaattcaacatacgctattaaattgataacttcagagtggaggtggagtgaaaagatgcaacagtgcaagaaggagacatcataataaagaggtttagattacagactccagagccagactgcccaaatttaagacctgactctgccactttgctattatagctgggttatgggtcattaaacctctctgagttttcattttattatgcctgaattggagcaaataatagttccacctcgtaggactgttaggaggatttagttcattaaaattagttaagtacttagaatagtgtctggtccagaataagcactgtatattagaacacatgaatcttctaagtagctctgatcatataaggtgaggcagcttgaattgttccaatgcctcttgtttttctctgacaaacaccctggctccatttatcttgtactgattggtttaaccccagtcctgatgctaatatagagcttagcatcaacttaagtgtctatcagcagagtaatagataaagaaaatatgctgtgtatacataatggaatagtattcagccttaaaaaaataaggaaagcctgtcatttgtaacaacgtataagaacctggaggacattatgttacatgaaataaacaaggtacgaaggacaaatactacatgatccatctcacttatatggggcatctaaaacaatcaaactcagaaacagagtagaatgaaggtttccagaggccaagaagtgaggggaatagggagatgttggtcaaagggtacagtcagataaacaggaggaaatcattttttgagatctattacattccatagtgactataattgataataatctattgtacatttcaaaattgctaagagtacttttcaaacgttcttggcacaaaaattgttaggtatttgaggcgatgaatatgttaattagcttgatttaatcattcaaaccatatacatatagcattactttgtacaccataaacaattacaatttgtcaattaacagtaacatttttaaaataataatatgcgtaggtcttagctcctgctgatagttattaagattttggaagatagctctctaaagtctacttttctcaaagctattcaattctgccaagaatgccatacttgatgcagctgtgccttaaagcactataatttctaattctggagcactgtgtaaaaaaggtaatccacccatatttttgcagcctgttactagcacttacttttataagagcaaagcaacaatatgatctttcagttcttaatcttttttccctaacaatctattaagaatttaagccattagcaatttgataaaatatttcttattgagtcacttcttaaattgaatccattcaagaatactaaaatataaatatgctctcccaaatat

SEQ ID NO: 112057 - DNA, 1039 bp, Homo sapiens
gaggagtcaggcatacaaacaaggaatccaaagcaagaatgaatttcatagtaaaagtcttttcaaaatatttcttttcttgtgcaaaatattcaagaatactaacttagttttgaactcaccttaaacattcagatttaaaaattacttttaaatgggggataagtttttaatctagaaaaagttagttaattacatatatataatttccaattttataaataaaaatgttcttttgtatgaatataaagtttttttaatgttttctaaataggcaaccacagtttcagttgtctaaataaccttttcactgggctagatacaacatgagctttgttttttttacattaaatactgtagtcgaaattcccacatgtaaacatgaagaaaaataaaaactaactttatactgtgttttgatcatttgcttacttttttgtttgtttgtttgtttgtttactagggcgtcagcttctcataaaagctgtcaacagagtttggactgaactgatacatagtaagaaacaagtcttagaggaacttttcaaagtaactctacctgtgaatgaaaggggccacgtggacatagctacagcaaggccactcattgaagaagctgccctgaagtgctggcagaatcatttgggtaaggcctacagagatcataccaccaggagatttacatgtggctatcatatatgggtatactttaaatatgtgactacagcattcacaaaaggattctataaagtcatccttaaaatcaatataacaaccattctagaatgattatactgagatcttagttctctttgatttttttttttttttttttagcatctgaggtatgttatacatcaggcgtttatgcattcagaatgtaatgcattgctaacagctctagtattgtcactgtcttggctacaggtccacaatcccttaactataattttgaaattcaaaaagctctgttttttcattaatttggtgccaaaactgactttataacagaacctaatttatctttctttgtcctact

SEQ ID NO: 112058 - DNA, 1023 bp, Homo sapiens
ttcacagttttcttgaagctctcttctgtctgtgttacttcactgctattagagctatacactaaaacagagttttgtttcacagttttaccctttattacatacacaaaatcaattaagagctaataaactggcccgttttctctcaaatggagaacagctgtgactgacagtttatgttgaggaactgcttgtttatcacagactctctttaggcaataggagactccacaggtagtttcaatccataacgctttatcctgctgaaattatttatcctgatttctggccattgaatgtcattttcttcaagtagtgcataaaagctagtagtcatattgctacctgttgtagatacacttattttaccttagcctgattttttttttgaggatctggtcctgtgttggtagatatcaattttcttagactttttttcctactggaatttaggggaagatgcatctctgcctattaccagtggaggaagctaccaggtattggtgaacaatgtgttttatttcacacagcgtgtggtggacaagctttggcaaggcatgttcaacaaagaatctaaacttcttatagattttataattcaactaattgcacaggtaatccattgtcactatcagttgtagagtacatgttttcctgttttgcctatggtgtcaaaattgttgaaattaaatataactaataagataatgaatgttaacatttaagaaaaagctaagcttattaaaagtgaatagagacaggctgggcgcagtgactcacacctgtagtatcagcactttgggaggccaaggcaggtggatcacttgaggtcagaagttggagaccagcctgaccgacatggtgagaccctgtctctgctgaaaatacaaaaattagccaggcatgttggtgcgcgcctgtaattccagctacttgggaggtggaggcaggagaatcatttgaacctgggaggtggaggttgcagtgagccaagatcacagtactgcactccagcctgggtga

SEQ ID NO: 112059 - DNA, 1055 bp, Homo sapiens
cggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggcctcgatctcctgacctcgtgatccgcccgcctcggcctcccaaagtgctgggattacaggcgtgagccaccgcgcccggccccttcttactttttttaataaaaggttcttgctgtattgcacaggcttgactcaaaatcatgtgatcctcccaccccagcctccctagtggctgggactgtaggcacttgacgctatgtgtttctttttatagacaataaaaagctttgtaaaccatttttttcttgacatctatgaagctcagagctaaattgtgtgcttagttttttgttacaaatgtatttcccctccctattgacatgccctcttgattactagattcttgggtttttgtattagttttaatggctttataattcatttgttatttattttacctgtatttcattgtaaaccaccatatctcttttggaagtgaggtgtgataatagtcaagtatttattatattattgtagtttatattgttataaactgttataacagtttttatataacaatattatatatagttttatatattatatatactatatattatataatataaactataacaatataataaatataatgtttagaatactatgttttaaataatggattcaaaagaagatgatgtttcacctttgctttaaattttttttaattctgtagtcagaaaatacgtgaaagaccataagcatagcatgtataccatctctcatggcatttaaaacaaatttattagtagaattttttaatctttttaatatattaggtaatgtaaatgtggttgagctcatatttttgttttagttggttctgtttctaattctaaattttcttgattaggcttcc

SEQ ID NO: 112060 - DNA, 1040 bp, Homo sapiens
gtaagaaggggccgggcgcggtggctcacgcctgtaatcccagcactttgggaggccgaggcgggcggatcacgaggtcaggagatcgaggccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagtaagaaggaaagaaaaacacaatagattgtcagcaaagacatatgttttcctaaaattgttctgacaggaatgttctctgtgggtttttgtaaggaggacggtgaacaaccctatataggtggtatctttgttaagttttacaatgtacaaagatgattttgaaaattatcttatgttaaagtgtagagcacaaagttaaactgtagtctactgacaacaattctacttgtaattagggtatgaaaatccaggtgcataactttccagtatctgatccagtgagtagcaaggaactgggaacagagggatgagatgtaggaaagagccttttgtcatcctcaaatgccagtagtttcagccaggtttttgataggagttggatattaaacaattcaataaatgtcataacttcctttcttaaaaagagatctgtatgttttagattcaggcacagtattgaggttttgcaagtgaaatggaagaacctacttattcttgaatagagagatccaggactgtatttatgaccctgttacaaagatgggcttttggaatgctgttctattttcccttctattctgattttcaaggtggtcctattaaatgttttaagaaagtagctagaataaaagttctacattgagaacaagaatactagcttaagttctcaaaagccaacagctaaaccaaaattgtaaggaaaattgctctttcttctgc

SEQ ID NO: 112061 - DNA, 4008 bp, Homo sapiens
ctcctcgagtgggtatgacaggattctcagtgcaaattcggattaggaaaaaaaaattacttaatgatagatagcatccacattgggaaaatagtaagactttacttgacttctaattgaagactgttaaagatgtctgtatatagcttatgtttgtggcactgtaggaatttagcttttagactcaactacacttccatcctaatgccaaatgctattcaaatcaattctagtagttgacaaaatcttttaagtgtaaacacttgagtctgtgcccttagattaaattaagatacagattcatgcctagcacagttgtattggttatgcaatttttcaatatccatggtgccatagtcataaagtttatatataaaactgctattaataagtcttaaattaattttattttatcagatttatctgtaagtaatctaaaattaaaatactgctgagaatgggaaagaagtgagcttaatgtgctttgtttaaaagatcttgcttaaatttatttgttctataattttatctcttggctaattaacatgtattttatttttatattctttaggaaaaaggtagaaagcaatgtttttaacataggtacctaaggcagaatgcagaatgatacacagtattcaattttttatatctataaaaatgagttttaaaatgtaggatggaagggtactagttctttatgtctatatcattggttacttttaaaaacaacaaaaaactagtttcaaagaaattttagcctattagaacttatgagggtctctactgaaaaattagtggtggctaatatttgctccctttcacctctgcagtttgatttggattccatttggacattcatctttggagttcctgcctccagcggaactgtggtctcttctatccataacgtatgcacagaagctgtttttttattattgggaatgctccgcagcatgctgacttcagtaagttcactcaaatgcccaggcctattgagaattcctcctgcctaggatacttttttgtaaatagaggaattttttggtaacataactactttatttactgcatgatctctggaacttcagactcttatgttagacaaaattatatctaacgtaagaacagactgtgtagttgttaagaccgtgcactctggagccctacctgggttaaaatctcacctctggtacttccaatctattatcctcagttatgtgcctcagtttcctggtgtttaaaatgccgacaataatagcatgcatctcttagggtatttgtgaggaattaataagatagtgtatacacataaagcacttataaacatggctgatacataataagtgcttcgtaagtattaacttattaatgtaataaaatatataataatgagtacatatataatgagtacatatttgtagtatatgttattacaataatatgttatttcaacttttaaagtcactttcatttagaggtcagaaatgttaacaatacaagtttcatttgattttgtttttgcttttgttctgctctaattatgtctaacttagagatgaagaattgaaagagtaaaagacagaactgatgttcctgttgatctgacaggaatactgtgaataatgaccagatttgtttatacaatttaggattgtgttgtaacaggaaatattaacttgactccttgaattacatgtacctgacaaatctaatttcagtcaaaactattgttgtatcatctaagaacagaacattaccattaaatgtattaatttagaatgttttaggagtctcgttttggtgcctattcataaacaactataaagacataagaaaagttttttaaaagatactctctgggcaggtatcagaagatatacattgttcaaatatacagtattcatttttttatcatcatcattgttgtattacataatgcttaagagtgaggctcagaaaggtgaagtaacttccctaccttttatcttactcctaacttagcatgatgcacgatggggcaacattaatggtaatacagccactttggtaccaccaacactcatggtaataataatgaataatcaaaaccactgattctagttagcagacctgcgattaatctaatgattagacaatgatcctatcagtttctaaggggattttttgttttagctagtttctaaatttctttgcatgtgtgtatacatgtgtgtttgctcatatgtgtggtttacagagttctggaccatcaatatatccagtttcataagaatactgagtaatggatttttaaaataatttatagcagtgtcaataactgtaacatagtgtttcctctcatgtccccataacagccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtaggaaagggggaggaaaatgtcagaactggaattagaatgtcagaactggaattagtctgtttcaatggttagcagattttttttgacagtcttttaagtttctgaccaagttacagtttcataactttatacatcacctcttgcattattgtccggtgtccccagctccccacagtttccttctgctttctcctaaaatcacagtgaactctacttccttttctcattcaccatattcttgtaagtcccttgttagtaatttcccttttcaagtagttgattcatttattttacgcgatgccagctgtgtagttgtaaaatgttcttttccattaagataactctagtctgaccaaatttatttattttttattttaggaagtaggtatttgctggatttaacttttgccaataaattatagggttgaaagcaaatgttggtcctttcttccgcctgacttttcttttttcattaaagttttattttgcttattttgtactaacttaaaaactattagattataatcacatatagtatagatactcttttgttctttaaaataagcccaaaaatgctgcctggtttcctgctttgaaaatgtattcacgtggaaattcactgaagcacatttttgcagagggcttgcaggatagtttcataactttagagtctaaatactattcattacagtaactaatagttcagttgacataaatattggtgacttttcaaaacgaatgaactactgtagtttacacaaaaccatatagcaggggcttatcacttacttttgcacgttgatgttgattagctaataaactgtaaacataaaacaggtttaaaaataaatagataaaacacacccaaaagatagttattcctccatagtacttcaaaatttcatgatgtttcttcatatttccaccatatactctaggacctgggataaatgaccttctttatactaatttttctccatgtataaaggtacaatacttattctaaaatggtggggatttttaggagaaaggcaaatgtgacacatgaccttaataccttggcttgtttataattttagaatccttatttttggtttaaaaaaaaaagaccttcaataatatatcaatatcttttccttgtcagcatctttttttttttttttgagacggggtttcgctcttgtcatcccggctggagtgcaatggtggcacgatctcggctcactgcaacctccacgtcccaagttcaagcgattctcctgtgattctactgcctcaccctcctgagtagctgagattacaggcatggaccactacgcctggccaatttttttgtatttttaatagagatggggtttcgccatgttggccaggctagtctcgaactcctgatctcaggtgatctgcctatgtcggcctcccaaagtgctgggattacaggcgtgagccactgtgcctggccatcagc

SEQ ID NO: 112062 - DNA, 1351 bp, Homo sapiens
atttaaggttaactagtttttcatgattttcaggacaatgaaatatattaactacattatagcaagttacaaaaattagctgggggtggtagctcatgtctgtagtcccagctactcaggaggctgaggtgggaggactgctttgaccctaggaggtggagattgcagtgagccaatatcatggcactgcactccagcctgggcaacaaagcaaaactgtgtctcaaaaaaataaaaatatatcataacaaggatatttttaagttatgtttttgtagcattctaaattttggctgtattttggatttcacttttttcttagggaactacaagaacactagagctcttctgaggtctttcatttaataagtagaacttacagcaccttaagaaggattttcaaactcccttgtatcttattgtctcaactgtgtttcaaaacctatatcctaatagacaggtttgctaaagtcaaacaaattgtaaagtaaaacttttaactgaagattaattcaacagttgaatacttaattgcctatagtagtatgaatgttctggatagaaatgttaacacatactgaattacttccttctttgttaatgcagcatgtttatcagttgctgattttgcacttactgttatattcctcttctcttaggattcaacgtgggcagaagtgctggtgggagatcgacggtcagggagattaaccgagatgcttgtcattttcctggttttccagtccttcagtcattccttcctaaacacactaatgtccctgccctctattttctcctcatggccttgtttctgcagcagccagttagtgagctgcctgagaacctgcaggtcagtgtgcctgtcatcagctgccggagtaagcagggttgccaggtaggaattatctagcaaggggtgcgtgaaattacgtattccaaagaatcaccgtaggataatggataatcactgtaaaaccaactgtcaattccatcactttccccacatttaaggtttgatttgggacagaaaaatctgaaaataccacagaaaattttcccaaaaagtcctttgtccctatttacaattttttcctatatgataactctgtatattatagatgcataaagactctggatgatatttaatggtgatctaaagaactcttttgttatatgatttattttattttattttattttattttattttattttattttattttattttatttgtgagacagagtcttactctgtcacccaggctagagtgcagtggcatgatctcagctgattgaaaattccacctcccgggttcaagcgattctcccacctcagtctcctgagtagct

SEQ ID NO: 112063 - DNA, 1669 bp, Homo sapiens
aaatggcctgattggacttgctgtatgtgtggttgccacaaccctttaatttgtaagaaacacagtatctgcaaagtgcattaaaaggtgtgcctctgtgaggtctgtgactcagtaactcatagctctgctggaggagagctgggcctagaactctgggttgttgatgcccagttctgtgtacttgcagtactatctgagaatgtctcagctccatttcttcgtttcttctctaatttctcctttatgcgtttgtgcgcctttgcctttcttctgtgctatttaattctaacttttctttatgtattacgtttactgaataagtctatgcttcctattttcaatttttaaatctggtagaattaactgtatctttcaaaaaagaaactaagaattaaggatttgagaggttaagagtcagtggtgattattatttttattcacatggtcctcatttgatgactttccccctactgggaaggcaaggggaatattaatgtaaaaaatatctcacagccttattatcagtagtttaggaaatgtcaaatgtaaatgaacaattttcggagttctaaagagaaatatttaactgaccctttttcttgtccatgttggtgaaaagcagtcctggagaaaatgttttctaaaagatatatttttcagtaaactttccaagaactatgttgtaaattttcttttagcttatctactagggagatttaatgtatttatttttattttaggaactgaagaggagtttggaggtcttgtatcagctaatcttatacttttgaggaacagacttctggatatcttgctaaaactaatttatacatctaaagaaaagacaagcattaatttgcagtaagtaaatcttttttaaaagtgattataccagttgctactactagttaattcatgttaggcaaaagaaggaattgccattgactttaaatagatttttttaaccctgaaatttatagtatctccagaatgaaactcagtcttctttttcctttttgatttgaaatcctaatttctgaaattaattttgttttttgttttttaaatccatctgtcttgaatagagcttgtgaagaactggtgaagacactgggttttgactggatcatgatgtttatggaggaacacttacattccaccacagttacagcagccatgaggattcttgttgtcctactaagtaatcagtctattctcatcaagtttaaagaaggactcagtggtggaggatggcttgaacagacagattctgtcttaactaataagattggaactgtattaggtatgggacttttctagtcagctgcttgaaaatgagctggtgtgttttgttttattttaaattttatgtaaacttatcctctgcggtttgatcaccattaaggagatattaattttaattaatgatagaaggaagagcttacaagatttcaaattagtccttttaaatggcaaatcaaactgaagacagagataacatactaagatttgaaaactcagggaattcctcaagatctttttgtagtataggccttactgatctgtaagtaaataattagcaaattatcagtagtagaactaaattaataataataataaatatttattttgagtacttactgtgtgccagttcctaaacacttgc

SEQ ID NO: 112064 - DNA, 1001 bp, Homo sapiens
agggagtctccctctgtcacccaggctggagtgcggtggcgcgatctcggctcactgcaacctccaactcctaggttaaagtgagtctcctgcctcagcctcctgtgtagctgagattgtaggcgcgtgcaaccacgcccggctaatttttgtatttttagtagagacggggtttggggtttcaccatgttggtcagactagtctcaaactcctgaccttgtgatccacttgcttcggcctcccaaagtgctgggattacaggtgtgagccaccgtgcccagccagcctgtattgccttgtcccaaattctacctttaatgctttccctagaatttgcattatagacagaagatatttttaaaataaaacactgctaattaaaaaacttttcaagatgatgtatacagttcttgttcacatggggaatttatcttaattatttttcactatcttttaatcaggagtaagaacatttgtccctaagcctgttgccactactttgcagtacgttggtggagctgcagccatcctgggcctggtggccatggcctctgatgtggaagggttatatgcagcagtcaaggccctggtttgtgtggtcaagagtaacccactagccagcaaagaaatggaaagaatcaagggctaccaggtttgtaactgtaaaactttgccttcacttcacctggcacctaaaatactctgcttttttattatcattcatgttgtttgaaactctggaagaattatattgtccaaggaaacttaaagagacagtagttttatgaaaactaatatatgtcaaatgaaagtatgtattgtttctttattttgctttatcctttttctcctatcttatcaaatcttactaaacacttgagttaggcaacattatttcaatatagctttaatacattgaatttattttcagaacaaaggtttgctggtttgaatgttgtttttctctgtggaaatgggaaagaaatgaaatggggtccta

SEQ ID NO: 112065 - DNA, 1080 bp, Homo sapiens
acttatgtttacttggatatggaataaagctaatatgttcactgatctgaaatactgtgaggcagttagtgataacaacctttaaactaccaaagaacttcattcacaaagacccctgaagctgtgtctcaagatcctctcaccatctttatctcagtaaattgtgtttaacttacctcctgtgagtttccacactttggaagtgtttgtacatttccaaaaataaatgctcccaggctggagtgtggagtgccagtggcacaatctccgttgactgcattctcgacctcctaggctcaggtgtttctcccacctctgcctcctgagtaatgcaccacaagacctggctaattttttgcattttagtagagatgggggtctcgccatgtttcccaggctggtctcaaactccgggctcaagcgattcccttgcctctatcttacaaagtgttaggattataggcatgagccaccaggctggacctaaatgctcgtttttcagtattctgataagggaggagagaaaagatatgttaccattcatgtgtttggtttcttttccaatcaaaacattgaaactgttcttatataattacattcttttcctttcctatttttcagttaggcatttcctcacatgagaatgccactcctgtgaagttgatacacaattcagcaggacatcttaatggatctgcacggacaattggggccgctctgattggatacttgggtgagtggacttatctttgttgtttcaaacttctttatttgccatcaagtttgcattcactttcctcacttaaggggcagtatttaagttcatattttaatagcactgacctatagtgtacgtgcagtattcagagattacatgtaacaatctcaaattccagtcaatttaaaataataacctttcataaaatcccactaacttttacatatccaccaaggaatactatacagccataaaaaggaatgagatcatgtcctttgcagggacatagatgaagctagaaatcatcctcagcaaactaacacaagaacagaaaaccaaatgttgcatagtctcactcatag

SEQ ID NO: 112066 - DNA, 1048 bp, Homo sapiens
gtcttccactcccttgttctgattccaccaagaatctcagaagagttaggacaagtatattgtaaatggtcataatcctaagatttagtaatttatcttttcactcattcttaatttagatggtatctaataaaagctaacacttcttgggcacttactgtgtgctaaataagtcaatacacatgaaggatgtagctgttctgagcccttcacatgtatttattcatctcaaaacactgtgagttaggtactgtcattatcattcccatttcacagaagaggaaactgaggcacaaagacatataggtcgcacagcttttaagtgataaagcaagattcaaactcaggccatgtagctttaaaacacatgcctttattaataactcctctgctttgtggtctcaaagaatacaggcaggcatatctgagtgcttttttaggggaggggacatagtgctacatggctgatcagcattttattcatcttcattcctttttcctttgaatctagggggacatgttttacagtttgtcagataacagttaaaacttttcatcctttacgttgtgctatatgttaaacatgttttaagagtggcacttagaatgtagaactctatgactagatttctttttccatcttttaattaaagaaataaatgaagagctgagaagatagtttttaaatttacctctcttattctactttaagactttcaagcctcctcatttaaaaatgatagtaagaataaaaaacttactttaagatgagaactactgatgattttgaaaagaattattcttcttttgaaggtaaagatgcaaaatccgaaggggtggtgccatcccctgtgtcattagtaccagaggagaaagtgtcatttggcctctatgcactctctgtgtcgtctctaacagtggcaagaatccggaaagtgtataacaaattggatagcaaagccattgctaagcaggtaagcagaatgatttcttggtgtactatggctgattctcactgggaacatgtctcagagtctcatatggatac

SEQ ID NO: 112067 - DNA, 1055 bp, Homo sapiens
aagcaacttaagttctttatctcttatactgtacttaattatatatttattataataatttacccctataaaacgcttttcatcagtaattttagttaacagactcacattgaaggtaacatacctaatttcaagactactttaattccatagtggaaagctctctttatatcagcacaaaaatttcagagaagcgtcattaacttgatgtgcaaaccagccattgacagtatccctgtatttgcctgttgccatttctagcattaaagagtttatctgtgttagagagttggataaaagttttagctactatacctggtcctcagttacagatcccagtatcgtgccttgcccttcctgtttctccaccccaaatgtttttgtgcatttgtaaagttgtgtgaccttgggataatgaaaatacatatgctgaagtagttattttcctggggaaagtgttcacatctcacacatttgcttttgtcttccttacagcttcattatgtccacagtactccagggggttcaggttcggcaaatccaccagtggtgagcacggtctatgcctacattggtactccacctgcccaacgccaaattgcctcattggtttggcgcctgggacccacacattttctagaagaagttttaccttcttcaaatgttactaccatttatgaacttggaccaaattatgttggaagctttcaggctgtatgtatgccatgtgagtaacttatttttagttcttgaagttgtatgaaacttaactcctgcaatatagatgcatgtgtgtgtctgaggttatacatattgttaatctaggaaaagcgccttctcctctaatcttcttcagcaggatactcactcctattgaaaatattttcctccactgattatactgcactttctggattctttgtctttatgtctgatcgcttattatccagtttctcttactggctctgagatataggtatatgccctctaggagtctaactgtgacactcttctctttctgtgatttctcctattacatgaagcagtttaaagta

SEQ ID NO: 112068 - DNA, 1029 bp, Homo sapiens
acctcaagtgatctgcccaccttagcctcccaacgtgctaggattataggcgtgagccactgtgcccaggcttagagtgttaattcataatttttatctatactagttgtttgtgggattcttatattgattgaaacctctgtgttttaagaatattatcatgggtcattatcaaacaatagattaaaacatgattgggaatagtcaaaagcaatcagtggtaacaagagagtgacagtaaggggcacatgggagttttccttcagtgatgaaattgttctaatgtcttgattgggtttatacgttagagtatgttgccatatgcattttgtatcttcatttttttttattttaagttaaaaatgttattttgggagattttaaaattatgtcttttgatacccttacataattaaaagaagggaagggctttgcgaggcatccagatttattccatgatcttttctctagtcaccattaaatactggcagttatttcactgtggtaagtgcacagtgttaagagaaggagtcattgatctctaatatgtatgttgtcttttctttaatagatgtctttttttgcccagtttggcccctcataatgctcctacaaataataccgtcacaacaggtcttattgatggggctgtggtcagtggcattggttctggtaagtaatatttgctttctgcttatgagttttttttctagtagattatatataatttagagtttatttgcttttgttggcatcttttaaaaaatataaatattaatcaacacagacttttttttttaatttttactgtaggtgaaagattcttccctcctccctccggcttaagttactctagctggttttgtattgaacattttagttctcctccaaataaccaccctgtcagacttcttactgttgtgcgccgagcaaattcttctgagcaacattacgtgtgccttgcaatagttctatcagcaaaagaccgatctctgattgtttccaccaaagaggaactcctccaaaatt

SEQ ID NO: 112069 - DNA, 1129 bp, Homo sapiens
gccgagatcgcgccactgcactccagcctgggcgacagagcaagactccgtctcaaaaaataaataaataaataaataaataaataaataaataagaattgagttgtgatttcctttgctaagagtagaaacaaaaatagttcctttccctaagagaatatttgaaatatctttgtagttgcctgaatatccagcacatttaggaggaaaacagtttcctatactcatgtagtttatttcgagagagaatattttcttcattacatttgtaatgtgtccctggagagataatgacaatctgtttagaatttgtctttttattcttgaaattgttaccctttttataaatatgggaatctttaaattaaagtacttttacgatcatgcatttagttctaataattgtaaggaaagaattaataatggggaaaaaatgggagaagcaagtttctgccatttatctctaatttgttttataataaagatgacctatttcttttcattttaatggtctaaaattgtttacttttccctcaaagagaattaataaatcatagttttatgaaataaaagtatttcctgatttgtaaactattaactgagatttataattaaattacattgtatcagtggctttgatgacaattatttgagatgtttatttttatttatactctagtttccaacatttctgcagtgtgcatattgctttagtaaaaaaggaaacgcatgctattaagtttaaaagtaaatgtacattaaaactggataatgatcttggcacttaaaaaaaaattattgtctattgaaactgaagtggtatttacaaataaatcagccttgtaaagttattttgaaattccatatgacattttcccaagagatttccttgacttacaggtagtatgatcacatctctggaaggtctgggtactgataatgtttttagcttacatgaagataaccattaccggataagcaagagcctggtaaaatctgcggaaggaagtactgtacccctgaccagggtgaagtgtctggtctccatgacaaccccacatgacatcagacttcatgggtcatcagttactccagcttttgttgaatttgacacatcacttgaagggtt

SEQ ID NO: 112070 - DNA, 1065 bp, Homo sapiens
gcagataagcaggaaatgaaaatattgtttattaagttcgtaatagcagtgttacagagtttatataggggcagagacttttggaagtgtgactcaaagcaggcttcctggaggaaatgacagttaatgaaataaagtatgaggccaggcagtgtggctcatgcctgtaatcccaacactttgggaggccaacgcaggaggattacttgaggtcagcagtttgaaataagcctgaataacatagtgagaccctgtttctacaaaaaaaaaaaaaatatatatatatatgtattaactagcatggtggcgtgtgcctgtagtccttgttatttgggagactgaggccgaaggatctcttgggcccaagagtttgagattgcagtgagctatgatcacaccactgcactccagtctgagtgacagagcaagaggctgtctcacacacacaaaaaaatgatgataaataaaaaactctaaagtatggaagagagttaatcaggtgaaaaagtaagggcaagatttttttccccaacaagaaaaacaaatatggtggtccagggtagagaaggagtacagcattcttaggcagtcagaagttttatgtatgtcttaagtagaatttatgattgcgggaaagatgggagcagtgaagctggagagtacagtagaaatcatctcatgtatggtactgaatgctagctgttttgtgttttcaactacagaaatggacagccatggaagagtcttaagcaatagagtgacactgtgtagatttaagttctgtgagatactgactatagtgaggaatggattgagttggggcaatattggtgtcacaggaggtaattaagactctgttttaggaatagtaaaataatatggtctgggtgatagcagcaagaatgagagaaaagagcagattccatatttttatgagtagaaatagcaggattttctgattttctgaatatggaaagttaaagaaggaacaaaaacacatttcagtgagatgcagaacataagaaatgccctgggtttggatataaggtgatgagtttggtttta

SEQ ID NO: 112071 - DNA, 1075 bp, Homo sapiens
aaatccaaatctcatcaaatctgtcaatttagaaatgattttggaaggcctataactaaaataagacaattagaatctatgcgtatgtgtgtatatgcaatgaaaacatgtttaatgaaattttggaattcagtggttatttctgatacatgctagataaattatgaatcttttttctagatggatcaaaatatttaaaagaataaagggagcaatataggaggaggataactgttggtaatacacattttgaatatttttcttagtaagtttagaaattaaatctttttgaatgaaaaatggcagaatacagggagtgaaaacatgaatgggtaaaggacatgctgccttttaaataaactaggagagcctgtgtgcctttttataagtaaagcggaacattttcctagaatccctgttaaaaagagaacggtattttttttaaaccacggcagtgccaattctttgctactaaatcagtgacgtaaagcatctgtttcccaagctgctcttgtcccagagagctaaaactgcattgctctctgtgacagagctcagcattaggcaaattatgctgagaccaactcattggaacaaagagttcccataggctgaagccacaagcatctgtttcttagtgccaagatgcaaaatgtgcaaaattcatgaattgtagatgagtagtatgaaatagaaagtagagatcattgatgagaagaaatgtgtacattcaggacatggctgggctttctaattcatagaaactttttctgtaaattgctttcaagtttttaaaagttgcaatgaatattttcagtgataatgaggatagatgcagaagatgaaagtagttccaaataagctaaaggaaaactcccacaatgccaaatatatttattcttggatagcttagactctgagacaaccctgactcagctgacccagttagttgttgattgtgttactcatgcactaaggaaaggttaaaacacatataggtaatttcaaaagataaaatctcactgagggaattaatttaatttgatctctcatcacgtattattggaactgtcat

SEQ ID NO: 112072 - DNA, 1020 bp, Homo sapiens
gcagtgagccgagatcaccgcactgcactccagcctagactacagagcgagactccatttccaaaaatacatcagaactttctatttattgaaatggtaatttgacaaagggaaaacagcattctctttttattcttaaagagttacttatggccttaaatcaaaaacatattgtcatcatttacagtgtagctccatgtagagataaccaggtctttgacttaagggaaaactgtcactaaatcagtatagctagttgattgagccctaatccgtgtgaattctccatgagtcttacaagttgacattaccccaaggacagaaagtccctgatactgttcatgctaatactaagatgattgttgacattttcaggttgccattctattcagcttgcatacattttgctcaatggtaagaatcataagctagtaaagaatattatgttttttacttcacaaattcaagtctagtgacttgaaattagaatttaagtcacactgtttctagaacctctcaacaaattacatcagcttatagacatctttttcttgtagcaaaacatactgttttgttggcaaaaggagaaaccaaaatttgactgtgtttttatggcttgtggaacactctcagatgctaaggacgttttgaggttgtgatacttgtctgacatgtagtatccaggagattcttctctaattattttaaggattgggggaaaatgaactagctgactttatatttggaaaactaaaactcaaaacctttttcattgttgattattcagaaggaataatagaacagaattatagctgaacagtgttcaatcagagttagaagaagtgaatacaaaataataatcagaactctacagaatataactgcaatggaacaaaaggtggcaagtacttgttattcttcaaacatgggatccattacttagtgcctctacatacctgatgataagttaagcaaagcagattcagaatttaaatattatgtattcccaaaagaggtaga

SEQ ID NO: 112073 - DNA, 1154 bp, Homo sapiens
tgagagtaaaatgtgttgatgctatgaaactatgaaggacatatataattttgtcatccaactgttttcataactaaactacacatttttgttatagaaaaaacatgtcttttattaaaaataagttagaaatgtggacttaatgtctctaagtagaatacttttccactttttttatttttcattttttttttattttttactttaaacgttgggatcatttgttggtttttactgttattccaaaatgaatttcatagcactgaaaggaactgtgtattttctccatcagattcaaccaattgaagtatgttgctgttatgaaaaatgctcacagctaagctttgaaaaagttagtaaaaaacccaccccaatacttactttgatcagtgctctgtaaatctctaagctgatctagttgatctttttaaaactacctttaaaaaaattctactcagttttttaaaaactacagttgattgatgcaacctgcacataaaatgatcatggtctgcagttggccccaaatacttcattacttttcctgttttcctcataaccaaaaataagtccttaactcttacattaatattctttcattgaggcttttaaaaaatgaatcccaaggttctgctatattgttgttttaatcttattactgttgttcagattttgaaacttgaagatagttggagttagtacatcaaaagtatttgttacggattcagtatttcaacatatttgcatagtaatattaggtatatgaaaagatgtaatttcatttttctcttaaatttacacttatagcttactttgcacaacaaactatggcatggttcagaatagtcttaaatgaatataggattgttcagtatatttgtgcttaaaaactgcaatttctttttttaaaaaagctgttcctaattcaaggaatgataaactagataaatttgagttgatatcgtgtatttttctgttgctaaaatggtcgaggtaaaaaatgtgtgtgtttgaaaatttatgtttgttcatgagcccaaggaattgttgaatattagagaaataatttcaattagtagtttaaattactaaaaatcacaatttaaaaatatggtgattatatcataaatgagtaaagccttaaaatttgctgt

SEQ ID NO: 112074 - DNA, 1512 bp, Homo sapiens
tccaaaagaatatgaaaacagatgactcttctcctatttgtttgaagtgtatcactttatttttgaatattactcttgctctggtattgtttttttttttttttagcatggaagcctgtgtactatttgtaaattcaggttcaattagttctcattgcagttattggaacagtttctatgaagtttcctttaatgatagtgtttactgttgttttttttctttttagcctcaaaaggtgcatctggacttattgatatgtgttatcaatagaacatcattatgattattcttatttccagacacgtactccatcattctccacatatcatactcctcaaaaaatgatatagttcccaaagagaggtgtcagtgtcttgaaccgtcaagttcaagaggccatcagactcaatatttactcattccttcatgaaataagtacttaacaaaaagctgctgcatgccaagtcactgtgctaggcattgaggattcagctctacacagggctgtcttggtccttgctatcttttagctaaaatgtagacacataaataaacaattacatatagtgtgacacattctacagtgggggaatccagggttctcaggcagattgtaggagagccacttcatctagatcacttattttcagtgcttcaactgtgttttcaatgaagatgtcactttgaaaataatacttctaatttatgccccaagtgttattgcttttaacttaccatagttttactacataaaataaatgaactgccctcatcaatagaccatgtaactacattggatagagcttgtaataggttttgtgtccttttctgtggaatatctgctttgaagtatcaactgagatatttcctgcttcttaacaagatttcttagtcctcagtatttacatttaaaaatccaaacagctttgacaacaattgtaaaaaaaaaaatcattaaacttctgcttttccctatcttgaagtaaaatgcatatgtatagttaatttatcgaaaacacaggacagtgtagtgttctaggaatgagctatataaatttgtgtattcagattcaacctcttttcccttgatttctacttatcctagttagaatacatcatttttagtcactgtcaaaaatagggcttagagcaccctgtttaacagatgtgttaaatgttaacatgaatggaataagcatctgccgtgagcatgcttttctgtttcattcagtgcttgtgttgtagtcttgttccttgttcctgctgaatatggaagatgttccttattaaacttttactggcatttcttgtgaaactaaccaactgccaacctggtgttctcttcttctaacctctctaaaccaccctgtctgttttgttgtctgtagtcgtgcagaacagatccctccttgcctgacaagtgagtcttctctcccctctccttggggtacaccagctttgtccaggaaaaggtactgatcatataagagaagtcagtctctatttgtgtg

SEQ ID NO: 112075 - DNA, 1461 bp, Homo sapiens
attatcctttgtttactacctagaggcagtgctttcccaatgcatatgactcttatattgacttttagaatgtgttacatttatctcatagtattttacagatatgttaaaatttaatgtttcattaaacaacagttaacaattaaaaaatttttaagcgattgtcaggaataatgcatatttatttaattatctattcttacagagaaagagtgtttatctacatgtgttcagaatatgcagcaatcagatgacctgtctcccctagaaattgtcgaaatgtttgctgggctttcttgtttcctcaaagattccagcgatgtttcccaaacacttctggatgattttcggatatggcaaggatataattttctttgtgatctcttgcttaggtaagactgctcaatttaagaatgtattttaaatgtctactcagtcttttttatcaaagaaaacaatgtgatttggggttataggaaaagcaaattaaggaaacacttatttaatgtatacctggctttactcccttctttttctggtgcaatcacagcttactgtagcttcgtattcctgggctcaaatggtcctcccacctcagcctcccaagtaactaggactacaggcacgtaccaccacacccagctaatttttaaacattttccatagagacaggatctcgctgtgttgcccaggctggtctcaaactcttggcctcaagcaatcctttggcctcccaaagttctgagattacagtcatgagccaccacacctggcctattcccttctttttattcctgttctgccaacagagtggaaaagtgaatttagagttaaattgccaaatgcagggcacaaacatgatgaagtcagaggttagatatgaagcataaatctgctctttagtagctgagggagaagaatttagataaactaattaatatcttcttaaagtataaactcttcttaattatatttttggttctttattttatagtacttctagtctttttattaatgtacttaataagaataattatgtagatggaataaaaccttacaactgtgtatatgaaacaaattaataatttcaaaatgtgttacttaacccccttttccatttcaaatggttcgtgcacatacttagaaagtggctggttacagattttcttaagaagaagatactcaccatttttcagcagctattcctgggccattaattatttttaaatcatttgatctattataagacaccactgttttgtaaacttacttgtctccctcccttccttcctcccttcctccctccctccctccctccctctggggtctcattatgttcccaggctggagtgcagtggcataatcatagctcgatataatttttaactcaagagatcctcctatctcagtttcctaagtagctacacccagctatattttatttattttttttgtagagcc

SEQ ID NO: 112076 - DNA, 1114 bp, Homo sapiens
tcgtagatgaatagaacaaaaggtttagagtatttgagacaagaaatggtatgttgggtatgtagaaaggggccacatcttgccagggatagtcttgaagctttctcttcatcaccctactattgcattagttccggccccatctctcatgtggtttggggggttagtttcccaattaccctttccttctggctctgtatatttaatttatgatctgtattaccaccagctaattttctgaaatctagctcttttactttttgtttgtaacacttcactgggtcatcactgccaagaaaataaaatgtgagactattttcataagtcattgagcatacacactttgtaggccacttagccagctgtctgacctaaagcagggtatgtaagtgatgaacctcagttgcttcatttgtgaaataaggatcattttacaaatgaagtcatggggttgacttaaggaataggtgagatgatgtatgtaaagtgcttattagccttatgcctcttatatagtaaacagtaattcaaggttagccattattattgtggctcgtcaggagtcagcatttttggaatctgtgtttcttcaaaaatactgtaccatatggcctaacctcctatgtatcttccaggtgatctttccctttttattttaattccttatcctttttaatgccattcctggcagtgttagtcaatcccttttatattagcctgtatatactaccattgttagactgaagtcttaagagattaagtcatagttacttaggactctaataattccagtcgactgtggtcttttgaaggacagagatgcttcgtctttgcatgcccagctcccagcacacagcctgacattccctggacactcaataaatgttttctgagaaagtaaactaactaatcaacagattataccagtctgttgatctctagtgcagttgaacttcttgttccaaactgcaccatggaaaattttgataaatattatatcatacttaacaatgttgaaatatgtactgtaagaaggtctagagtttctcctctggatatctttgaaaataatatagagatgtatttgtgtcagtgatggctttatcactcaagt

SEQ ID NO: 112077 - DNA, 1097 bp, Homo sapiens
ctcttagaattttgtcctcggaatgatctgttttctttttatttgtttgctgtgttttttctctcttttttttttctttctttttttgaggtggactcttgctctgtcacccagcctggagtggagtgcaatggtgcggcctcggctcactgcaacctccgcctcccagattcaagcgattctcttgcctcagcctcccgagtagctgggattacaggcgcgcgccaccacacccagctaatttttgtatttttggtagagacggggtttcaccatgttggccaggctggtcccgaactcctgacctcaggtgatccacctgccttggcctcccaaagtgctgggattacaggcgtgagccactgtgcctggccctctttttttttttttaactcagggaattagtgtaaccaacctgtcctggtgttcctgggattttccaggttttaggataggaaggcctgcatctcaggatactgcacagtctcaggcaaatggagagggttggttattgtaagtaatcttcaaatggtcccagagtagaccattgttttcatgtatctgactctactggatgagtaacaaaatctcagttctgtttgctgttgatggtagctgtaaatgtatgtatgttactataccaaaatttggtttagaatagcatatgtttatttgctattaaaactttatataatttagatatttactattgatatttaatataagtaatattaacttttaatacagttttctacatttattcatattttctataaaaacctaatcacttaaaaaattacaagtttagatgccaagttatactttaaatctatctacaataaatgaaaatgaaacatcataccactttgcttagtggccagctaaacctagtaataatctatctggaaatagatacatttaaaaagcaaattcagtgttatgtttggagctaccttgtttgagtgccattttctgctggtagcagtgttacacagagatgaccaaaacatggtcctgactcaatgtgtagatgtaagagatgaagcagaaaaagatagtaccataatatttaataatggggcatatatagtgctatt

SEQ ID NO: 112078 - DNA, 1024 bp, Homo sapiens
tctgttcttctcagactctcatctgatggtccttcatagaaacaaaaagagcataagataaatatttccctaatcatttatattaattgataagaaatcttaactgatttaccatacgaaataatgcaattacatcttcattgttaattttttaacattgttatttatagcaaattattttaggactaatgatggtccatagtctgacttaattttagatataacacatatttaggaaacaaaagcctccatttttaaaaactttgtaaacattccaacctctcttttattagtcatatttaatatatttttattgaatagcactattcagtaacaagtttatattgagcctttatgaatgccattagataacaccattaatttgctttccctgagtgccaaaaatatttggttgaagaggtgccaggaaatcttctgaaatctatttaggtggatattaaaaatgattattttaaaaataagtcaaaccatgctatttttctctaaagatgaacactatgcacagtttagtgatagggttcatgcacagtttgagaaaaatatagtactgagtgatgaagagcctggcttggaatcagatagatgtagttttaaattctgtctgtattgcctcctgttttaagttaagttgtctaactcttaattttcttaactgtaaaatgaggctactagtagaacctattctgtaggattttatgagacttaaatgacaccaagttcttgaatagtgctacgcagattttaaatgggtattatatggtaattgttatttccagtgaatttgcaagaagtcatttttgttcttcattaccttttttttaatctgttatgaatttcacatatgtattctagaatcagcccttttgagttgaatgtgttgccagttctcttgcccaactttcttcctctgcagaaccagaaattttttgtcgttgtttgtttgagaccaagtctggctctgttgttgctcaggctggagtgccatggtaccatcttggctcac

SEQ ID NO: 112079 - DNA, 1046 bp, Homo sapiens
tgtttgacttagttatcttatgtcctatgttattgtaagtctcattaactattaacaaattctctcaaaagtttttaattggttgattagaaacatatgtgtatgcaatgccttaaaactctaatataatgagtgatttgatatcacaaaggttcagtaaactcttaactaatgaaaagatagaaagttatatctgtaccattgtgactaatttgaaaaatgtattattttaaaaataattcttattaattggatataattaataaactaaaattgttcttagataccatttccattaaatttagaaatatatagccatatctatttaacatttggccgtttgtgcttgaacattgtccactagtgacaaatacctatggtgagtgaatagctcagtatgttgctagagccaaccagttcttaccatgattgctaaaaaggaattgcagtgttgatttttgagactttgcttgattagagctaaatggtgaacaagctgttagacatggacatctagctacagactagtttttaaagtgtgcttaatagtgttatttcagtgcatgatttttgcctttgagagacatgggttgggaaatgacatgtattaagtcttttttctgggccaggtctcatgctgggttcttgaaatgcctcctgttgtcttcattacagtcctacaaggaggctgctgttatcttccctcttactgatttgctcaaactgaaagattatggtgaagtctgaaaatagctgaataatatttattcagcattcttaaaaataattaacatttagtcccaagaacaaaagctgacaaagaaaacatttggtttaaacttactcaaaatgagtagcattttagttgtctaaaaattcataactgccactgttaattactgtagtatttgttatattttgctgtgtattttaaaatgtaatgtttaccaattagatcttttgtaagaaactccccttattttttaacttatttccaatttatatttgagaagcatgtaaatgtaatacagtgtccttttttaatc

SEQ ID NO: 112080 - DNA, 1067 bp, Homo sapiens
cattagtagtggttaaaaaggggtaatgatgctttctgaaagcttactgttactgattctgtgtatactttaactcaatggttagtttgtgtatttttttaactgcagctccagcaagggatacattttgcattatgattcagtacacagtaatacacctttatctgaaataagcttcatgaaacaagttattcttttcttatcttctatttttttctattctatttcacttctttgaaaaatgctcatcattatccactaaatgatttaacatgacttaccaaactatagttttagaaagtagttttcagtcacatgatcattttcactgtccttttatgatttataggataaagtaggatagtattatattcaatttgcatattttaatctataagatacactattcttcatgtactcaaagtatacttgaattttctagcaaaaaaattaagtaattataaattaaataactaaaaatagaaaattttgtgaggttttggggtttttgactgtcttagatgttttgagatttgggtaaagtttgttttttcattatttttacattaaccattaagaaatccattaatagttttgtgatctctttctctttatgtttttattttatttatttatttaaagacagagtctctgtcacccaagctgaaatgcagtggcgtgatcttggctcactgcagccttaacctctcaggctcaagttatcttcccacctcagcctcctgagtacttgggactatacgcgcacactaccatacctgactaatttttgtatttttagtagagacagggttttgtcatattgcccaggctggtctcgagctcctgagctcgagccattcaccggcctcggcctccaaaagtgctgggattgcaggtgtgcaccactattcccggcgcctttatttttgaacttgatatgactaaactaattggaaacatttattacttgtctgattaatgttttacattttatacaaattgtggcaaagtgagtaagaacttccaatgctgagattcataatttgcccttcagggggatttatcaa

SEQ ID NO: 112081 - DNA, 1020 bp, Homo sapiens
aggacatgtctaatgatagtaatcattcttacattttgatatggtggaaggacagatacacatagttttttgctctccttttcgtctacccctccactcttcaactcctttagtgagaatgtattcccccagccatgagaatataaatacacttttatatttcgtttgtagactatttaattcaaaaattataagggaggccaggcacggtggctcatgcctataatcccagcactttgggagtccaaggtgggaggatcgctctagcccagagtttgacaccaacctgggcaacgtagtgagaccccaactctacaaaaactgaaaaaatgagccacatgtgcatacctgtagtcccagctactcaggaggctgaggtgagaggatcacttgagcctaggaggtcgaggcttcagtgagctctgatcatgccatgcataccatcctgggtgacagaatgacactgtgtctcaaaaaaaaaaaaaatataggtgaaacaataatactctgattaacaaagggtataaatccactgacaagtaatttttgtgtccctgatagtcatattagtatcaccttttattttaaagtgtgtttaggaatttcataagtttcctaatctttttcatttatatatccctaaaaaatacataaagagcagattatatatacataatatacatataatttaaaataatttgaatagaggaatttgtggaaaagataagttaggtgtgtcagcaggaagagtctctgcttcattctatccatccatttatccgtctattcgttaagcatcttcagtgtgtcaggtactgtgctagccactaaaagttgaatataaagaaacagattactgacctcacgccagattcatcttcaaggagtggtggtggagctgtgcacttattggagatactctccataaatcctaacatgcttttattatacctgtggtagggcgagaaatagcctcaaatgggaccaaactagaatattggctgttgactgagagccttg

SEQ ID NO: 112082 - DNA, 1079 bp, Homo sapiens
atttttaatttccaaaagttacattgtaatgtatttcatcttattttttaattttttttacccatcactatgtttctaagacgtgtccaacttaaatggatctgaaatgtatacttttaaataactatatatagttgtatatcaactttggtttgcctgttcttttgctcagtgatggaccacttaagtagcttccaaaaaattgcttccaatgagagaatttcttcagagtgtagatgtagaagaggaatgcaagattccaaacgatgcaaaattgccctttagatccagttcattttctcactagtcatgtgtgtagtttctgtccacatgtctaaggacacagcattttccagctttctgattgttgctaatctattaggtgcaacgtggcattttgtttcaatttgtattgctctgaatactaattaaattaaaacacctctaacacctctgtgtttaatggccttccagattccttgttcatatttttcgccttttttccagtgggattgctgtatttttcttgttgcattacttgtaaattctatattctaattcttgtcagttttggatattttaaatatcttctattgtgttctctctttttttgttggcttacagtgttcctttctaagccaaaatatttaattttgaagtaattacattcatcattttatttttatatacggtaagtgattttgaatttatcctgttagagttcttacgtgattcattttacacacacacacacacacacacacacacacacacacatatgtatatgtatgtatgtatatatttgccaggcgtggtggctcactcctgtaatcccagcacttagggaggccaaggcgggtgaatcacttgaggtcaggagttcaagaccagcctggccaacatggtggaatccccatctctacaaaaatacaaaaaaaaattagccaggcatggtggtgcacgcctgtaatcccagctactcaggaggctgagacaggagaattgcttgaacccaggaggcggagggtgcagtgagctgagatcatgcaattgcattccagcctgggtgacagagtgag

SEQ ID NO: 112083 - DNA, 1013 bp, Homo sapiens
gacatttatttgccttttgttattccttagtttgaatataaggatcatggtagaaatttactatagtttctaagtttatattccttatagagtctttaatgtacatttaaagttgattctgtgctaaattacctttttctaattttttttttttttgagacggagtcttgctctgtcgcccaggctggagtgcaatggcgcagcctcggctcattgcaacctctgcctcctgggttcaagaaattctctgcctcagcctcctgagtagctgggattacaggcgctggccaccacatctggctaatttttttcttgtattattagtagagacgaggtttcaccatcttggccaggctggttttgaactcctgaccttatgatctacctgcctcagcctcccaaagttttggaattacaggcgtgagcccccgtgcccagcctattttttaaacaatagttgtaagtctgtagatgttggtagtctagaatttctcagattttcaaataggaaaatctagatattgaaataaaaaatgtagagattgagaaatttaagttctgtaggtgtacctactctaaatttatcatcagtaggtgaggaaaaggattccattcaaaatggctgagtaaaaacatttgtattctattcttctgcctaatgctaactgaacataacaaaaagaataaagaatagggaagaaatcttttaacttaagtgaagtgaggagaaaacagtaatcccaaacctcagattatgagaagagctgccaaacattgtgaaccttgaagcaaattgggaagtatgcaaatatctatagattttaaacacagcacagagtctcccatggtaggtagcaaggggactacaaagtctcaggcagggcgaagctgcagggaaagacacagatgtaccttttttttgcagaaaagagtggcaagaagcagcagaatagaggaggtagtatatagagccatctccttggtctcagttgatggaaagcagctgaagagaa

SEQ ID NO: 112084 - DNA, 1034 bp, Homo sapiens
ttttttgaaatttaatatatgcatggggtttaaaagaccatactgaaaagaatacacagtaaaagtaaatatcccactacagggctccagtttccctccctagcactgtcatcactaatttcttgaatatcttttaaaatatgttaaatatgtgtaagcatataggtgtacatataacatatatcctcctttaaatagcctattagaaacagttctcaagatacattttctatttcctaaatatgatagtacagtaatcaaatttataatggtagctctataaatcaagtcaatataaaaagtcctgtctacacataattaacagtctttgtttatcaataaatccagtgatagtaaagattaaaaacaaaaacccacaatttttcttcccagagactgacctttagggaattccttgggtaacaggttctgaatgtgtgagcacaatagggcccattcgcttgaaggtattttactcaaaacttgaaatctgggctccagctagaaagagggggaaaaaggttatgaattaatctctaattcagaatattttcctcaacacaggtagcccaggtccactaactatctcatacatgaggacttttcaaccttggttggatactggaatcaactaagaagctttttaaaaaatgctctgatgcccggaagccacactctgttcaaattaagtctctggggctagagcctgggcagtgtttttatgggtttcccaactgattctaatgtgcatccggggttgagaaccactgccacagaaatataaaatcatatggtatggaggtcacctataaacttttcagcttgttgctaaataacgtatgagtatggaaaatgcactttttttattttattattttattttattttttgagacacagtttcactcttgtcacccaggctggagtgcaatggcctgatcttggcttactgcaatctccacctcccaaattcaagtgattttcctgcctcagcctcccgagtagctgggattacaggtgtacgccaccatgcct

SEQ ID NO: 112085 - DNA, 1110 bp, Homo sapiens
gatgatgaataaagcaaaggaggtctatttttctggttatgatttactattactttttctcttctgaaaaagcagtgaagccccaggaccataacaacatcagggaggtgggaagaccattttgtgctaatagtagtccagtcatcttcatgcaatggttgaaagactgtatccgtgagtgggaagtgctactgttgatatgatatgcttttttaaaagaggtaactatttggggacgaaacaaacaaaaaaactcttttctactttctgcgggcttgggcactggcacttgaatcactggtgtggcaattgaacatgatctcctttgacaatcaaataaaagtcataggtcatctctctagaatatatgtatgtttacaaatttaatatgaagttttggggcttcatttacccccaagccagcattgtccaatgtaactttctgtgacaattaaaatgttttatattggctctgtctaatacagtagtcactagacacataatagctgttgagcacttcaaaagtgtctgcaactgaggaactagattttttacttcatatatttaaattaatttgtatttaagattaaatagccacatgtaggtagtggctgccagcttaggctctttcatatgccataggttataatccctataaaagaggttttgtgaatgtcattgttaggaatttaatttgtttatttcacttttgatttttgcagtcaagcagtagttaattgtatcttgcttttcagttaaattttaatagttgttatctctaaatatgtaacttctttgtaattcaggaagatttaaaggcgattttcaatatttgatcctgtttctttcataatgaaatatccagaataggtttgtcctgggattttaagcttgttcagaaaatgtgaggtgaatacctattgagtcctgtgttgtgggctctccagcgtcactttgtcctgcgttaggaacactctggttatttagagccacctttgcccaagtatcttaaaagtgcatttcccctttgggagaccgaggcgggcagatcacctgaggtcaggaggagttcaagaccagcctggccaacatagtgaaactctgtctcta

SEQ ID NO: 112086 - DNA, 1081 bp, Homo sapiens
agtactatattagtttatgtttgcctgaaaattttgtggtgatagactttagatcaaattaaattctgtttcaggaataatattcaatcttaaatgcctttttaaaattgtggaatatacactacctaaaaatgaccattttaacaatatttaagtgtacaattcagcagcattatatatgttcaggatgttgggtaaccatcaccactatctatttccggaagtttttcatcatctgaaacagaagctctgtacccattaggtaataattcccattcttctctctcctggctcctagccacctctattctgttttctgtctctatgaatttgcctgttctagatattttatattaagtatgatcatacaatattggtcattttgagtctggcttttttcacttagtataatcttttcaaggttcatgtatgttgttgcgtgtatcagaatttcatttctattatggaagaataatctattgtatgtgtataccacattctatttattttttcatctgtttacacacacctgagtcattaacacctttcactattgtgaaaattgctgataagaacattggcatacaaaattctgtttgagtcactgttttcaactcttttgaaaacagaattgctgggttgtatggtaactctttgtttaactttttgaggaaccactaaacttgctttccacagtggctgcaccattttgcatttttctagcaatacatgagggttccaatttctctacatacttactagcacttgttattttccatttttttggaaagtagccatcataataggtgttaaatggtgtctcattgtggttttgatgtgcattttcctaatgactaaattatattgagcatttttacacatgcttactgacaagatacagttgacccttgagcaactcagggcttagggatgccagtgcccctccagtcgaaaatttatgtataacttttgactctcccaaaatgtaactactaataacctatttttttttgttttgttttgttttgtcttgttttgtttttgagacggagtctcacactgttgcccgggctgaagtgca

SEQ ID NO: 112087 - DNA, 1055 bp, Homo sapiens
gttagaaggcccctaggaattagtccaggctcctcctttttgaattaaagaactttaggaccaaaatgtgtttgactacactatagaacttgttgagagcagagttactagaggcctaagaaactagatctcatgattcatatgctaatgttttcatattgaaatattgactggtaaatgaaaggaaacatttatatatcctgtataaggcaacccaaataacttgagactagagtatgacctttgaatgaggcagcaatttttaaaattttaatttagaacaaatcaattcagctctataccgcatttatcttgagatgcatgaaaaatacacctagagaaatagcatgaattttttctccaagaaaagaggctgtgtggtctgtgatatacaaatgagtactggactggaagtggtaagggttgagttctgaatctggctctaacactaagtagctgtgttgtcattgattctttgcataatttctccaggtcaaagtttccttatcagtaaaatgaagaagtgaaatcagatggtctgtagagaccagctttaaataactttatatttttcatggatctttaatagcaaatttaatctattttaaataaagtgctatatgttccattattaaacaagcaagacaacaagtaaggaggtaaagagaatcagtagaaaatgaatgactcatgatgtatattctgaacataaactgagttttcttttcctttccttcatcaggtataatacttctccacgtctgcttcaggaagaaagtgcctgccattcttatcatttctaagcaggttcatgccagcccagaacagagaatcaggtcagttttaggattttttttttgttgaaaaaggagccaggaacagaattgtgattgtctttgctgcgttattgtgcagcagcaagaccagtgacttgtgattcaggagttgggtttcaaccgtcctttaccactgatgactggtaagcttgggcaagccttctttgcttgttggctcttagttttctgcaccaaaacagggctacattagaataagtt

SEQ ID NO: 112088 - DNA, 2018 bp, Homo sapiens
ataggcctttggatttaacaatattcaggtaattgatgaccttgaatttcagtgatgttgtgtagtaaaagtctaattggagtgtgttaaatttgaatggaagtataattgtagacaaggagtacaagcttgtgatgttttgctaaaaaaggaatcaaagatattggccatcatctagaggcatataaggagtcgagaggttttgttgtttgttttctaatgattggaaatgtatttgccagtgattttgctttattggaaggaggaaattgatgacgtaggagagagaagtgggatttcctagagcaatgacattggtgttctaggcatgtaacatctagtagcaaagtagaggggttagattttgatgtgaatcctgaaattcagtgaaagggtacagattcaggtggggaggtaaatgtcatgagagattctggaagttctcttctgattgcctgtggcttttgaattttttttttcttgtatgatgcatttcatcagattacctggcaggagtcctgggaggccttaggaggactctaaaactgcttgttaaaaattttgaaaatttattttttgttattatttagtttaactggctactttgtataaagtttggaaagagactccacaaaatctttctgggctatttggaaaaaaattttctcattgatcttcaagccaaataattttttttaaaagagacagggtcttgctatgtcacccaggctgaagggcagtggcacgttcatagctcactgtggcctcaatctcctggacttaagtgatcctcctgcctcagactcctaagtacctaggactacaggtgtttgccaccatgcccagctaatttttaaattttttgtagagatggggtctcactatgttgcccagtgtggtatcaaactgctgttctcaagtgatagtcctgcctcagcctcacaaagagctgagattacaggcgtgagccaccactccccacccaaagagtatgataagacccagcacaatttccattttaagtattaatataagaaaaccaactcagaagacatagataggccagggagatatagctaatcatctagctaagtctggaattcaggtttctgtggcatttcaatgtacacagtttaatttcaaaatttagtttttatacatatgtgcatatacatttaaacttaatcctctgacaatgtaactgacttactctaaattggaggcaaggaaagcatgaagtaaaaatatgtaaaatgtcagggtcaaaatgggaactttaaattgtggtcttaattgtgacctgtgtaaaacttgattcctgagaattatactatattacatattgtagttagaatgtactgaaatcattttgtagcatttgttcttggctgagtttatattaaaatgaaagattgtaaatctagattgattttataatattttagatttctgatactttaagatgtctgtagattacatttatattaaaaaatgggttgaggaaatcattggtactctaacttgctgttgccagttttctggccgcctgctatttttgcttctgctcccttatctcaacaattgcctgtttttggtcaagactggtaaaaccaagtaatgggcatccaaatacatataaaatacacatgaaacaatatgaaaatggcaaataagtcaggaggaaaatgggtaaaatatatgaataggcatttcatacgagagaaaatatgagatagccaagaaacatgaagaaatactcagcatcattaattgacaaggaagtgcgaactaagaccacaattagatgccattctatacccagcattaaaaagttggcattactacacgttggagaggctgtagatgtggtagttctgctactaccttttggtagtgaagttataaattgccaaacacactttagggaaagtaaaaattggcatcatcatgaaaagttaaatttaagattactccctaactcttaggcatgtacttaagagaaactcggacacatgtgg

SEQ ID NO: 112089 - DNA, 1068 bp, Homo sapiens
atgtcttaaagcatcaccccacagactgtgtactaattgcaagggataatatagtgattatgcattggtgcgatccaacaacaatatggggcagatggtcaccatgtgactccagataggacaccctgaggggacacatcatctcctctgtagtattctggccaagactgcataacctgaatttaatcacgaggaaacattcgacaagtgcaaaataaggaatgttctactttaaaaagcggggagggaactgtggtccttaaaaaagtcagtgtcataaaagagaaagaaaggctatggaagtgttccaaattaaaggaggcatagaagagagaaccactaacagtacctgaccctagactggatcttatactgaatgggggaaaatataccatgcaggatgttattggatcaattgaaaaattagaatattggaatatagaccatagaatagataaaaatattgtaacaatgttataattactgaagttgatcactgtgctttccttataagagaaagtattgctaaagaaacacacattggaagaagaggaggaaagggcttgatgtatatagtttattctcatttgctccaggaaaaaaagtgtatgtgtgcatgtgtgtgtatgaatgcaagaaagtgtaaaagctcaggagcacaaatgtaaaagtaaagaggtgacattagtaatggctgaatctgagtatgagtgatttttgtatttttactaacttttctgtaagtttggaattattttcaaacaaaatattgaaaacatttaaaaatatctgccctttatttttagactttcctcatttataaagagcttggttctttctctggaaccagtttggaatgaacatttttgtaatattttcctgtgtgctggtgttacggccctgcatgccaaccattgttaaatatgacagcagttagtgggaaagaaatgagtcattctgtggacggccagagtctaaaacctaataataaggggaactatttgttaatttatcaaatttatggaagtatcagttacaatgtctaataaaatattttgaggttatcat

SEQ ID NO: 112090 - DNA, 1299 bp, Homo sapiens
caaagtgctaggattacaggcataagtcactgtgcccggcccctagcaggaatttttataccttcttcctagactcctgctattaaggtgactttgctgtaaagatttagtctctctctgccttgcatcttcaatttatatattccatcaagaaaggattaaattggccgggcacggtggctcacgcctgtaatcccagcactttgggaggccgaggcgggtggatcacaaggtcaggagatcgagaccatcctggctaacacagtgaaactccgtatctactaaaaatacaaaaaaattagccaggcgtggtggcaggtgcctgtagtcctagctactagggaggctgaggcgggagaatggcatgaacctgggaggcagagcttgcagtgagcggagatcacgccactgcactccagcctgggcaacagagcgagactctgtctcaaaaaaaaaaacaaaaaatgaaaggattaaattaacctcgttcagatcaggtgtctgtctgtactagagccagggtatgcagacttatgatgtatagcgcgctaggaatatacctcggtgctgggggtcattcccaaagaaggggaagtcaaaagctgggcagccctcctaggtgtctagaacatctcactctttggtagcttaaccactgcttttcctgtctctttccctttgctttcctccccactagtagagataaccctgctatcccatgtattgatgcagtttttccagtgggagaaaagcaaaaagcaagttgaagtaccatatccagaggcagtgccatagggctactgactctgagtgatatcatgctgcctcctggttccattgtgattctttcttgatattttacaacctaaatttaactcctgccaacttgccatctgcatgcttgagggaaaggaagaggaaataaagagaaaatgtatttaaagggaaagagaagggtacttatcacacaccagtgactattaaggaaataaatggtggccacagtccttagttttacatctgagcacaaagccctaacctgtttcacttcagattacatatttctgttaccttctgctagtgtcctggcttatcagggttctgtttctaggaagctaactcagtccttcattcccaaaagggtctgaggtttggtagttccaactgtatagaattgtgataatctttcactcacattaacactgtgtacggcactgccagagaatatgagattcccccaagttcttttctcatgatcttcctagccccaggtgtgcagtagcaacctgtcttctcctt

SEQ ID NO: 112091 - DNA, 1171 bp, Homo sapiens
ttatagataaatttatagtcagatttctttgattaaagcctggagtctttttgtgtctctttgaccctacagtccaagttctttccccatggcattgcccattaaaacacagtattaggtgatttagatgataaatgccatagttgagtaaataagtatgaaataaaaataaactctatatcagttatttgtagaacaatcattgtgtattgattgcttaataattttatttagcttgatttatttgtgtaatgagtagggactaaattagatcaagtatcagggattaaacttgctacctgagaacctagttcttatttcccaaaataatgatcctatgtaaatagactctcaagtgatgttatgctatataataataattctgtaagctttttttcctaaagatgataacatattttattgtgattgtgctgggtatcacgggtactatgcatggacgctttacacatgggtagttctgccctcaataactttataacatagtggagataagataggtagatacataattgaatggtatttgatgagtctgagaggtgcagaagtgctatggacacttaatgagtagaaagattattttcgattgaactgattaagagaaccctaagatatgatctttgatctgcatatcagggggattgatcaaatttctttggtgggaattgtgaaatttatttatatcaaaattataggacatataaaattgatagatttcactctcagtgaatcagaacaggtttcttggggaaaaatattagcccaaatataatatttaagtaaagaagaaaaggattagggataatgtaagatacttaggaaaaaaaatacttataatatgagaatcttactcttgctcctgaagcattttacaactaggtcatcataaaaattgtactaagtatgacttccctagcatgtattctttttttaaaaaaatacattttattgtgtatatttaagatattcacatgatgttatgagataacataagtagtaaaatgtttacaatggtgaaacaaatgaacatatctatcatctcacataattacccatttttcccctgtgtcaaaagcagctatgacctgctcatttagcaaaaatcctgaatacaatacattgtcagttaatgagatctttagatttgttcatc

SEQ ID NO: 112092 - DNA, 1050 bp, Homo sapiens
gttcttcatgcattggctcttctttccactctgggtccttgaaataatagcgatcattgagttctgacatggattctttcagctttcttcagtttcttaagcctttggtacctgtgttacgagtggagatcatgtgacagggtgatttttgacatgttgtaattggtatgttgtcaacacttgatgaaccagctgctcagccaattaataccaggcccagcttcctcttcctgtatgatgtttcttcctagcatgtttccttctgttctccagccaatatagacttaaaggaggccaacttatttaatattagcctgaggaaagtaggaatttgatacatagctgttatttggtctatgaaaaaattatgccaaaattattttgttatgtgctatttttttttcaaaggacaactgatttgtttatctgcacattaacttgtagttttattgccttgctctgagtaaaacatccacacacataaatttcactttataagttgaataactcaggaggtgattaattatcctgcctaggattcaacactttaaatagaatttccacaagtattttctcaaaatattcgttacttagtacatgttaagtgtttgagtttagaaaaacaatttaatatacctgttttaatttctccaacacttattaaatatgcattaccttattgatttttttaatttttaattttgaaataattataaacttgggaagttgcaaaaatagtatagagctccacgtactcttcacctatctttctttccccattagtaatatcttataactatagtacaataactgatttatattttattactaaaagcatagtgaccttattttgaaaaatgttggaaaatacaagaatgttggtatttttgtcctcttcagaggatgaagatgtttgtgtatacaaattcagatctgtgccttatgtccgtaggcagcaggcccagggtatgtttcttccctgcatttcctgtaagaagagcaacaggtattagacaaatggctgattgtttccacagggtaattcattca

SEQ ID NO: 112093 - DNA, 1588 bp, Homo sapiens
attctacttaactgcagtctcacgtcttctcatagattaccctcacactctttccaaaatgaattgttttttgttttaattttttaaaatgtgaaattgtggtctttccagtatacctttttttttctgcttaaaattcttgaatagatcttaagtcattatcaaagaggcgctaaaacatggggttgcagtctataaaaaactctttgtaacctggctccagcttctccagtcacatctctgacagccattcatttgttcattttttaaaaaaagacttgagtgtctgctgtctgttaggcacagtgctgggtgatagcgctatatcagggagcttaaattctagtggtgaggggagtagataacaagtattactattgtcaattgtactgtcaataattgtcaattattataatacatagtacattatatactatattattataactgtcagtgacatcatacaatcattggggtgctaaagtatgggtgggtttgccatttatagaggtctgaatcagaaggcctctctgtaaaggtccattagaagagatttgaggcagccaagggagtgagaattgtaggactgagagaagagcaagtgctgaggctctgaagcagggtgcttggcacattcacagaacagtaaggggttggctggaaggaggtgaaccatgaggtcaaggtgatggaggtgtcattagtcttgggtaggccagtgttaggactttgacttctgagctcagtgtgtttgagcctagattgcatcctctgcatggcagagatgcattcctgtctcctacttgaagcttttgaagtatgccaagctctcctgcctctgagcctttctttctacctggaatagtacttaggttgtccctcctggatgttcccttagcactcttggttgtactcctattatgaaacttaatagctggtttatttgtctctccaccctaggctgaggtcttggatgggaggaactggaattttttaaaaaaaaacttctgattttttatttcattgaattaatgtttgttgaattatagaactgcttaaacataggattaatcattgaaaactgggtaggagatgccaaccacattgcttagcaactgctagttcatgtggacatggaatctgttttgctgaccactgtgcatttagtgctggtgcaatgagctatacacagtaggtgctcagtaaatacttggtaaatgattgagtgcacattcctgtaccagcctctgccttttccactgcttccctgaaacccatgggttaaatgaacccaaaatcccttaacgtttcctgacagccttatctttccactaatcttatgcgcaagaaatgccaaatacttagagatgcattctttcaccataaataaatgtaataataaagaaatacagtagcaaagaaatgtggaaataatttatctccaagttaaataaataaagttcattgcagaatgttttggctcattcacacttctgtttttctttctttggttggaattttttcaggttaatttattacttggcccccaaatctttaataactgtaacactaatagatctagaatatc

SEQ ID NO: 112094 - DNA, 1034 bp, Homo sapiens
aaatctatatttctatttatgtcgagtcaaaatctgccttcctgatatttacactgataaatccagttcccccttggtgtgtgtggtgtatttatcatccatgaaatgattaagaaataaatggcgaccgggcatggtggctcacacctgtaatcccagcactttgggaggccgaggcagatgaatcacctgaggtcaggagttcaagaccagcctggccaatatggtgaatccccgtgtctactaaaaatacaaaaattagcttggcctggtggtgtgcacctgtagtcccagatgctcgggaggctgaggcaggagaatcgcttgaactggggaggtggaggttgcagtgagctgagatggcgccaccgcactccaacctgggtgacagagtgagactccatctcaaaaaaaaaaaaaaaagaaatggctcctactttaattttttagagtaatgtttattgaagcataatttacatgtagtgaaagtaaaagtttaacaaatgtctataattggatagtctccaccacagtcaagacatagaaaaggacgtttccgttactctaaaaagttcactcatgccctgtcatgagtcagtcctctacctctacactcccagcccctgaaaaccgttaatttaattgatgctcttaaagttttatctcgtctggcatatataaatggaattatacattatgtagcctttcgtgttcccttgcacttagcgtaatgcttgatatttattaagttgttacatgtgtcagtattttgttcagtgatgtgctgggaaatgtcttaacaacatactcttcagaaaaaaaaaaagaatctctgatttatagcattcgctaatcattgtagtgtaaacactgtcactatggcctaaattaagctaccagcttacagaattcctgaaaatttaacaatgggctcccatgagctggtaccagccagctccagcacagttcctttttttgttgagtaacattgttttacaccagggtaacacaatttgttcatccattcataaact

SEQ ID NO: 112095 - DNA, 1075 bp, Homo sapiens
aaaaaatccgactttaaaaaaaataaaactttatcatgagactcttaagtataggaattaggttggtatgtttttatgtttaaaaatatatattgcattagaattgagaactcttcctatgatatttgagcaatagtaaagtatgttaatactttgaaccattctatctcaagctgctagaaagaggtttctactgctagtttctttccatgagttaaaatggattcatctgaaatatatgtatgcttttggtgggtcacagtgggtcatgcctgtcattccagcactttgggaggccaaggctgggggatcacttgaggccaggagttagagaccagcctgggcaacaaagagaaaacaatttttgtaaagaaaaaaaaaaatgtttcaaaaaatttgtatcacctccaaaaaggagggataagttagaaaatacaatgttctactcttgcataatctgtttttgaaaaagtaaatgacagtatatttcaatattagttggattctctgctttgaagagattcttaaattccactgctcaactttgcaattttaaaagtttacatcagttgttcttaatttatttatttatttctttttttagagacagggtcttgccctgttgcccaggctggggtgtagtggcacgatcacggttcactgcagccttgaacttctgggcccgagtgatccttctcccacagcctcccaagaagttaggactacatgtgcatgccaccatgcctgtctaatttttctattttttgtagagatgagggtctccctgtgttgctcaggctgatcttgaactcctggcctcaagtgatcctcctgccttagcctctctaagtgctgggattacagatgtgagccaccatgccctgcttctttcttaatttcatgcatatacttctgagggtccttggcttcccagaaatcatatgcagaatatagcatatatttgcttttttcctagataaagactctgttgggtgatcacattctcaaaaggatatgggtctgtaaaagattatgaacttctagatataaaattaaagaatacatattccatatt

SEQ ID NO: 112096 - DNA, 1184 bp, Homo sapiens
accaccgaggtcaacaaaagacacagcctgatctcttccagtccctcaagattcaattttagttttgctacccaaattgcactccacatctatctcttaatgttcctggctcaaggcatcatattctaaacactgtcttgaattcaacttcccaatcgtaggtagaggcagaggcagagtctgccctctaatacatgaggcttgggataacacaactgaatgtctgctctctgtagttagctggatcacaagggtggatggcagaaagagctgggatacttgtttccagttcctttctgaaactcacctgtcaggtaactcactccatctttgtgcacaagaagctggacgtatttaggataaacccctctttgcggaaagcagaggagtgaagttctagtccctctcaacatgacctgattcgatttttcccctgtggcctcctttgatagactgtcttgaaacaagtgtttctttccagaataaaaaccaaacaaacacaaaggacttatgtgttctaagtaattgaggagctcaccagttgaatggcttgactgatgcgtcatcaattttaattctgctgcagagggtttccccaggtgctttacatatgctagctgtaactgatctcttcaagcactcaatgtaacacttttctggaaatgctgggttaagtcttgctttccaaaagtaagctggaaagatttcaaataacatggatggaaaaaaattgaataaacaggaaaatgattcacagtgtgcattgatacagggagatgtaattacattaaattaaatgaggtaatagttgtgaaagaacttggcaaacttgtaaaataccatatgaaggtaaagttttagcttttacattctgtacaaatggattgcaatttgaagtccacagttcctattataaggattttggtaggaaggttaaaacctagttttactcttccttacattaggagaagccttgaaatggtaaatgatctttctaagccatatggtccatagtcaccaacataaggaatgtctaagtgggaccagaagtcagtatgtttctcttaatgatcagtgtcagaagtttgtgagtgcctagattcatgtgaaatgcaagctaccagggcataagacactgacaaagctgaaaactggaccataaaaaaatcttaacaacatcaact

SEQ ID NO: 112097 - DNA, 1049 bp, Homo sapiens
ctcactgggtagattggtggtgggggagccacctgaattcaagcccccagcccagtgttggaaacatagtacacatctgttaatgtttccccaataagtgggcaagtgaagtcgtcaataaatgaaatactggtgcactccaacttatgaagatagttatatctcagaagtccatttaaaaaatgtctatttggtcttagagttcattttccaaatataacaatgctacaaaacataatccactttccataccaccccacacatgcctatttaatctctataatagatgaaatattgtgcttttgcatatctaaagcaaaagcaaaacaaacaaaaactactgtgaaatcatctttttcttttggacatcacaaaatacacttgagtttaaagaaaatagaaacaattataatagatatacattttccacaactgtgttttatattgtactataaaatctgtaatctgtgaaatccaagtgggaggtcctggatttggctgtgaagactaataatgaagttaaatttggagatcctgcttattgaatgggcaatagtcttaattaatcaaataaaatagaaacactaattttggctatttaataattatctggagtgctggtgcttgagggaaattaattaaaggagaatgtggagctggatggagaagaggaaatttagaggggcagcttctttcatgttatagtttctttattgtattgattttcctttcatctcatttgagcactgaggcaaatccaaagtttcttcctgaaaaaaattctttgtctgcagttatttttgctaatatgtagaaaggggcttacacactgtttagactaaaatacatatgggcttattttattttcagagcaatgttacctttgtcatgtgcatactgccagttagcacgtggataatacgtattttgatcaagaattcatacgtgtggttcagggtatagccagggattgaaagctcaagttcctccttattcagcatctctgaaaagcctggaactactatcactgatatttaagaataatagtc

SEQ ID NO: 112098 - DNA, 1043 bp, Homo sapiens
tcctaatgtaccactcccctttctttcactccttctctttccctctctctccctttctttttctccctctctctacccgtttgccttcttcccttctttttccttctctccctcccctctccccctcactctcccaacccctttccctctcttgccttcctttttatctctttccttctccttcttccctcccctctctcccccttgtcttccccgtcttcccctccctcccctgtccttcccaggttctccaggagcctcctctcccctctccaggctcattttttttccactgctctatgtaccctgcttttcctcttatggtcatttatttccttgtcaccttcatggcaataagtctttaatacattcctcctcctcctcctccccctcctctagcccctccccttcctcctcctcctcctcctccttctctctcgctctctctctcttcctctgagtctctattctcatcgccattactttctttggaaaggagaacccatgcctctgctctggtaaaatgctggctgcatagtaacggtatattatgtaaacttgtcttgtttacccaccctagtattagtctgtttcttctagaggagttcttatagtatggtaattcaaataaagccatctaacggccacccataaaatacaaagaatcctttttgaaaatgaaaattgcttcagaataaatattggttattccagtaattcaaaaggatagaattaagctattttagaaaacattttaaaataattacaaaaattgtgcttaccacaactgaggcagaaaataagaattctgatttttttaaaatctgtcttctggagatctttatgtaacttggaatctaataaaattgaaaaattatatctcttctatgtgtaattaaatgtttctttaacgatctaggaaagactttcaactgatgtgccctccgaaggctttggagttaggcactgtattagttttctagggttgctataacgaagtaccacaaactgggtggttttaaacaaaagaaattcactgtctt

SEQ ID NO: 112099 - DNA, 1168 bp, Homo sapiens
catttccaaagcaaatgttgtcccatctgaatcacatagcccatcctattggccatcaaattcttctcaaccttctttccctcttctgcactctaacaaagagactacggtggagtttatagaagcttctacaacgtggttttgttgtatatagatgtgtatgtatgtctatgaatatgtctcccccctatctagttttagaaaccggtattcctaagttatggctttattttcttcactattgatgttcttggaagagtaaaattgctagttcattctcattagtcactgttttttcatttctctttcaattctctgaagctcttctgaatgtcaaaaacatgagggctccattttagtatccctagttgttgattgcctgtgtctcgtgacgtttattgtgacaggtataccatgacttagtttacatcgctggtgtttaacttccacctgtgttccattcattcaacaaatttgacagcagtatttattgactgcctttaatgtgtcagacactgtttcagttgagtgatataatcagaatccttactccagtacaaaaaaaaaaggacatgctaattactctcagagaacctaggatcaacttacatgactagacactaataaagaaccacacaaatgaatataaaactatatttgtggcaagtgccacaaaagagaagaatgtggtgctatgaacacataaacccttcttctcagggaggtcaaaaaccacttctgtgagaaaggtaatgtttcagccttgtttgcttctcagttatttgataaacttgtgaatcactttatcacctataaatgattttcttttcagatgactattggaatagtgagtaatatatactatttttactgtccttaccacttatctttgactttgttttaaagtcttttccaaaaaagttatacacttttttatcactcattcaaactctaattaatacatctacctaattttaataaatggctgttggagtgatttaactggtaaacaaaaggtatagaggcttttgatcagaatgaaagcagtgttcagacaacaaaaattacagggattttgctaaataataatagcatatatgacaggcagtatttataatagatacattttgtgaacttaattatacatctttcggggagatagagaaaa

SEQ ID NO: 112100 - DNA, 1015 bp, Homo sapiens
ctcccatgacaaagagcgacctagcaaggacactctttgatatagtttggatatttgtcctcacccaaatctcatgttaagttgtaaccccaatgctggaggtggggctgggcaggaagtgtttgagtcatgagggtaggtccctcatagccggtgctgtctttgtgatagtgagttctcctgtgacctggtcattgaaatgtgtgtggtaccaccaccccccacttgctcctcctttgaccatgtcaccatgacatcccttatgacctcatctaaaaacctcctaaagaccccatctctaattaccattactttggggattaggacttcaacatatgaattctggggagacacaaatattcagcccataagtggatatttttggttgcatccttgtcccatctattctttgctttttcccttacaaacatgatcctatgatggatatagagaaagatttgaatcagagactacagcagtatatgtcattttattcttggcacctccttgttaatcttcttcctagatatgcagaaggaaatcaaactgatgagtgtccattaaaaatttcatttttcaaactggacagtggctcacacctgtaatcccaacactgtgggaggctgaggtggaaaaatcacttgagcccaggcgtttgagaccagcctggtcaacatagtgatatcctgtctctacaaaaaataatttttcaaaaaagttagccagatgtggtggtgcctgcctgtagtcccagctagttgggaggctgatgtgggaggatcacttgaacctgggaggttgaggctgcagtgagctatgatcatgccactgcactccagcctgggcaacagagcaagaccctgtctcaattttttttttttaatttacttttcagagagatatccttaccaccctatttaaaactgttaaccaacaccctccccaccccgctataactcctgacttcactttctctactgttttttcttttctgaacagtcattatcatcttcta

SEQ ID NO: 112101 - DNA, 1035 bp, Homo sapiens
aatgatttctatatttctggcttttgcaactgcatagaagagggtgacagtcactgagctggggaatacataatgagagccagatttacttgcattttaatttgactaagttgagtttaagacatctttgagataagtggaaatgtcaaataagcttttgaatgtatctgaagctcagagtgtcctagattagaaatattactccgatattcattggcttacagttggttattgaaatcataggcctggatgagatagcctggagaaagagagtactagagtcagaagagaagaaattattggataaatctttttaaaaactctaatatttaaaggtcaattagagtcagcaaaagacattcagacaacagagaaattagggaaaaacctagagaaaacaaagaaacaaaggaaagaaggtgcttcaaggaaagagtggtcaatagtgatgaacacttctagaaagtcaagtcactgaaaagtgaacattatcaaacacgcagcttgtgagtcatgtaagtggaatgctgggtgcatcaaccaggctgcagtgggtacagtgaagaaatagattcagtatagacagtaggcaaacaaaaaaatagaatagcgggaagtcaaagtactttttttaatgacacagacttttaagtatatctcagcactgaatgaaatgatccactaaagagagaaatttaaagatagagaaaggatagctgggcgtggtggctcatgcctgtaatcccagcattttgggaagccgaggcaggtggatcacctaaggtcaggagttcgagactagcctggccaacatggtgaaaccccatctctactgaaaatacaaaaattggccgggtgtgctggcagatgcctgtaatcccagctactcaggaggctgaggcagtggaattcttgaacccggaaggcagaggttgcagcgagccaagatcatgccattacaatcccacctgggtgacaagagcaaaactccatctcaaaaaacaaacaaaaaaaaaaaagaaaaggaaaagaaag

SEQ ID NO: 112102 - DNA, 1030 bp, Homo sapiens
cttgagtgaacatgattctggcacataatttttgattattgggaatataaaagattctgatgcatcttactgtatactgggttatagctacaccttggatattcactgattataatgatgatatatgatgtttgctctctgatgatgttgatgttttgggtatttgttttcacagggtactatttttctgcctggaaataaagtttctgagcatccctgcaatgaagagaacccagggaagttcctttttgaagtagttccaggtaagatattttcctagtctgattaaattattgtcatcctgtgttggtaaaggtgaagatgggtcagacaggtttcattcttttttgaatcatgactgagaaccttaatttgaggcttggttagtgttgacgcagataatgactgcaggtttatatactagtacaaatgaatgcactcacacacacatactctgaccacataactactggattttcatttgtccatgagactccatagttgaccacaagtcatgatacagtatttgttcaggactattggagatgaatttgattttacagcgctcttgtgatgtgaaatttgacaaggggttataggttgaatgctttgcccagtggaatcactgacatatttcctcacaaaattgtatcttcaaggaggttttgcaaaaaacaaaaaaaaaaacaaaaaacaaacaaacaaaaaaaaacaactcttactacttaatacttgtaatactgaccaagtattacagttctgtacctcagctttgctcccaaccaaccacttccacatgttttgctggtagagctgaggacagctctgccaagacatcaaatccctcagttaaacttttgaaacatcctttcgtttttcctagtcatctgtattcattcctcttagtgaacctgatctccactaaagtctttgactaacccagcaacaattcctccaaggccatgttgtctacctctttgatcaattcttcaacttttccttatccctcaatgtaagaaaaagggaggta

SEQ ID NO: 112103 - DNA, 1015 bp, Homo sapiens
aattgtcaatattccagaccctaaaaggcccatctgacccagtgcctaaaatcaatattaactaaaagtaggaggtgttctttcctcttccttcctccagggaaagaaaagaagaggtgaacacaaaagacaaggggatgaggaatgaaaagtagccatggaaaaaaataagataaattttgaaggataatctaaagtgatttttatctgcctggaaacaaaattaggccttcaaaaaaaaaaaagatgttatttatcctacctttagccacaactatactaattatttccaataccctcagacaattacatgttacttttgtacatttcaaattttaaaaagtttccattctaattattttttccagaaggatttcttaggagataggtgaaaagttagaggacatgggtgcctaaagaatctaataaatgcattgatccttttgccaaaaaaaaaaaaaaaaaaaaaggcaaatacctaccaaaattgcacatacttttgaggacttcagagattccctaaaatgcaatcattgactgtagtttaagaataatagtttatattgggaaccaaagactttattatctctctctctctcacctctctctcactctttatctctattttagctaatctgtctatgttcctatgcatttatctattttatctatgtacatgtgtgcataaactgttatttgtaattatctgttataccaatcagttttagacttttacctctctgattcagttgttctttctcctgtttctatgattgtgtaactccacagacctattttgcacatttacagaagaacttttcctggatggaacatttcatgggtctggaggctgtaaaatttttaatttagtaaaacttcaacctacttagatggttactgcagctgtgttacataataggccagctgagaaataaatagttatgagatagattcatgggtgtctctgggaaagaaaaaagtttggccaatttttgagtttttgggataataatgt

SEQ ID NO: 112104 - DNA, 1083 bp, Homo sapiens
actgtactatattccacactacagttgaaaaaaagtgttctgctacatcgaaggtcaagagattgccttgcttccttaagagcattgttaaaggtctgataatttaagaaaattaagataaaataatgcattatgtgtatgttacaaaaaccagagtaatagtctactatacagaaagacttctgaacttgcttcttcaattgaaaaacaagcaggacccaatttaaaaaataagtattggcactagtaataaaaactgatttttcctttctgcatcctgcaatgaattcattgttaaaaaaaatcaaaactcatttttctaaaaatctctggactctttgtaaaagttaactttcctagtcaatatcctcaagaagttttccgggtgacttgtattcttgtcttccctattctcactatataaaaaccacactttatttcctttctttttctgagaaagctgtaaggtaactaatttactcagactatggaactctagaccatgcagatcttgattgtaattctaacttcaccattgacctttaacagtgtacaggttaattatgcttatctgtaaaataagaataacaggtatctcctaggattattatgagagctaactgagataatatacataaagttcccagctcccagccctgtgtgtctcataagacgggtggccacattttcagttcctttcctgttctccacctgtctccctccctctgttccccgcccctctccacaactcgacctctaaaaaatgcttaagtaattgtagagaaattagcatgaatgcccagatgcatttgttactgaataactcagcagtgaacttggcattccatagctaacctttccccttcattaatccccttctccatccccctcaaacacaggagtacaacaggatgccaggcgaactatgtaaccaaccatgcacgtgagcattttctcccagaattttgactagtcttgttctgcctcaaacactagacggggctcatgctgctcacaattaactgactctggccatgtggtggctgccctcaagatctgccacaaagagaacagcagttcaat

SEQ ID NO: 112105 - DNA, 1054 bp, Homo sapiens
actacagaattcataacacatctcttagcatctcttatacccagttcccttttttaactatataaaatgagtcattacattatatgttttacatgtcattttgtcttcacagctattctctgcaatatatcctgccaataaattgatttattcagcatgaactcagataattagcatcactcagatgatgctaataaagtacctcgacctagtggatatttaagaaactggatttactcttcagggagactagttcatggccattaagatcatttggtacttttgtgctttgcattgtttgacatttaattatttgtaataatatgattaatttatataattaaaaaatcaatatttgacccactattgaaatactaaattgagttattgttaaccttttaacaagacaaaattaatgtctacttatattcattcttaagtgtttagcttttgtgaaaactgaattcaggtagtgttatgacttgtttattcatgttcagacctaaattaggaagcacagtataatagaaagagcaaacacattgaatttgggtagtcctcggtttgagttttagctcttttagtaattagaatgactttggataaatttaatctatttctgatctgtaaaatgcaaataataatatatatctcaaaaggttttgtaagctttattcctgaattatacacatataaaatgattgggcatagcctactgattctgtttacaggaattgtttacctttacttccctcttcaattgtgttactgagagaaatagtaacctaataaatctgattaataatgctgagataaaagcatctctttatcactcagattttagcctctttagtttacattggtttgattaggccactgctattgctttggttatcagattgttttatatgtaagatctttttaggtacagtagctacatataagctactttaagactaaaatggttgacattttaaaggaaacaaaataggtaaatccgccatgtccccttgaatatgtgaaaaatacagaaattgatagaaaaaaataccac

SEQ ID NO: 112106 - DNA, 1037 bp, Homo sapiens
caaatgttttaacattaaaagatagacatcatatctcctactctcttccccaatggaaacagttccagctatttctaagtcataggctcaaaacttaggatttaaagaactttaaggagtattccagcagtaatctgatttacagggtctaagctactttcaatttgaattccctacattgtctgatgcagtgccttgtaaataatgagcactgaataaatatttcttatgtgactgtaagactgagagagggtaaatgagatttgagtttattgtcattcagtaaatatttattgagaatctgttgtgtactagcagttgtcctagacatttagggatacaccagttaacaaaagagacaaaatctctgtcctcattagttttacattttgttgtcaaatacattcaataaagattaattctataatataaagtgttataaatgtcatgaagtgttatgtaattggataatggtatgagagagtgagggagtgggtgatgctggtattttagattgaggtggtcaaggaaggcctcatagagatgttacctcatagagatgaggtaagaattgatcaatgaactgaatgaagtgaggcagctcagacgtggatatttcagacaggagttgatatagtttagatgtttgtccctgcccaaatctcatcctgacatgtaatccccaatgttagaggtggggcctggttgggaggtatttagatcgtggggccatggggggtgggtgggcagatttctcatgaatggcttgggtcatccccttggtgataagtgagctcttgctctgggttcatacgaggtcaggttgtttaaaagtatgtgacacctccccacccactctttctctcccttgctcctgctttcaccatgtgatgtgcctactcccccttctccttctaagcttcctgagatctccccagaagccttccaatgccatgctttctataaagcctacagaaccatgagtcaattaaacctcttttctttatgaattacctagcctcagatatttctttaca

SEQ ID NO: 112107 - DNA, 1048 bp, Homo sapiens
aactaaagaatgaaagaaatgtgttccatcttattcccaacttcccctaccatggctgtaggttctcctctctatttctctctacttttatatctgggatggataggatgaaacctggaacagaaatctgaaaggccttcagttcagtctgactgctttggtttatgatctgtattttggtgcctcctagtaccctggggtctcttcctttttccgtaaagcagtcaccacccccattctccagttctgtctctgaagttgaccgtgttgggctagggcaagtggttgttttgagggtttttccctccaattcctttaccttctgtgagtttaagataacatttagattggtagccatattgagaaattaggtagacagggggcttatagtctgtcatcactgatgtagagcttttactactgcaagtatagttaagttgctgatgcatagaccatctgttacctttgtttcccaggtaatatgcacgtgtcactagctgaggccctggaggttcggggtggaccacttcaggaggaagaaatatgggctgtattaaatcaaagtgctgaaagtctccaagaattattcagaaaaggtaagctgctgctgctgctgctgttgttgttgttgtttcagtattgggtacttaaaaaacagatacagggtcagagattagatttttgtttcattattcctgtgcctttggcagagtatgaaaggaatactttccttatctcttttagggctgaaaaagctcagctattatctacattcatttgaatatcttctatgtgcccaatattacaccaggcagcaaaagtgtaatggtgattgaaaccgaaacagttcttctcagtttagagctcacagttcaatgtggaaaatagctattaacaaaatatttgggccaggtgcggtggcttacacctctgttcccagcactttgggaggctgaggttggggtgtcacttgaggtcaggcggttgagaccagcctggtgaacatgatgaaaccccatctctactaaaaatacaaaatttagccggt

SEQ ID NO: 112108 - DNA, 1083 bp, Homo sapiens
atgattatatgtccattaaaaacaaaatacaacttaataaaaaaggagagatacatatagttcttaacagagtaattatcagtttactgaccttggttgtcctggtaagtgaataaatctctacattttagagtgataaggaattatgaattgctttcaccttcagcagttctgattggtgctaccatgctgaggaggggagagggtcagtctgtatccagggatgaaaaggaagaatgtagcaagccttttctggtctgggtggataccagaatccacagtgacaggacagggacagggcatagcatttaggcttctaggtggcattcaggcctctgtgttagctgtgatccgcaatcatttataaatttgaaatggtaacagttacactcaaaatcataattttgcctccaaaagaaagacaatctggaattagccatgacagttagaatcccagcttcctaacttagattcgggacttaggtactggagaactggacagaaagtctagtaagtagaattaattaaaatagtgggatggagattggcagtagtgagcgaaagaagtgttagagggatgttacagcaccatacatgcatcagtccccaagagaagaggaagaatctggaaaaaaataaaaaaccgagaaggcgcagtctttgtgtttgagtaccctagggctcagtccttggtcttcatttcttttctatcttaattctttttttttttttttttggtgacctcatcaagtcacatggctttaaataccatctagtaggccagcaactcccaaaatatatctgcagttgtgatctttatcccacatttcagatcaaattgcctaattgacatccccattcaaatgtataacagatatcttaaatgtaataggttccaaagttctaattcctgccaccacctcctaacccccacctcagcagcctgcactattttagacaatctctgttgatggcactctgtccttttaattactcagatcaaaactttgatgtcatccagagtcctctttttctgtcactccacatccagtctgtcaggaaattctgttgtcactacctctg

SEQ ID NO: 112109 - DNA, 1083 bp, Homo sapiens
ctttatatttatgggcaatgtccttgagagagaaaccacacctttcaccaatttcttaaaggaatgcataattcaaaaaacattaaagagctactaatccttatccatatctatatgtcacgttgataaaacatttgaaccaagtttaattcttaagaacaatgaaagggctctatttctagtttctaggatctaccatccagattttgaaagattaagccaaatcaaggcattgttgttaataatgctacctgttgtatttgtatgaaacccaatctttttgtagcatgttgatttggtatatgttaactacttattaacatctatacaaataggctgcattatccattgaagtgattgctgtttcctgtgattataattttaagcaattttcttctttttttttattttttattttggtgcaattacaaaccagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaaggtaactgttaaatttttttgtttgtttttttatttgggtggggataggtcaaataaagacaatgggctaccatgtttcaaccctctgaaaaatctattgagttttaaatgaccgtgtattccaagaagttcagttattttatttaagaatccaaaatagttttataaagatttatggatctgagaaatatatgaaaaaaattaaccattagaagcacatgtttacaaatacttattaaatacctgctttgtataaaacaccgtgcctgaggaagatatagaaataactggaaagttgaccctgattaacatgtacagaacaatctgtaacagcaatcctcatcctttttggcaccagggactggtttcatggaagacagtttttccaaggatggggtggtgggggaatggttttagcaagaaactgttccactcagatcatcaggcattagattctcataagaagcat

SEQ ID NO: 112110 - DNA, 1484 bp, Homo sapiens
tgaaacacttggtaaaactggttctgggaaatctttctggggtaagctacagttacaatagtaaatatagtcatattttaaaatttagtagatatcacaaaattttctttaaggatactatataggtagcattttctcaatgaagactagaaatggaaaattgaatttcttcttctaatataaattgtttatttgaaacaatacttaaaatttagaagctcattgcaataagtctagattttgtgagaattattcccaaaaatatcatagaatgatagcatgtttgagctgaaagtgtctcctcttgttttctttcttagatcttttcccaaggagcttttagcaaatgcttctattgtgaacacctagaaaaaatgtattaacatgaaaatgggttttagaaatatttaaatgtactttctgttgctttatacctgtttcgtgaccactcatttgtctggatcttctaggtatttcccaaaccttctccactttcccttcttctcggaacactgctacctagtgtatccagggaatccatgcttgtatccctgccagatttccccaagacctggactcttctagtttttctcttgttttggatatgaagaatcccaagaataaccaatgctatatattacctgaaagtcccacctctgttctgcatttctaaggctgtattttatcttgtttgccctatctgatctggatctatactttatctgctcttatccttagggttgtagtcctggagtgttggtccctcttccttgcacaggttacaaatttaccactgccacacagtgttcttgttgacttcctcagaattcctcatcggtaggggtttagttcccatcttaaccaggatgtcagatggctgccaggaatgtattcaaattctgcacagtttttcagttgataacaaacaggcccacagatcttctagacaaatggtttgtaaactctccctcaagaaacctttgcggttctatagtgaagggaaatgtaggaagtagaggccgaataaatggagttcttggttgcccattttccctctttaactagagcagctccagttttatttgatctgtttatatttctgcgtgtgatttttttgaacaaaggtaaagctattaaaaaatctttgaaaaccatctgtccagaccaaagtttctcatattgttttcaatatttttgttttaaaaattcctctatgaccaaataagcttgagaagaaactatttaaaggaaattaaatgtattttcactggagaacttcttagaacctttaatatactagactatattactaaccttcaagaagaataggcatgtaaataaagcatttcccaaactttcttggtcttggaggtctttttttcagacattctcataagactaatattctttaaaacttcactttatggataaggaaactgatacccaaacaactatgggatttgagtttcctattagacagtcca

SEQ ID NO: 112111 - DNA, 1057 bp, Homo sapiens
ccccagtatattccttaaagcttttgttgcctccagtagctgacagaatgagttagtctttcactggtgtgaaattcattctgagtgaccatcattcttacttaacattaattagcgtgagtaaaagtcagcaagccagcttacttgtctaggtttttccactgatttaatgttataatatttggaccacaattttacttatctgcaaaataggaataataataatatgtgtcaatcatccatattattaaactgttgtaaaagtagttatttccacattaatgagctgctttgtggtccttagaagtttctttgctatttctccctttatttataatatgaggataatattgtctaccatatgaggttgtttgaggattaaatagcacaaagtgtgtgcctagcatatagtaactgttcaataaacaacagttattaatagtaactaacttcaatgcaggaattttcaaagatgtgggatgttagtaatactgtcttttcagtcactgacagtacagtgtaatctggactaacatcatttatgcaacttaactgataacatgatttcagaaatacttccatttacaagtcttcttataggtagaaaacataatgcttgagccttgaatataccaccttagatgggtttttaatccatacttcagcaaaattcactaatggagcaatattaaaacatttctgtggtatgtgcgagtttgtgtgtgtgtaaacaaatatgtatgcatgcttttggtgctagatttaagtaatttctcttcaccattctctcttcttccatttatattgacatttctcctctatttggccacctgaataaaacagtggtctgtccagttttttatcccttatagtgtggagtttgacctaatttgacatactttatttcaagcagataccctttgctaaagctattaaactttaagattacattttgttttaaagggaacttaaaagagcattgatttaaatttgttatccctcagagcgtccatttaaagacttagcatttctcggccaggcatagtggatcacgcct

SEQ ID NO: 112112 - DNA, 1098 bp, Homo sapiens
aaagttatgcaaacatagtatctctttcctcttccactatgaccatcatcaccatcccatttcacctctgatcttccatttggagcatttaggaaattgccaccactttcattgtcaatagtggattacatttccatttattttctaaaaattgtgtgcatacatgatagattcttatcattccaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaaggttagtaattctgtgcatgtttgagaaagaattgaagtattttaaatatttttttgaaataaagaagggttattaaattattccacaagtcttattttcactgccaaatttttgtaccctggttagtctcttacttctctgtcaatttctgttctcccttccatcaaaaccctaattgaaatactctgcttccacaaagtcatccctaataaaaatgcccagtcacgttatagtctctcgatatttgggatagtatatttttagattgtaagcttctcaaaggcaggaggcatattttctacttctttttgcttaaattctccaccataccgtctaccatgcactatctca

SEQ ID NO: 112113 - DNA, 1086 bp, Homo sapiens
tttgccaaaggagatacataattcataattcataacagagccatattttgaatcccagtctctagagcccaattataagattcttccactctgctgtcctgatttaaagaagagaccagatacatgtcagatacatggttgaaaagatgttgttactgcctgggacattggacattcaactaactgccttccaagtcccttaagtctctccttaaaaaaattatataatttttaatacagtgaaacaagatagtattaggaaaggctaaaatgaggcacttttggttttttctgtattaaaccataaggtgcaggggttaaggtggaactccattatgttatctattgtggtagatagtattttggtggggttctactatggtcgaatctttaaggcagctaatcctatgactgaccagataggccataaattatcaaaaagcagtgattggcattgagtggtctgatttctttgggaacaaaatgagataggaacaaaaaagatctcaagaaagaaattgtagttgaaattgaaaaattataaatagaagattattactgcgattattaagttaacttttcagatagttctctacatacgtaaagcagtagggaaggggcaggaagaaacataacttaggtttctcttgtagaaactagttttaaaatttgatgttgcccttttttgcttcattcttttaattctacttttttttcacctcagcacaggactatctaattctcctcttttttctcagtattttattttctacctcttcaactccatcccaagatctgagtagttgtctgttttctaataggagtatctgacaaatgtctctttctgtctttcttgtaatgtgattaccatacacgccctatccattgctctgtgggttggcagtagattcctgattatgagagattgacttggaaccagtactgtgagtacagagtgagcagtactcccacaccctgggtggggatcattaatagcatttggcttccaacagttgcaactcctctgcattctgcacaatactagaaaggaaagtatgaagaacagatacaactaatttctacaaa

SEQ ID NO: 112114 - DNA, 1138 bp, Homo sapiens
ctaccctacatcttcatggctacatgaaagctttcatgtactttttgctgacttttatcaacattgttcatgtcagaatttctttaatcttctcaagccttagccaaacaggctcccaagaggtgattgactttttatttccaggcaacattatgatatgaatatcttgggattgcctctgtattttcaccttttcccttgtctgttagttacctcttttaagaaggtacgatttttcctccttgccagtctactcgtcccacatgtgttcttttttccatctcctgtttccttcaaaacattttttttaatcagtttttcccactaccatttgcaacttcagtctctcccactcaacgggcttattatccaccacctgaaatcaagcacagacattcttctgtgggggggaaaatctatttttttaacctctttttgcttcccaaatcctcaaaattcttgaaagaatactggatactcattctctcaaattcttaccatctagtccttctttaaccctctctgatttggcctctgacctgttcatgcaatgaaaatagttgtcttaaaggtcaccaatgacctttatataccacttatatacatttattcactcagaaaatattcattttgtgcttgctatgtaccaggtacttgctagactaggtactagaagtacatctaaaaaagacaacattctttttctcagagaacttataatttagttgaggaaacaaacaagtagagaactacaaagtagtgtaagagttgcaattaagcatgaggcaacgtgaaagtaagaggagcaatgtctaactcagcctttatgtggtcatagaagcttttagatagaggcttcctttaaaggttaaggaaaaaaaagatattcaggtaaagaagaaggggaagagcggtgtttctaacagaaggtatccttcagaaaggaagctaaaagttaatatgcttttgattatctgcaaatttagtaacacaggtacagaattcgtttagggaagtggatggagataaggcttttacctgaattgagtttttaaatttatatttaaattgttgtgtttgtgtgtatgtgtgtgtgtatatacgtgtgtgtgtatatatgtgtatatataggagatgg

SEQ ID NO: 112115 - DNA, 1033 bp, Homo sapiens
atagagactatacacaggagttattagtcaaatataaattaaaaggatctcctgccttccacatgatgggctggcagcctggcagagcttactgtgtggagaactcacagtatacttaaagcctgatgtttctaaataaaattgatctaagaggaagcaaggggctagaagctgtgctgctggagcagcatccttcacaacgttcatcctaaactagagtgatatgaggcccttgaatgtcacacttctcaagcttgctgatcagttcagtcattttatctcactgaatagaaaagaaagactgatgcatttcttctaaaactcattcctcagagagagaggtagaaatagaagtacttcatctcttagccaaagcaagaactttaagatagaaggaaaagggtttactccaataaaaggcaaacaattgcttatgaaaacattcttttatctaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtaagcatccaagattacaaatgataagctttgtatcttttccaagtaagcaagaagtgttagaggacacatatctaagagttcaagtgccagtaactgatactgtgcataatctcatctcattgctggctaaaattatggtattttaattctcattttgtaaaagagggaaatgaggctcaaagaggaaatgtaatgttcccagagatatggggcagatatgatttgaacccatgtctatctggctgttaatcctatgcttttatcttattccatactcaaaatcaaaatacattatacagaagaaacaaatgaatttggtgaatggcttgatatgagaggcaagttcatactgattctagaattgtttgttttgctttttctcaaaaggcttaaaattcaattacatcctttaaaaatggtct

SEQ ID NO: 112116 - DNA, 1062 bp, Homo sapiens
ttcctgccaaagtttggtccacattttctttaaggatggagaaacctattgggtgtaaaggcatttccttctgaagactttattttgcttctttgattacaggctactcgtaaagtaaatgaaaatagaatagcattatttgctctaataaaaactatattttgaggtaaagatgattatggaaatttttttttttaatgtagtatcgctctgttgctcaggctggagtgcagtggcgcgatctcagctcactgcaagctctacctcccgggttcacgccattctcctgcctcagcctcccaagtagctgggactacaggcgcctgccaccacgcccagctaattttttgtatttttagtagagatggggtttcaccgtgttagccaggatgatctcgatctcctgacctcatgatccgcccacctcagcctcccaaagtgctgggattacaggcgtgagccactgcgcccagcctgattatgggaatttttaacaaaggtgtatttttaaaagtctttgttttttaaggtcttgttataacttggtgcccacttccacttcagagagagatcattgaattttcctagtgacaatgaggcatgtttctttaaacttcattctgatgcatgaatattaaaaacctttaatgttttcctacctctttatgcctgagagaaaatatcaattattaatcttcctaggaagtagaagataaatgaaacaatccaagaatctaagtcagtaatcatttgatattttctttcttccttctcccctccctccctcctcctctgtctcctcttcctcctcctcctcctttttcttcatcttcatcatcatcatcatcatcatcatcatcacctggcacccttgagggagacattttctttataaaaggaagttttcccagttgttgtatgtagcagtcaaacttagttctgtgtagaatgcaacaacatagaattgctgctttccagagggcatcaaagggagtgccttgtgatgtgggtcactaactgcatgaaaaactaaatcatttgaaatcctttgctcctattctt

SEQ ID NO: 112117 - DNA, 1046 bp, Homo sapiens
agatgaagcaggaaatgttgagtaggctgcaactaagagaaagctaaagagatgaaaatatgttatgaaaaccagatcttcaaccctcctttttaaaaccctgattgccacactttgaaagctacctacttatgctggcaatcaaaatgattaaaaactgcatgctgcttatttattaacataattattctcataaaagtactgtggcgttaccatcatgtaaagcaatcctatttccttgtagagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataagtaagaacatattaactaacccaattacatatttgtaaattctacatttcatacgtttctttttgttatgacattttattattttcaccatatttttttacattaacacttccctcctaccttccttttccctcttcagttcaaagtctgttgcgagtttaaatagaagtcctgaaaggaggaaacatgaatcagactcctcatccattgaagaccctgggcaagcatatgttctaggtcagcaaaaacaagcttaccttctttgtcccatacctcatgctcagagggaagtgaacaagatcatcttaattatcaaattattttgggttccatgtcctaattgccaaaactgaatataaattttaggctacttaaaatgcacca

SEQ ID NO: 112118 - DNA, 1024 bp, Homo sapiens
tattgttctattgatttttatgagcttatcagaagaaatcacttcgatatctagcatctgaccatcttatgaaatgtctaatatttaatttatgccacaggaatgactatgcatagttctggaaactcttcatcccaagtacccttaaaagaaaatggtaggtttacaaaatgtttttcccctcatttccatcatttcttgtaccttactgagatagtcttggacctaacaatgaagagtcttgagttccatgcctaggatttgatcttacattgaagttaaaggagagttgtatttttcagcatcataatgatgtaatgggacctctgatttaggctaatgttgatgaaatgacaaattagagataaggacactaattgggaagctaagataatagttcaggtgggagataatttctattaaaaagagttttaactgaggcagttattttaaagggatgctggagctgaattttagagggaaaggaggattcattcagacggaacaataaagataagcattccagatcaagggcatagcatggtcagagacatggaatcatgagaaaagaaatttagggaactgcaggagtctcagtatggtggcatgtgggggccagggtaaagtttgagaactaagtagggaccagtttttaatcttatgctaaatattatgaggatattttgaagactttaaatgctgagattatagtttagaaggaatctaagaaacaaaatcgtaggcagaagaccagaaatgtccagtgacttgaacatcactggctttaaaatttttagaatttagattgcaaagtattttcatatacattatcttatttgatctttctaacaactttcatgagtagaaaataatgttttattactatccatacactactttcctccaaaaatgtttcagtcttggactcttaaagttgaaataattaaaagcctgatgagaaagaagccattatgttaattaaaattattaatacagctaaacttgatgaagttgtaaatttagt

SEQ ID NO: 112119 - DNA, 1004 bp, Homo sapiens
ccagtttcctcttgctattttactcaagaacttactaagaatattttaccagttataaattaaaatgccaaccattaattagaaggaattttttaatatattaagcactgtcaaattcagggagttgattatggtgtaacaaacagaaaacctaaattgaaaagttcggctctttcctgtactagctgactaaacttgtgcaaatcatttaacctattgaggtttatttaatcatttgtaactgaaatatacttatttcaaaagaatagcttatgaagaataaatgtaatacgtagtcattttataaattataaatcactataaaaatataaaatgttaacagtatcagtaaacttaaaatatatgtttaagtgactgagcaattaacacactttgttaacatttaaattgttaaaacaagctgacagtcttaatgcctgagcatgttatatttatttttaaattataaattcccaatagatgtgctacacaaaagatggagcatagtatcttcaccagaaagggagatcaccttagtgaacctgaaaaaagatgcaaagtatggcttgggtaagtcaccgtgagattcttgaaggtctatgattgttggggattcagaggaaaagtctatagcatagcattggcattgcagtgccagctcacttctggtctcaagatactgactggctgcccacctacaagcccatcaacctacccgcccagtcaccaaatgcctaataagaaatgcctacaagaaatacttccacaaaatttaatatgtgttacctactaatcatttgatatcaatagtccccacatttctgtgtttcaggcaggctaatcattagtctttgaaagcagcaatatgaaaatctttttaaaatgtgttattttacaggatttcaaattattggtggggagaagatgggaagactggacctaggcatatttatcagttcagttgcccctggaggaccagctgacttggatggatgcttgaagcc

SEQ ID NO: 112120 - DNA, 1050 bp, Homo sapiens
tggatctcactgtattgcccaggctggtctcaaactcctgggttcaagcaaccctcctacttcggcctcccaaagtactggggtttataggcatgagccactgtgcctgaccatagtgtcttttaaaacacacaagtttgatgcataattccattttcagaatcctactttcagaactctccttcctaatcaaacagcttagttcatgcagttagttgataagatttcttaatgatggaaatagactgtaagatacagcttcagtataccattggagtgcagtaagtacatacagagctataaatacgggaaaatgggcttttaaaatgtgtctagaagtatatatgtttgtatgttcctatgtaaacacagcatgttaataatatctaaattttttttatatctttttctccagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggtgagcccctagcatgtggagtatagcatttttaatgatgagatggattggcctttcagaatggtttcataatgctggtttaactgtaccttcatttgtcattcatggtacccccaggaagtcatatctgctctcaggggaactgctccagaagtattcttgcttctctgcagacctccacctggtgtgctaccggaaattgatactgcgcttttggtgagacttatgaaaagtaatttacagttttatagaatatcaacttagcaactaactaattcagctgtggtggtttcatcatgaattgttctcctgggtttcatacctagctacttgttttaggtaggcatgttatcttgtatgtgacaacttctttgaatgtattccatatttatataataatacaaagtaatttattcaatt

SEQ ID NO: 112121 - DNA, 1050 bp, Homo sapiens
aatatataatactactgtagttctaacttaaggtataaattgtacaatattaactgttattttatatattattttctctattgaacataaattacttttatcatcagaaaattcaatgcatactttagtagaaagttgttcaatggtttattttcaaataaatgcttctaaaattcatagaatggtcacaaatctctttaaatgtgtccattacagaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacaggtatcatcaatataatgtgaaccgctcaaagcaactggttgttgttagtagcagtagcagcaacatgcatttctcttaagaatgaaatgtatgtatctgtgaccttcacagtggttaggcagaggatgactctattggatgtctagctattgtgactgatagttttagttagcaaaccaataagctctctagtcagtcagcctgagtctttcttccctcttgagcatatttactagtaactgagaaagttatttgtatttcactgttaatcatactacttaaacagaaacagaatagacttatttaggcagtaacacagtgggagactagggaccagaaatatagaggggagataagggcagagagtttgcaaaaggtaagacaaagaagatggggaaaagaagaaatgattgaaaacatagaagcatacaaagagaaggactacatcaatacattgcataattattca

SEQ ID NO: 112122 - DNA, 1033 bp, Homo sapiens
tattttcttggcaatttagcttctcttttctaaaaattgtgatcttcacatgcccctttcttgtttttgtaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtaatgaaaagtcaaactttgtacaatatgattttcttggttagcttaagagtaagtacttttatgactgagaaaacaaatattttctattatttcaaggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaaggtactctgcaattatttatgagttttgattgtgcgtgtgtgtgcatttcaggtcattgattatacttcattctctgaaaatatattactgaattagtaattcatagactaaattggcaggacttaataaatttaaaacagacttcttgataggcgattttgagaacactaagtgaataatagaatggttaccacatttatcagttaggatgttttcacttgcaagtaatagaaaataaaactcaacttttgtttaacaagaaagggaatttattgggagtttttttgttttgttttgttttcttttcttttttagacagtttcactcttgttgcccaggctggagtgcggtggtgcaatcttggctcactgcaacctccgcctcccagattcaagcagatctcctgcctcagcctcccaggtagctgggattacaggcacccgccaccacgccaggctaatttttgtatttttaataga

SEQ ID NO: 112123 - DNA, 1461 bp, Homo sapiens
aaaaatattagaggtttggaatcaaatattattccatttatttggtttttaatcattttgtaatatgaattatttttgtgtactaataaaaataacaacatcccagaaatgtgagttttctttaattattttgatgtccctcttgtggtttggattggctcatccccttacttcctatattgtcctttcaggttcctacagtgtggggtcttgcagccagcctgccctcactcctaatgattcattctccacggtaagaaaaagcccaccctctttcatgtcatacctccttatctgaggaactgcatgtttgtgttttgaaccaaactgatttcatatttaaatatttgtcttctttagatattcatattaatagtaaggctatattttactgaactaataggccttgctaagtaaatcatacaacatagagcctcacataggtaaccgtacatcatttagcacacactcagcttttaaatacactaaccagttaaatagataactttagtgcggagatttttcttattaatgtgtaaaattcttttgattgtctcttagaccatgggaagagaagaataatataattaagagtggaattgttcctttgggctatttttggcgagtagtaaccttcaagttcaaatctgtgcaatcagtgaggaaaaaacagaagtagcaaaaaaataaataaataaaaagtaggtttacttgcttttgaaagacttagaaaatgctttaccaaatgattaaatgagagagctttaatcatttaagattagcacagagaaatctaggggtgactaaacaaaactaatacatagttaaattccatttcatgctctttttaagtctacttttatgcccatttggctaacatccctttttgtggttttcttcctggtatgtaatatacatttctacagtgatcagagctagatcttcatttcatggaattgttttattccacatgcatcccatacaatatgttctgaacttcaatatggaatggctttccatgtaaaatacagcgctgagggattgctcttttattaatccgaaagtcttattatgtcaacatgagctggctttagtgtgggaggagaaaaataatttcatgaccagaattccaaaattctacacctttcatttcattatgttgtctcacacttgtgatttggtctagcaagccatgaaaagataattacagcagaacattttaaggtagtaatgattgagacacaaaagcaaaaattttttgttatttgtatgtgttgaaattgagctacagcaacactcactattctctgtttattcagaatgtcttcaatttcacatagccaaagcaactgaattttcatgtatttctagtaatattcacactgtatagtgctcttctttttaagtaatcagtatgttgttgaaagaaagaagagttgagtttttgtgaaattaacataa

SEQ ID NO: 112124 - DNA, 1067 bp, Homo sapiens
ttgaagatattcaggtaagtgaatgaaatctttccctgttggaaggtgtatctcctagttgtaatccaagcctggactctttccgtgattgcaccaatgttatttctagataaaagacagtgacttcctagttcccatgcaatggaactaatgctagctattttttctttatgtaatataagtttaaatgtgactgtcttcatgaattctgccagtttcctccagtatgtcctctactaaaatggaaatgaaaatgcaggacttttaatgtgattatcatccttggtgatagcacaaaatggctcagaagttgcatgttggaaacttgtgtttttatggtcagacctctaagtagactcattgaaactacttttaaaatctttaagtagaaaatattccctcataaaggcaacttaacatatttaggaatacatggataattttagcataaacagttgttattcagatcattcatactgcagttacctaaccactggatcaatctagcttgaattagataagtggcaatacctgaagtaaagctgctactgtttcctcactctgtgttctccctcaccttactacacgcctgtgcacagtatcctagctagatgtgagtaatgtttcccatagaaatttagctatcttaaggaaacagtgattttacttttatagaaacaaagcatatcaattcagttctattggtgtcatgtaaatgtagcctgagaatttctctcataatttttgattcatgattttttattgatttacactagcttacctattacttaggctagcacagttgttcaatattcttccagtgatttatccacttaatccacacatttttatagaactcaacccctttatagagatttggcagtcaacaacacagacaaaaaatatttctaacctcatggagcttacattctgaagaggaaataccagtattgatagtgctgtggaaaaaaatagagaaggacaattggctgggggagaatgagaagtatgtcgtaattttcaacaaggagtcagggaaggtatgagaaaatggcatttgaggaaaa

SEQ ID NO: 112125 - DNA, 1027 bp, Homo sapiens
cacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaggaactcttctaggtgcctggagcacatcagtgaataaaacaaagatccttgctagaataacaaagatattcttgcaggatactgataaggatggaagaccatagacatgttaaacatgtaaattatataggatccctgaaagtggtaagtgctttagagaaaagaaaaatgaaataggtaaagggaatcagtcatggcagattgggggtacgattttaaacagggcggcaccattggcgaagtaacacttaagcaaagatttgaaggcaaaggagagggtcatgtagatctctggggacaagagcctttcaggcagagggaccacctgtgtggaagtccaagggtcttgagtgttcaggtatggtcacagccaatgtggcgggcagggcacgagagaaggaagagtgaaggaggaggtgaggttagaggggaggtgacagggtccaggactttggcttttctctgagtgaaatgggagcctggagtggcagtgatctgactcacattttaaaggactactaacctgctgtgttaaaatgacaccaagtctggggaggaaggtgtagtgttataagcaaagagatcaattaggtgacaagcaggggtggctacagctggagtggtaagtgtggacagagtgaaagaaacaggacgtgatgtgaagtagatttgctaatgggttgtatgtggtgtcagagaaagagtcaaggatgaatgtgtggaaaagttaaaatacagataagcaaaaaagaaacttaaaaggccacttgtattcctactgt

SEQ ID NO: 112126 - DNA, 1010 bp, Homo sapiens
cttgaccctgagcttaatctcgccgtaaagtgaaagggttcttgcgcccccacagcagcccggggcagggtcaccctcgcgaccggggcggtcattgccgtattccgtcctgagctgccgctcccccacgatcctcccaccaatcccgggagggccgcgacgtcccttgccgcttgggtggcgccagctagagggcgcgggccggggcggaacccggtaccgcagctcgggaggtgggggtgggggcggggcctcgcgcggagggcgtggcctcggggcgtcccgggcagccggcgtgctgagcttgccagccagctagcgagcgacgggcgcgcgcggcccctgcgcactcggccgccgcctgcgcgcgttgcggccgcagctgcacctttgcctccgcggttccgcagccgagccccgggaggaggcgctcccctgcgtcgtccgcacttgcgccctttcccaccgcaacaggtcaggggagggcggaggtgacgagggcgcccgacccgggactagaggacggaagggtctggaaggtgagcgcagccctgcgccacccagggctgggggtcgatccgcccggcccccgacgccgccgccgcggacttctcggaagccgaggctctccccgcctctctgccggcttcccagcacgctgactcaagtcgctggcgttcccacttttccggtgggagccctcggggagaacgggctagggctcagagctctcaccgccctacttgcgatcccgcggcaggtagcgcgtagaaaaacaggggacggggacatgggaagagacccatgctcctccctcacgcgcagcccccaagtcagacgtttgcctgtgcaccccgcgttttgcggagagctgtcccgttgttgggacctgctacttgagttgcgtaatgagtcccagaagtttctcggggggagggggcggggaaaagtggggttcttctctcctgcaccccgggacccttccctgtgcctgtcgtggagagagatga

SEQ ID NO: 112127 - DNA, 1026 bp, Homo sapiens
tagcacatgcctgtaatcctagctactcgggaggctgaggcaggagaattgctttgggggtggaggttgcagtgagccaagattgtgccattgcactccagcgtgggcaatagagcaagactctgtctcataaataaataaataaataaataaataaaataaaaaatagccaggcatggtgttgcatgcctgtggtcccagctacccaggagactgaggtgggaagattgcttgagccttgacctaggctgtggtgagctgagatcctgccactgtactctagcctgggcaacagagcaagaccctgtctcgaaaaagataatctgaaacaaaaagacaattgatgcctctgcttgtaaaaatatgcacaaataccacagacccatggagaaattgtctccgaacacctttccaatcctccgttttttttttttccttataaattggagtgagcaatatagcaatatcttctttattgagtagttgaacagagtaaaggtactaagatttggcaagttcttggagcagagcatagtaagtgctacataaatgtttgctattattactcctgaaggaagagattgtgttctcagtctttttttcttttttatggtaaatattgtctcataagatgaagtaattggtttactttgaataaatggcaaactttgagtttgttccaagaaacttttgtaagggtccaaattctgaaatgaggacaatgccttgtacgatattttaccagcccacagggaatgaggtagagacattttctaccaatatccatgtgcttttctgtgtttcctagcttctttatggttacacagaatcaggtgactcatctgtccagataagcagtgagtcacagataagcaataaacatttatttatttagcataagttaactccagatagtaagtagtaagtactatgaaaaaatagaagtgtggccagcactgctattttcctactcagtagccattcctgtttgttcttgttgtcactaaaagaactttaattgctaag

SEQ ID NO: 112128 - DNA, 1045 bp, Homo sapiens
ggccttgctgtgttacccaggctggagggcagtggtgcaatttcagctcactgcaacctacatcacccccaccccccacccacccccacctgcatccctactcaagcagtcctcccacctcagcctcttaagtagagtagctgggaacacaggcatgcacctccacacctggctatttatttttatatttagcagagacgggtcttgtcatgttgcccaggctggtcttgaactcctgagctcaagcattcagccaaccctggcctcccaaagtgctgggattacaggtgcacacccggcccactctctttattcttagtacctggcttacagcagatgctcaggatacatttgttggttctgtcagtcagtcaacaaacaagtgaactcaggacccctctcagattgatagccacccaacagcccaacctgtctccttttctcctgttatcactctccaccaaagagccctaggggtgggtgctattgggttgcaagcaggttgagcatcttcactgggagggtaatgtggggaactgccatcagggactcttcagatgcctctacagaagtgttatgaagaataatgccaacaggaatacaatagtgttttattgatcacttactgtgtgccagccctgcaagtcaagagagagaaagtgtgagcagcaaaggcaggggtagagctagcgatgcagagaaagagaaaaaggagaaagtgagcgatagtaagtggtgagggaagggaagggagactagtggggattgagttggagaattgagaaaacttgcctagggggccactattgctggtcagaagagtgacacatgtttgaccctgaaaagtagatctctgctagtgtgagtttaactagaatattttaacatccatgctgcaatcttttgagagaggagaaagagtggcaaattatgtctgctagtatggaaacatgtagttagcaagtcagcaatttaaatttcatggagagggagataaaagaccttatcgggagtaagaatagagctgtgaaggactatattcagt

SEQ ID NO: 112129 - DNA, 1067 bp, Homo sapiens
ggcaggctggccccgaattcctaacctcaggtgatccacctgccttggcctcccaaagtgctgggattacaggcgtgagccgctgtgcccagccataatttctatttataatagaattcttttcccacttcttgctactgcatttcactagtctaaaaaataaaaacattataagaaatgtagactcagacttatttataatgcaacagaatagatgatggtgcctgcaattgtggaccatcccaaatgttctcctacttctccccctttctggttcatttaggaaattattcaattcctggtcatcattgtgggctgctaaacttggtttactctctcccctcaccaaagggaagacagttagttgaccctggctgctgcagttcacattctgctagagcctgggggaaagctgttgtcatttgtctttaggtttattcataatgttgggtttacacatacgttttacatttttatgtagttaaatgtcttgtcctttatgggttctggcttgattgtgcttagaaaggtctttcctcctccaagattgtgaaaataatgtcatgtgttctttgctggcacttgtacgatttcatttttgcatttaaatcagaacttgtaagctggtggactgtgggacagatctggtcaacatatgggttttggttagcctgtcacggaattctgaaagaaattatctgccagtgttttttacataacaatcttctatcttctcatgaaaaatgtaagatttagcaaccctgggcttgcattgtcatatagcaatgctcagaaagaattgaatagcttcggctcttttaagcggaacacaggctttctaattcagaacttcccaattggtgtgccatcaaatgcttttcaggtgtgccacgatgttgattccccgccccccagcctaaaggtcagccagagctcctatctaatttcctcctgcagacatcatctgctttgtccgtttgccccagagacttgatgtcacaaaaaaaaaaaattgagaaagcactgacgcttttcaattcgttacagttctctgcacagccagattc

SEQ ID NO: 112130 - DNA, 1033 bp, Homo sapiens
taatagcctattttattttatgattatttgtgcccttgcaagctttgtctttaaaatgacaataaaagtggaaaaaccaataagcattatttacattgttttgattgagaaggaaaatcgtgtctaggattttatttctcctccagcgtcaactcaaataccacttgaacagaatgttcatattgattaggactaatgaactatcattaactgaataaattgttcaaacgccaaattttaaattgcttcatctttgaatagtgcttttgctttgcttggactttctaatttctttttccttattgaaagagagaatgtgcctttttgccatttcactaacatgttccccttcttactcttttgtatcaactgcttgaaatgtctcattttctccttggaatcttgaaactaaaattaatttttacaaagtgtgtgctaaattacattcttctgaaattgggcccaggtaactgaagccagagagtaaagttgggatatattctgggaaattttttacttgaggacagggggaaaacatgttaaaataaaccataagaatgaagtaaatgtcatttcaggctataccaccaaatgggtgggacatgattttatcgtcttctgccattcagagtgggtactgaagtgttttaggagatttgctgagatgcttttcagtttttgggaagatttgagggattggattttgttaaccttgcatcatataggatggaatactgtagcccctggaagctctccttttcgagtttgaattgatgtttaactctcctaattgagaagaattctcaattattgaggaagctacaaggtgttcaacagattaacacctattatatggacagatcttctttgtgcaagtaaatcaagggccaaacttctagatgcttactagagagtttaatggctgtaggccatgttttcctgaaatagtgattggcctgggcattgtaaatagtgcacacctggaattgtgaaatgaggaaataaggtttcctgcattttcaagtgaactagt

SEQ ID NO: 112131 - DNA, 2488 bp, Homo sapiens
taacttgtttcgatatagcagtagttctcaacggaggacaattttgtctccctctcttccaggggacatttgacaatgtctagagagatttttagtcatcacaatctagtgagtagaggccagggatgttattaaacatctacaatgcacagaacagcccccaccacaaataatttcctggtttctaatgtcaatagtgctgagattgagaaactgtcagcctatcccatgtatttcctgaagaatggaagttagcactaaaagcttggttagagtcaagataactctttttgcttaaaatagttaaattgcccaggagtgccggtattctgttttgatctgggtgttggttacaagagtatatcattttgtgaaaatttatatgtgagctctacactttaaaaaatgtgtgttatttttaattttaaaagtttacattaaaaaaagaaacctctttattgtgttgggtcccttcctctttttgtctgctacttcacacttcttaaatagttgaataaatctttaaagcctcactcccttttaaagttccttaatactcttttttttttttttttcccaatgtgagagactggtagagatgggggaaaaaatgggtgccttttgaactcattgttgggatggttgagtgtctgttagggaagtcagagtgctggtactttccttgctctgcagaaaattgcagagttgccctaagggagggacacctaaacgataagtaacgttaggccacttgggttttgtgtaaagctgaaaggagaaagtcattccagatgggatggtttgaaagcagaggttggctttcatgagctgtggaatttgggaaaggggcattctgggctgaaagaaccagggaaggtaaggaatgcattaggggtgtgctgggaaccttttcttgagcgatgtcttaaagccagcttctcttctctgtctctgataaataattggaaggaaaggcaatgaatttttttctgacagttggttctaactgggggccagggcctcgtttgcaaatgaaaggactgctgttggagtagttgaaatcacaatgggccctgactcttttcacatcaaagtgtaaaagaatctccaggggtgataaatgggggctgctggactcattacttgtaaacaaagctgagggatgacctctacatttttttttaattaaaggaaaacagggtttcctagtggtgagcatggggctgctcttcgtttgaattttgactgttcacactggaaaagatctttctttaaggttacaagggagctgccgctgttacccaggatttaccctgaatctcaaacactactggaaaaatgctgtgcctaggacggcccagcaggtatcctgcatgtgttgagaattgaagtgcagtgggttccgctgcgttgttacagtaaagtggaacagggcagaatttctgagtgctgctcctctcaggagactgagggctcctttactccttttcccacccgacatcaggaggaaaactcctttattcctgtgcagtgtagaaaaaggtccgtttttaagtaaattcttagctctttgtaaaagaagtccaaaggcagtggttttagagtttaaagatagtatttctttatatttgtgtagttacaaggctttgagtatgatcaaaacgtttaaccaaaactaaagtatgtgcatactttatggtgttgaaagcaatgctactaaaaatagtacaacattttatgggattaagattgcaaattgctgcctaaattcagcttgcagttaaggcctaccttcagtaaactctcgttgtgtagtcagctccccaccaagcttatctcttgctgtttttccacttggctcctctgttgcagtcagtccaagccctaccagattttaaacaactggaggtcagagactgccctttgtaacctgagtggaactggtaaggcactgggcacccaagaattctaatgtgtttactgactttccacatgtttagtaatcaccttctgagcctatcttccaagcaagttgtaagacttgagaaaggagcagaggtcacagctggcaaggagcacagcatccctggatggttgacagagacaagctatcctccagatgaaatatttccaactacagatgagagtattgaaggccttccattcccctttgatatcagaatggtgagaatgtgggagacaccaccagttaaccctgccttcatgagtacagatacccatgaaaatatttaataagcgcagtgaccagacgagacctgtgctaagtatttgataggcatgctttcaatctcgtaactccctatgaggttatgttttacagatgaaaaagggaaaaggaagatactcatcagtggctagcttccttccatcaccgaaccctcaagtccctgttccctttttgtctttgtagaagctggtggcagggatatactttctgagctctggtttaaaactctgagttttgggc

SEQ ID NO: 112132 - DNA, 1924 bp, Homo sapiens
gtggggagaagaggttcagaacatcaaatgctgttaaactgtggattcagtcacctcttccgtgaaacctcctctcttaccctcaggcagtaatggtctcccatttctcaaagatacaaccttttattatggcatttaaattgtttttgtttttatcttccttacaagattctgtcattggacagctgattatgagctagcagacacagtagaaattcaatcaattaatacattaaataatttatagaagaatgattattggcctctgccaccaagaaatggttatgtcttcttagtgatttgcctgctttttgtctccctggatttaggatgtagttttgaaaataacattgacgttccttcatagacgttcgtacagttttcagtattcacaatggcagaagtatgatatttcgactgtgccctatttttatgctgggcaaggacctcaagaacaaaactcctgtgaccttacataggggtcttacactgaaggagtatgggaaatagcaactcttgtaaaaataagctggtcagtgggtggtaggtaagctgagggaaaagatttatgagcaacatcctgttctgggatcactgctggggacggaagagggggagaaactgctatataaatcacgaaggcagctcaggaaataaagtctgccattggagggtctcagggggacccttcttggatatcttttgcataacacatgggtgaaggagaatcaacaggtgtcacttttctcagcccatgtggggggttggtgctgggttgggataattcatctttcataagggaaaaaaggagcagaagatgacagagtgagatggcacagtgggccccagagtcatctctagttttgtaattgcttgctggattgtgaagaaaaaaggagagagaaggggccattttgtaggagcagaagattgtgttcattggtcttaggtctcacgtggtagcctctccacggagcgcctccttgttccttcaggaatctgcatcagcttctgctcagttcaggatgtgtaggtgacatcctgtcttgaccagagggtgcatttggcttgagactttttttcttttcaaatgaaagacagttgagtccaggcgtggtggctcacgcctgtaatcccagcactttgggaggctgaggcaggcggatcatgaggtcaggagatcaagacccatcctggctaacatggtgaaaccttgtctctactaaaaacacaaaaaattagcttggcgtggtggcacgtgcctgtagtcccagctactcaggaggctgaggcaggagaattgcttgaacccaggaggcagaggttgcagtgagctgagattgtgccactgcactccagcctgggcaacagagcgagcttccatctcaaaaacagaacaaaacaaaaaacagttgaatcggtttatcaataggggattagattctatgttatgatgtacctacaaaatagaaatgaaatagttgttaaaaaaaaaaagggtaagataggcccggcgtggtggctcacgcctgtaatcccagcacttagggaggccgaggcaggcggatcacgaggtcgggagatcgagaccatcctggctaacacggtgaaaccccgtctctactaacaatacaaaaaatgagctgggcgccggggcgggtgcctatagtcccagctactcgggaggctgaggcggaagaatggcgtgaacccgggaggcggagcttgcagtgagccgagatagcaccactgcactctggcctgggcggaagagcgagactccgtctcaaaaaaaaaaaaaaaaaaggtaagatagtttatatgtgcatcaagattgcatgatatagtatacaaattacagaacagaatcaaagatatcttatttttgtgggtaggaagctagagctatatctacctagataaa

SEQ ID NO: 112133 - DNA, 1016 bp, Homo sapiens
tcacttggggcctgttgatcccaggctgtgctgtagggaggttcctttggcagccaactgtggagtggattagcattggcagagctggaggtggagagaccagtttggttggatcccatgcccgttaacacctgggtgctgcagccttttgtataagggggcaggatgagggtgaggtttcggtgtggtgtactatagacataatctgcagaattgcttggtagtttatgctgaattttacattgggcttctcaattctgcctcagttggtctcttaatttttttcccccttaaattactacaccccttacggtagagaaaaaaggaagtatgtaggttatggtatggccaaaattttttaatgtattgaatttggactggtgtagcaacttgtctttttccttatttatttctggaagcagattgatttggtaaagagaaaggaagtatccaaataacaggtctgctgatttcttacctagactcagcaaatgtttattatgaggacctgccttttccagagttaacgttttctttcttttcttttcttttttcctttctcttttctcttttcctttcttttttttcttttcttcctttcttcctttcctttttcctttcccttttcctttcccttttccttcatgccacagatacttattgaagatctgctgtcagatgatgccttaaaatctgatagatcaaagatgacctatgggagagaatacgagaatagaaaaatgggagtccctgttctgtttaacctggcagataagcacacagccagattgtgaaacaatgtgataaacgctctagcagaagagcaaataaagtgttaaaggatcatagaaaacagcaaagtgtcacggatgaaatctttctaatgagaaccctggtaattctttttcttttggggccctttgggtcatgccatcttacttggagcagtgctatggcagaattcaacttatttatttatttatttttgagatggtgctttcgcttctgttgcccag

SEQ ID NO: 112134 - DNA, 1362 bp, Homo sapiens
ctactgagtgacttacaggtgagtagtatctgtagtgtagatatactggacaaagggatgattcacgtcccaggtgggacggagaggacagcgagaaatttcatcacactacttagaattgtgtgcaatttaaaacttatgaattgcttatttgtggaattttccatttaatatttttagaccttggatgactgtgggtaactgaaaccatggaaagtgaaactgcagataaggggggcttctgtattgttttagagggagtgtgagcatgtgtgttaggagggggctggaattgcatttctgtggattctccaacctcacctttttccctcaccccctgcataattacctgttccttcacctgtgttcccatggtgtcttatctctgctgtggcgttttcctattgtattttatagtctgtgtttctcatactagactgggtcccctcagggtgttaaggactatgtgttactcatctttacatcccattgccaagaatagtacctaacactggcacatactgggcactcaataaatgtttgttgaattgctttgaaaggtttaccagggagttgccctaacataattctggagaaaggtcctcccatagaagagtctgggcacgttgctatgggagagtgttttctttgtttcacacaccaagtatttatcgagtgcctactgcacactgtgctgtgaggggatacatagatgagtcagacgtgtactctgccctgggttgtgttgacttaatcgtgggtggaaggaagatggtaaatggttgctgataggtttaatgagaaataagctatgatgtggtttagttgtatttgggcttttgtttagaagcataattatttcaatcaaagaatgttagaatttttttaaaatgatgtctcattgatggtagcttacttctcttacttctcattacattcacttttttttttttttttttttttttgagatggagtctcgctctgtcagctaggctggagtgcagtggcacaacctcggctcactgcaacctccacctcctgggttcaagcgattctcctgcctcagcctcccgaagagctgggactacagacgcgtgccaccatgcccagctgatttttgtatttttagtagagacggggtttcaccatattggtcaggctggtcttgaactcctgacttcatgatccacccacctcggcctcccaaagtgctgggattataggtgtgagccaccatgcccggcctacattcacttttatattatgatagaatctgtctagtaaatttcatagtgtagtttctttttaaatttttattcttttggagacagggtcttgctctgttgcccaagctggagtgca

SEQ ID NO: 112135 - DNA, 1067 bp, Homo sapiens
cttccttgtcattaagtattttttgtaaaacaagagggtgaaagcttattcagtggagggggtggtagtggtgatgggaggaattagagatcagtgttataaattcagaaataaagagaagtatctaaagtgagctcttcccactcccatccctctactttcagtatctcaagaaatctctgggattttggtagcaatatgtgtggagaacaagccaggaaaaggatctctagtttggatgattggtgattggctcataaattaggggccaggaggaatggagtgggttggaattggggccattcagatgaattctggcctggtctggccttgggaccatttctcaggctgtctctttctcttccctgtttccctttccttttgaaaggcatcactactccttcgcactcactggtgtttgctattcaacaaattattaatgtggctgatcttattttaaggggtttattgctgatcttcacagttaaaaaacacacggtaaaatatggaatgttttagttttgtgttagccaagtccctcctgatctgcttataggaagctctctttgaattctgccttctgcttttattcccaaggaaggaactaactaaacacacttttcccctagtcttttttaattcctttttttgtgaaggagatactatcttcttcctgtatggagaaaccaccccttacagaccctagaggcagctaagtctcattgatagatatctctcagcatctgttgtaactgcatccagatggggaggatcttattgtgtagacacaatgagaaaatgttctattttggacaacctcccaagtgccttttcatgcccaggaaagtgttttggggcatctagaacaaatagtcttggagttacagagagaagtttaggttggagttacacatttagagagttactgatgatattgtacaagacagcatttagattgagaagagacaagtaaggtttgttagaactctatcctggatcctggatgtgtgagcagaaagaattgtaaaataagattgagttgcttgaagtctgcagagagcctttca

SEQ ID NO: 112136 - DNA, 1047 bp, Homo sapiens
atgagctttttaaaaaaactaaacctttgatacattaaaatcagttggtctgttttgcactttttttcagtggatctttcatccatgcatgattttggtttttgtttgagagagagtcttactctgtcacccaggctggggtgcagtggcacaatctcagctcactgcaacttccacctcccaagtatctgggatcagagatgcgtgccactatgctcagctaattttttgtgtttttggtagaaatggggtctcaccatgttgtccaggctctggtatcaaactcctgagcttaagcgatctgcctgccttagcctcccaaagtgctgggattacaggcgtgagccactgcacctggcctacccatgtatgattctgttataccattggtcatttcaaaactaaggcagatcttctcatataactttcatcactgtcactctgatctcatcaggaaagtctttaagtattggcgaagctggcaagattatgtggcagatgcaaaaagtcttccaaaatgcttgaaagctcaaatttcatcattggcaataagtactgtcaattgttttcctcaaagaaacaggctcaactttgttcatttttaatgtctgccagatacccaagtcagaataactacagtttgtgaattgttctttcaagtaaaaatggtagtccatgaaaaaaaagctagctcagcttgcaactcaattacacaagtgcttttcttctagacagccattgtacttaagtgtgcagtggactgcttcctgggtacttcccattttatcacaaagaacatcaaaaagacccatgctcaagggtcaagatttaatgaacgtaataattctgactgcttgcttcattaacgacaatcataaaggaaacgcttaaaaaaaaataacgtgtggtagtgaagaatgcagtgactactagtttcatttgctgtcactgctttggttagtgcgaaggcgccagcagtttccccataattgcttttgcaccatcagtgcaaatgtcagcacagtgaaaagacaatgtctttgtgtt

SEQ ID NO: 112137 - DNA, 2489 bp, Homo sapiens
tgcagatcgccgcagaggccccagtgcccggatgtccatcaggattagcgcgagccaatacgggccgagcccggggctgcgccgaggacgcccggggctcgagagcaggtagtcccgtaacatcggggcgccgcgccgggacgcgtccccgcccggctccgccaaatggtgagcgcggcgctggcagcagggcccgcggggtgaaggcgctcatggacggaagacccctggctctataagctgaattatggcagcccagtcaaggtaagccgtgcaccggagaaacttttcaaacgcgttcgtggcgaggggagctgaaggttgcgggggagggcagggtgcggggaaggagacggacaggaagcagctttgtcattgccttctcatcattcccgaggctgtggcttgactaaatgtcagataaaaagcagtttggagaacatgctggacaatttctgcacagcggagagagggatggagttaaagtgaagattaaagttagatagcccccttcttcccccagaactgttattttccgggacattaagttgatttcacttgtccgcccttgcccaaatttccatttagattctttgtgcgcctacccctcggttttctggatttcttgctgttgtctcgaggggaagtttagaaatacgattaatgtaaaacatagttcaccttggagagggtgggtgagaatttgcctggtgagtgaaaattttactgctagaatgtacgattccacataaaacggccccgcttacgtgaatctgctgagtaggcaaagaccgggaacgcgccggggtggtgaaggggagagaggataatgaactgcagttgctgtcagaggagcgctattgtaagaacctgaagccccgtctttccatggtttgttactgtttttgtaatgagcgttgaagaagagtgatgacaaggcattagtgattattatgagatccaaactgttctgtgcgattttattttagttttgacagcagttggtgctaagggagacttaggagttatatatacattctctttcaactgtgttttgctagaaagcagtttggtctcacatatttaaagtagtagggttcttcaagctgatatttgatgtagaacagtgattttgggaggtctcagaagacttaacacgtctgaagactcagatcatggagagaaatggatgttaaatgttcatgtttgggctggatgagacaatgtttttttcctacgaaatagaactttctaggaaggaaagagcttctctgtataaagtacctcctatgtgctacctgctttttatatttcttcttctcaacacagtggtttatcctctgcttccattttattgagttttaagaaagtggttcttaatctggggccaagtagtagaacttggatgagaaacacaagttgtgtctctatttttgttaacctctagctgaaatttagtgttttttttttttttaagtaggactagagataaaactatagtaccagtccttgtgatgttatcacaatagaaactatatgtcttttcataatcttaatacaattgttgcagatgtcttcaaacaccttttgtgctctccactcaggaaattaaggaactgctttatcttgcttaattcagtagtaaagaaaaacactactgtaccattgatttcttttaaatattttaataggtgcttgtctatataatctggtacctttgtattcttatgtattttatttaatgtatttaaaaacatttttctgatagtgctgttattgtcagactgctacagaggtccatggcagaaaattaagattaagataccttgatctaagaagttagtaaatgctgtgtgacagatctcagtaatatagcgcagggatttgtacccaggtgtgagagattcaatgccagcgctcttaaactaatgataaaaataaaatgagacacaagctaaattggacactgctgtgtgccaggcacagcattaagcagctttaattggattagctctgactcttctcaggcacctaaatgggtaagtacttttattatccacatttgttagttgaggaaactgaggtccagcctggctgtttcttgcctgaggtcacaaaggtggagcaacgcctgactccagatctgctttgcacacttcctcccttatgcttcctctttaatgctgaggtgagatgttaaagggagctgccaagcctcagtataacagtacaaagaatgattcctgctaaaattggttgtttgtaatatgtaataatcctgagttatcagtgtggtggttcaacttgccagcaattaaaataggagaattgtgcttatttctgatcctctaccccaccttccgacatgccctggaactaggaacaaagccacaagactgttatgtctgttgttttcttagtctgtgtgttgggagtatatctcacattttgtaaatgtgcattttctttggttacacctggaatgtggt

SEQ ID NO: 112138 - DNA, 2037 bp, Homo sapiens
aagctagaagtactttgaattgagagattacctaagtatttcttggcttgtggacttttataaattaaggctgtgttaaaacctaagagtaggaaatttgttttgtggctgatttcttctcttaaagctggaagacatttcttgactaaaatgcaattaaatgcttttaaaatttagatttttgggggtcatattttgaaaacaataagtatttggtttattgtattcctagagttgagaaaggtggtcactgagaaatgtcttgtcaaagcggattgtatgctgtgtctgggctctcagataagtgtgtgctttctttggaacctataaacataacagacacattgaatatatacttccttgtggaaattgcaacaaacttgctttctttgatgtgaaatagttacagaacatggctttagttactggactctgatggaaagtgcatccagactattttatagaagtataaaaactagcaactagtaaacctaacagtttatagacatatttttttcctgcaagaattaacagtgctttatactgaggagtggtgttgatggatacagtaaaaaggaggactttgcctgattcccacctccgctaaccctctcattgaagcagatccctgaattctagaaaggaaaatatacataccttcaaatactatcagggattagccagtttaaaaaaatcacctgggccgggtgtggtggctcacgcctgtaatcccagcacttttgggaggccgaggcaggcggatcacgaggttaggagatccagaccactgtgaaaccccatctctactaaaaatacaaaaaaaaatcagccgggtgcggtggcgggcgcctgtagtcccagctacgcgggaggcggaggcaggagaatggcgtgaacctgggaggtggagcttgcagtgagctgagatcgcaccactgcactccagcctgggtgacagagtgagactccgtctcaaaaaaaaaaaaaaaaaaagaaaaaaaaaatcacctgatgccacctgagaacccctggcccttctccaccctggggcaggggtgtatgcatgggagtaggggagttgaacttgcttctttgggagagttgaatctggtggctgagcacggagcttctcaaaagaaaggatttatagacaaactgcagtaggaaagtatgttcagtcaactctcccacagtttttaacttttgaatttgtctaaaattaatgaagctttgaaaaatcaataaagaagcaaagtcagattgtgcccaagatttatatgaagctggtttttggtggatctctttgactctagggagggaaagttttccattgcaaaaagcaatgctcttaaactggtatagatccagttttgccctgccctatgccccgtctctgatttttgagctagtgattaccttggaagaaaattcatgaatgcaaagcagctttgattaaaaatgagccattatcaaagagaatactgtggttttggaaagtacagttcaaagaagagattttgggatggaaataatttatgtagtattttgatccattgaatattctcactttttccttcttgtgacaccattgtaaacagtgtccttgacagaagagaaacacaaacaggtctcttaagtgatttctttctagttcatcctgagagcccagttgagcttcctgactcacagtctagagctgcttccatgataaagactgaaggagcggtgagtcattttttaaagtcagctgatttatggggatgttgttgttttggcaaaactaactcaagtgatctctcgagattttgctggattttataccataccgtgaaaagatattccatagctggatttacactcttgaaaatggggtttttgtgcgtgctgcatctaaaaattttaaatttcaattacattcaggaataaaatattatggatgagagagaaatctactttttcatcttggttctgtcatttatttcttgtgagcctccaaatctattttttacataatacctgtaagagagaggagttata

SEQ ID NO: 112139 - DNA, 1977 bp, Homo sapiens
cctcccaaagtgctgggattacaggcgtgagccaccctgtccggctgaactgctatcaagttcttaaggctattgctgggagcagtaatttggtgacagatttaatatattaagagaaaatcccaggggtaaacatcttatctaaaggaactcaagcagacaaagggtaaaatatttttattgacacctagattgtctttatttcggtatgttttcaaagggcactcactgtttgactgcattctaaaaagtaccaagaattgtttttcctccgtggtggctcatatgggtgagggcttggagacctgcaggccacatgatcctttattttggtgggctggggaagagttaaggctgtgatgaagatcttaccttttttttttttttttttaagtattgcttactgctggattggcaactaaacaaataaaaagtaaaaggctattttaggggcaatatggtcatatgaggttcagggttctcaaacttgattagacacaaaaatcaccgtgggtgcttgttagtatgcagattctgctccccctcccccagagattctgaatggacaggttctgggtggagctctgctgtctgtaaggccaggggcgcaggtaccatgctttgtgagatggtgcatgtgtgagtgagagagatcatataaaccatgttgtatgatgctattaaattttgatatcatatatgcttataaatacacatttttcccctcctattgaaacagactggaggttggtagagaaggtggatatctacgtccataaaatttatccttatattacaaactgttggttgaaatatccaaatgcgtctgtgttaaaaaaaaaattaaaagataccaagaagcaattcccagtgtttgatcatacagcaccttcccaagaattgtttcttctcaaggagcagggtatttaatttacttttttccatgcgttgtgggctccctccccagttagagttaactgctaagtatctctctctctaccacacacagcccagtttaccaggtggcagttgtttttgttcccagggaaaagttaaaatggtgtgaattggtcagttttgtccaaactttgtgaaaccgaaatgaaagttttgttttttaagaaaagctttgcctaggggtactgctgaacaaataatgttcaacaagacattttaaatggaactcctactgggaagtaaatgttaaaattatagcagatgtcacttcctgtaacaaaattcaggaaacagtctttggtatgtgggtgttgtaacttttcaatttttggaactttccttcaggaaactgtcctgtcagaagcaaagcagtcaataaaatatgaagcacaacttaaactatgttatacagtgtaattaaattttgatttggtgcatatgtttttgtggtcaagacagacccaagattatcacgtgactttcatcctggataatgtaagtctggataacttgttaaattgcttctcccccacttctcccattctggttactttaaaaatacaggtgtatctgatttactctggacttgaatttatggaaagtggtataaaattaattagttctcattgttttgtacaaaactatgaaacctgtttcctccctagctttgcagaaattttgtctcaattgacaaactgtctaccttagacatttctaagatggcctatttagtaagttggtagctttgagctttgataaaagtttgagtccatgatattatggtttaagaaaatttttccttaaaggaaaacagaacgtgttattgagttaatattgctgggttttagttgttgtttatttgctgaaaggatagtcattggtataaagtaagctaaagctctgtccttttatattttttcaggtaattttgacctagcaattacagctataggaatgttttcctgttactcatttacagtctgtgtctccctctcccctccagcctccttttagagttaa

SEQ ID NO: 112140 - DNA, 1286 bp, Homo sapiens
tgggtaacagtaaaatgcatgtgacagaatataactattactaaatcattccctgccactctaggagtgcatttattagagaaatgctaggactattggattgtgttcttccagtgttatgcttttgaagttgtgggaaggcaggcggattgtccccaaaggaggtgcccttagttgatgtctgtcatcctacacaggtggggtcttttatttcatggccagggctctcaaaggcttccttttggccacaatgagagaaatctgggggtgagtgagtgtcctcccaggtaaattaatggtgggtctgtaaataaccaggggccccagactgaaatcgggcaggttgtaatttgtcagatacctggatgcctgttacctgtttctttttattctgttatcctctagcatttggtaaactttgatataaatattgtggccgtttctgagctactttattgtaagagaatagttgggaatctgtgattaggctagagttataaggggaaacaaggtctccctgagtgcaggtggggcatagaggttttaaatgggaaggaataggtgataagaatatgtaagaggttcactctacctccatttgaagacagaggtttaacgttatgaagactgtcaacctgtttcctccttacactgtcagcctgacagatgtctttttatgtacgtaaaggtattcagatccagcagtgcattctcccaccagacttttgaagaatcaggacatttgaggaacattaagttctgacctttaatagcagccactggcttaattcttcatattttccaaaaaccacacccgcctgctggaatagatagcacagggaagttggatggactccctgtgccttgggagttcttactcccagagtgtctcctagtgtttccttttgctgtgctgtgtcccgtatatcctgtcatttccatttattttatcctcaaattataaagaattgtagtgttaagtccgttattcactttaagatgcagccagaacagtgactggagtggtttcatacctcatgggtttcccacacttccatcaacacacacttcacaacaccttggaggcattgtgaaaaggtcaagctttggagatggggaagagtcctgaagatgttgggtgacattgtacagtgaatggaggctgcctgcttggcacactttccatcacacatcacattttgctaatcttttggaataagggggaaagacatttaaatgagataattagagataagaatggagattttaatcttttccctgaagtc

SEQ ID NO: 112141 - DNA, 1356 bp, Homo sapiens
tcatttcccgaaaactgacagttttccacgtgcacagtaatttgagatcgttgtttcaggctgaggaaagcccacaggccgttgtctggggtgggggtaggagggtattgcaggctctgaaagataattgaggcactccagaccagtggagtgggtggctgcaagacgttatcgtccccacagagtatcaggcatgctttcggacccatcctgtgagaaatctgagtggagtaagacggatgcaaacaccctatggtgaatgatcactcccctacaaacttaagtgctgtcttggggcggaggcctctttctctcttggaaacttctgctcatcattcaagattcagctcagatgtccctgttcttaattaattaaatcaccccaggctcctccatttagagttcctgtttttctccttagtcctttagcacttgtaatcaacctctactatcactcttagcatatgtttttttttttttcttttgttcctcctccttcatttgtgtatctcgctaaattgtggaatccctcacctttttatccctaggtctagcacataagaggaagtcaatgtttactggaaatcaggggcttttctgttctcattctgtgaggcttacaaccttgaagtacagaaagccatagataaatgcattcctgttctcaactttgacgtaaataatattcaaaatacaattctgttttgaagaaattattttataaacaggtcttataaaatataaattgtcacagtgtatctggtggtaatgttgaatgtttccttattgtttacttgcagtggatatattagtgtctgcttttcagagagtagaaatggaaactttacagccttatcaagaacttaacattattaaggactctaaaaattctcaagtgtatgtctttcttaattacttgaactctcagattctaatttttagcgttggctgaaggttagagggatgctttaagattgataaataccttttgttttatgcaagtgaactgcctattggtagtgatggtgaaaagatgatatattctgcatataaatgttgatagctgagccaaaatccagcccaaagaatcctgacaagctttgtaaggctcacaacacggcttagcagaggtcaaatgaagggagacttctgcagaaaaacaatgacttactgtttagctttaaggagatgccaattatagcgggtagtaggaggtgagctggggttatgatgaaaatgagaatatttagaaacatgtaactgttgcttgttaccatataaaataccaatagatgtttccagctttcttctcctataataatctccctgttcttcctacttgaaatgtctgtggaa

SEQ ID NO: 112142 - DNA, 1197 bp, Homo sapiens
ttgtgcttgaagggtagaaagtgaggcagaacgcaggaagggtgctcttacctgggagggctgaggctggcagaagtactgcttgaaatactcacccaggaggcctggcatggtggctcacatctgtaatcccagcactttgggaggccgaggagggcagatcacgaggtcaggagatcgagaccatcctggctaacatggtgaaaccccatctctactaaaaataaaaaaaattagctgggtgtggtggcgggcgcctgtagtcccagctactcaggaggttgaggcaggagaatgatgtgaacccgggaggcggagcttgcagtgagcggagatcgcgccactgcactccagcctcggcgacagagcaagactccgtcccaaggaaaaaaaaaaaatactcaggagctttagtcctgtaggcaccagggctcccagaaaggttttaggtaggtgaataacaagatcaggtttatgatttttagaaaaatcagtgacgcagctttgtggagatggacaacccagaaagaggagcctctcggggccacattccaaatgagaagtgaagtccattttatttgaatgttggatgcttcatagatttaatacccaaaacattttttaaaagttggggaatgaattaaaggaagaaagcattaagaaaaagactttaagcttgcttgtctacattcttagtttgtaactgtaggatttttaatttttgtggctgtcatgagagactttcaccagcctcattattttgcaggtatgagatgtggtccttcagggtcagttgatagtgtgacatgagtggcctggtaatgaggccagcactctggttgatcctagtacagaccagaagagcaggagaagagccaacacgtatccacatttctgattggtgccaaatgagcagtgccaatgaggcactgtgcagctgtgctcaccaggggcctttacaactaaaggggagacataaataactagtcaggtgacagactttatctcaggttaaaaaaattggtttatctctgttgccattgtggagggtaatttctgtatatccccttgcttgactgctggtaagcacttgacatcagtctcagggactgaattttctgaaatttgtcagtaacatcaatacgctgacattgcatataacataaagacatgttttattaacccctagctgtagat

SEQ ID NO: 112143 - DNA, 1027 bp, Homo sapiens
cttctgtggcaaacagaagtgagtagcagagagtgctaatgcattgagataatcccctgggggctcttccaggaaaacaactgacatcgtgctgttttgtcattgtagttggctgatatttttaatatgaaatcagattgtaagactttgttttaggattaagtctctgattactttctttataaattttaagaatgttattcatgttagttattgagagtgaaaaccctgggacgatttagctgagtgatttttattatgagaaagtctcttacaaattctttcacatggatggagagacgaaaaaaatctcccttctttgaagcaacattttatcctgccttcagacatggagtcactttgatttctcatgtttaaattgtatttggaagtcaaactagtattgtgcttggaggtatgttgatgctttttcataaagccaatgtgtgaaaaatgtttcccgcatgttagatggtaggaataggggaatgtggaaacaaaaggccaaaagatggacttagaaagttgagatgtggcttttaaaatgaaaaagtcacttacatggtgtggaagaaccctagcatcctgtctttttgcctccctgtttgtgacagatctctatctcaccatcctctaagctgggattgccgaacttttgtgtttatttgttgctctatcctttgtacattcaaatcagaatggcatagtgcttctaaacagtaataagacttaatcctttccagagttaatgtacactgttgattttaggattttccctttccttcctgccagatgtctccatccttatgaagataaatatataggagaaatcacactctgtcatccaagagagagttaaaaatttaaactcgaattctagagagttggtgacatgtatcagaggaaggcctatgtgaagtgaccagtcaagggtgataaatgggtagtcagctgtgcacagccagccctgtgggccgtgagttgccatggaagcaccgaatggcattcagcaatcccgcatgactaa

SEQ ID NO: 112144 - DNA, 1596 bp, Homo sapiens
ggaaaacggcctttctaaagtccacatcctgctgactcctgcagatgaaaagcttccacctctaccccatattttgcaagctgaaaataaaaatatcattaatcttgtctcagttccactgctgcctataaaaggctgttcagtttggaaccagtcctgagccatgatggagaccatggcccagagtgaatgcttgggttttgggagccaggaccccaggctggagggtcacagccaagtgactgaggcctcaccctaaggctgggttaaggaacttaggctttctttaaatcacagccgtcatcactgcttcttcccagacctgtcctcacctcccttctcacatgtaagtatgcctgacaaaacttggagactgataaattttattgttttcattcttttgtggcatctgaaacagtttgtacaatgacgacagaaacctgcttcgaattagagagaaggaaagacgcaaccaggaagcccaccaagagaaagaggcatttcctgaaaagattcccctttttggagagccctacaaggtatttactgaacactagacattgaagtcctgatttatcacaatgttgaaccctatgatgaaacaattcagtataattgagttcgaacaagggtcacagctgtgaaaataagataacttattctaacttattctagagatttttgaaaacaaagtatgaaaattctctgaaggttgttagaattaccaaagtttgtggttttcttttgtaatgctagtcttctacagttagtaatatgtatccatggtagtcttctcaacaggggaattgagttaaaatggcacattaaattctacatgtcgtacattaagttcggagttttttccttaatagtattatataacgtggtttgttaaatggtagttttccttagttttttttcattctcaaattctccttttttttcagacagcaaaaggtgatgagctgtctagtcgaatacagaacatgttgggaaactacgaagaagtgaaggagttccttagtactaagtctcacactcatcgcctggatgcttctgaaaataggttgggaaagccgaaatatcctttaattcctgacaaagggagcagcattccatccagctccttccacactagtgtccaccaccagtccattcacactcctgcgtctggaccactttctgttggcaacattagccacaatccaaagatggcgcagccaagaactgaaccaatgccaagtctccatgccaaaagctgcggcccaccggacagccagcacctgacccaggatcgccttggtcaggaggggttcggctctagtcatcacaagaaaggtgaccgaagagctgacggagaccactgtgcttcggtgacagattcggctccagagagggagctttctcccttaatctctttgccttccccagttccccctttgtcacctatacattccaaccagcaaactcttccccggacgcaaggaagcagcaaggttcatggcagcagcaataacagtaaaggctattgcccagccaaatctcccaaggacctagcagtgaaagtccatgataaagagacccctcaagacagtt

SEQ ID NO: 112145 - DNA, 1032 bp, Homo sapiens
aaaaattgagctctaaggaaaaagggaatctataatatagtgtggggttgttaagaatacctcgaagaaatatacataacatagaatgccttcctttcttaattcatgcacttcaattcaaagctccacattcctgtccaatatgagttttcagagttctattatttgtaaattggaataaaaaacctaaggtgatttatctaaaggacagagctagaaataggacctctaattacttaaatactgaggcctctagattaaaacattaaacctcaaaacccttcagccaaagggattaagaagattagaatgggcttgacaaattaccacggggttaggaaaaaaaaaatgcagagagaaagtaggccaaatttaaatagggaatgaaatgaagttcaagagaaaactaatagtttgtgtggaccctagacctctgtgggaaaaaccatcaatagagttatttcaacaattaaagaaaggaacaaaatcaatgtaaaaatagctgcttatagagttcttgggaaatgtgaacatgcaaagttaaccttggaaaataatgtcaaattgctgttggcaactggagagaagaaatacaagaccaaaaaataaattattatgttaacatgaaccaggatcctctcttaggaggaactgtttaaatatctcatgagtgttggtcacccccaccaaaacagccaaaatcaaaccactaactcagtcatcaacaagattccccttggaatatctgggtttctgtccctgaagattatcagttggctcaaaataaaacacagttaatctagagaagagctaaaatgacccgggtggctatgtgagagcctgggagagcacatgcagtctgggaagattcaaaagagttgaatgtctatatcttggcaaaggcacaactggagagactcagggggatccaataaccatccacaaacatctcaagtgtgaaaacaaggaggaacaggaatttctcatcctggtaccaaatgtacttctggcatttccgagaaggaatagaaa

SEQ ID NO: 112146 - DNA, 1024 bp, Homo sapiens
tcttgttccctccacagcaaaagctctggagacagaagtaggtaaacactgttcctgcttcctctcctcccctcccctctacttgcaacccattgcagcctgctctgtgccttcacgccactgcctctgccggcaggagccactagtggactgtattggatgaattcgaggaatgctctttaaggccttatcctacttgacatctctgtagcatttgacacttgaccaccatcaccttaaacactctcctcccctgttgtctgggttttcttctacctttttgtacgtgccttaatctcctttggaggctgctgttcccactcctcctccagggctctgtcctcaaccatcttttctcattctgcagcctttccctggtgacctcatttgcacttaagattcaactgccgttgctcacgaacaccagagtgattttctagcctaaaactcttaaaacgtattttgagatctaggttctgttatccacctgcccactggacttttctagtaggtgttgcacaggcatcttaattgaacctgtctaaaatggatttttttgtgcccccctctccctgtatcacttcacacacagaatgttctccttcctcctggtcatcagttctcaattcctttctgtcatatactccattgttttgaaagcagcttgatcctatggagattactttataaacattcatagcttctccttttctctgtccctcatttagtatggatttttaccgtctttcttgaactgttacaacttctttctaacctctcatcttgctgttttcctgcttctcagtatgccacattatttcacatgagtgatttgattaagtgaaaatcagatcaagtcgtactttttcaagatccttcagtacctctccatcaccttcaggacagaaagccagatgtgtccatttgtcttcttgcctcttacctgtctctgcagccttgagttctggccctgctgctggtactgccttgttccactgcagcccccagacccttatagatgact

SEQ ID NO: 112147 - DNA, 1321 bp, Homo sapiens
ttttaaagtcttagaccattggggattctgattccccttattacgtggtgaatggtaatggttcatagtcaatagttaggaagttggtgaataactgagattagacatttactgtcaaacagtggtaagttttttacatttgtttttcattcaggtactttgttgttaagtgagtttaaacctatcccagcacaccctacttattttaacttttgcactgttagttgacatattgtcataatatgtactgaaaacatttctgcgtataaaacatcaacactgaattgtaccttttatatgtactgtttcatgtgactatacaggaccttgcaaacatcaaaaattatattgtatgtgatctcaggatatataatggtaacaaaatcagtgaatccagcattgttactgcttctctcattatttgcatattcttatcaagtgagtgtttacaattatacatgtggacaacaaccactcattgttttcatttttatttaagccgggtcttaagaactggaatccttggtttcataattaaaagaggccctctttgtagagatcaaaacaaaatttccagaatgttttaagtagctcagttaatgcagattgagcctctacaaattttatatgctttagaaaaatatctttatgatgccaattatgcagattacctcactggtataatcaaaatgaccaactggaaagaaacaataagttttctaattattcatattaatctttaaagaactgctattttaaaatacttcttcccattgggttttataagtttcagtgatgtcttaggatttagtgggtttttttagcttgtttttgctttagttgatgaaagataaggtaatatcatttgcttatgaaagagcaatttacctaaaggtaaatttaaaaaaatcaaatatataaatatgtgtgcatatattcacttatatgtacacatatatacacacgtattcaatatgttatatatatatctcctatctacacgatatattaggctctcatttattaaatgaactggggtgccagcacatctctaacatgatcttccagtgtttatcctggagtattatttcttcatcttctatctcaaggaagcgtacgtacatcctttctttacccaaacatgctgcctgatatacctaccctccccaacctgacgttctgatgttactgtcatatctgaaattttgcattctgagaaatttatgtccccaaactgcatttaggcaactactcttataggtgaaaacatctgattaggtggtagtggttgatggattatagtcacaagataatacttctt

SEQ ID NO: 112148 - DNA, 1050 bp, Homo sapiens
gctaatagaaaatttagctgtacttcgagaacaggcttttgatccctatttatttcaatctaatatttgtgtttttagtaatgaataggtaataggtcagaatttaaaaggttaaaaaaaggatatacattgaaaatcttccccctattccttcccccagcctccattccccagccttcctttctggaagtaattgatgttaggactttcttgtgtatcattcccagtggtattttatgcatagtaagcaactccatatatatgttttcttctcattgatactttcttcatttatagaaatgctggcatataatgcatctttttttaaaaatttattcttctaaacaatgtatcttggagattaccccaaatcaatgcaaaaagagcatccttattctttgttgtagttgcgtagcatttatttctttctaggtggcatgtaccatagttttcatagtcagttacctgtagatacacatttagattgtttccagtatcttgctatttgcaaactaggctgaagtgaataactttgtacatattttttttgtacatgtaggaggcagtgctaaaggttagagaagtgtctgtgtaattagaatttgctgactattgccaaattaatgtccttaaaggttgtagcacttaatcctcctaccaatcatgggatttgagtgcctatttccccatgtctatctcatagatggagtattgttaatcttgtggctgtttgccaatctacgtgtgaaaagtagtttctcagtagttgtaatgtttccagggagaaaacaatgcaaaacaattatctttttgtctcttttatgtttatttacatgtagtttagtttgttaattaaggtgttgctttataattcaggcagcctgcatcttcttaagtgtctaaagccataagagaaacttagtttcaaattctgagttccgggactgaaaacatgccagccattgtttatggggttgcctctgtgtggctggcaccctgtgattcagtgagggttctggccctaacttccatggaacatattatctagag

SEQ ID NO: 112149 - DNA, 1033 bp, Homo sapiens
cctggttagtgataagtaagcctttttgagaatagcattgttataaaaatgccgctctgttgaaacttgagagacttaaaacacaatattgcaagagcctcccagtctcagtggcatgtttcttcagccagctctttttagcttattaaaacaaactgtcatgcttagaagacattcactcacatattttattttggtatcagtgcgtttccttacagttacacaatgtcattccaggaggagtgagaaatcaggccacggccagcattgctgccttttctggtccgaagcactggtagtaggaagaggcagttaaatgtgaataccaaaatgcttctttgtagaagcaaaggaaaaacgtagctcttgaaaaaatgttttaggttatgcataggacaactggaatcacacaccctcctaaaatgctaatatatttgtttcttgcagcagtgttgaggtttttagaaaactggtataacagtattctgagccagctcagctgcttcagagcttttgtgtgtccttgcatagacaacttaatttctctaggattcagtctcctcgttttatttttaaaattattttatttgtaaatacctcatcgtggactccaaaagcatgtctcctcgttttaaaaactggcataatacctaccacaaaggttgatgtgagaattaaatagagctttatacagaattccctcaggcatttttaagtttatgtaatagggatgtatcttacagttgatgggtacatttagtgtagtccccctacctcccaagctaataatggtgcgtcgtacaattgatggtaccaaattgaggtgataataacatagaaagagtttaatgcaacgtgaagtacaaaatgcattcaataagtagctgctatcatttttttaaaaattaaatatggctgcttgttaaggccatatcccaggaggaaagtgtggtctctgctgggaggttggtctacatacaggaagccagatgtgtgagatggctctagataggcagaaggggagagctcgtgc

SEQ ID NO: 112150 - DNA, 1440 bp, Homo sapiens
aaataaataaataaaaaataaagaacagttgttgttcccaaaccccttttaaccatttctcccccactcatctccaaaggcaaaaataaaccagaatagtaacagaagtagtcttggaacgtaattgaattctctaccagattttattaattaaattgaagtctacaaactgcaagacatttggaccagatttttatggcatctctcgttaagtttttctggttgtccataaaggcccaggagagttgctcacttcccagagaggaaacttcctgtattgatgtgtgggaggcaccagtggttaaacagtgcttgatttatacctcttggcgttctgtaggtgatacctaatacctatggcctcatacatacagccttttcttcagtgagacgatgaaattttaaaggaatgaaagaaaaatagtgggaagtagatggtcatctttagacttaccttgaaggattactttttgcttttgtttattgaaactatgccatgaacatttgtgcttccacaaatatgtcattgaatacattacccacttgttcaatttttcttgtacaaggatgacagattccttctagaacttaattccaggggaaaaatgttaactttcctcatgaactggcattctttctttttatcagagaagaattatatataatgtttcccattttgcctttaatttccaggaaacccagagcttaattttaatgctcaggtacagtaattgtaaaaactgagggttttgtgtattttttatccctcttctgtggcctttaatttgcttctaggtcaattttaatgatattcttgtcttttactgtagggtttctgacttttttcttcttttttttttttaattagtagagagatgtatataataaatgtgactgttaatttgaatcactattgctcatattttctcaaaatacatttactcaattttagttttttaacttttcattttaaagtattaagtgatggtggtactaaaaccagtaattaagtatattggttatttcctcacttgtgaaatttttgacagtagtagtatctaaccagttgtttggaaaacagcttgtttttgtttcacagtcttttgtcccattttgtagttagggttttctgagaaagaaagaacctctagagaaacatacctttttttttttttttgagacagagtctctctctgtcgctcaggctgggcgtgaccttggccactgcaatctccacctcctgggttcaagcgattcttgtgcctcagccacccaagtagccgggattacaggtgtgcgccagtacgccctgctaatttttgtatttttagtagagacggtgtttcaccatcttggccaggctggtctcaaatgcctgacctcaagtgatccacccgcctcagcccctcaaagtgttgggattacaggcgtgagccaccg

SEQ ID NO: 112151 - DNA, 1146 bp, Homo sapiens
agggtcaaatccattaaaactctcccaagtggaacaagtgacctgaattacttgtttgcttaagtcaaacaggaaagttcttcttcctttgaactgaaataattccaggaaatgcagtaaagaagctgagggagaaagaatgcatcgaggagagactgcttttccagcccaacctgtcacctacagtcttcacagctccacaagctctggcagtacctgttacgtacagtttatgtgcttgataatattcagggtgttaaattcattcacgttctataccttgattgtcttctacaaactggcgttttttagttttttatgttggagagctttaacttttcaacatagcccactgaaataggagttgttttttttaagtacatgaaataacttttaagattgtacttgccatttatgatcaatccattctacattaagttcaaaatgttaagtagcaatgaatgttctatttataatttactttttcttccctttccaaatatctttccaggaaatgacccattcatggccgcctcctttgacagcaatacatacgcctagtacagctgagccatccaagtttcctttccctacaaaggtaattccttaaaagtatggcaggcattgcatccaccttagtgaaaagcgtaaggcattgctgtgaggcagattgataaagtattacttgttcaaatctttggaaatgaggttaaaattatgattaatttagcttctacagtgcttcagaatgctttcaaacatttattctgcaacttagaacatcctagattttcataaagctttataatttataaaaagcattcaggattttccaatacgttctctcatttgaggatccttactttagagatgggagaacagaggggcagggaaattgagtgtgtgatttctcgttcagaattagatatatgcacatacatcttacatatctcacactccctacattttcttgagtttaatgtgatcagttacactagtgctggtttaataacaagcaaataaactgctgacttgtgtgtttctgttacagtatttatgaacaatgcgttaaaacactgccattctccttttttttaatttatacttttggataaccttcaaaatgtagaaatagcaccttcagat

SEQ ID NO: 112152 - DNA, 1118 bp, Homo sapiens
acgtcatcgtaagtgaaatgctttttgtgtattaaaattttgtagtatgaaattgtaatgtctcatgtcaatgcattgcttagatttttctgcctttatgtaatgacattaataagactgctgcattctaaagggaagaaagggcccacattaattttttttgcttgtttgtttgagatggggtcttaactctgttgcccaggtgggagtgcagtggcatgatctcggctcactgcaatctctgcctcccgggctcaagcgattctcatgcgtcagcctcctgagtagttgggactacaggtgcccaccaccatgcctgactaatttttgtatttttagtgtagagagggtttcaccatattggccaggctagtctcgaactcctgacctcaagtgatccgcctgcctcagcctcccaaagtgttgggattacaggcgtaagccactgcacctggcctaatatttggattaagtccccctgttgaaggtctatgtaccattggagagtttggtaaaaggtcttcttgagggggaaaaagggtttttgagccattatttacattttaactctgggaatagaaggcctttgcttttaagatgtcattctttaatagctttagctgttagaaacaagttttgggggatgtgcacaattgaagattttccgcccttttttggcctaatttactaataaagagctaatcttattgcccagctattctttattaaggccagtaagtccagaaatattttgggttatgggaacgttttagactgcatattaaagatttttaaattggcattttgacccaatttgtcatttcttgatggtattgaactcttactactttactttcatatgacaggagctggtcatagggactaagtgaggaggccttcctccagtatctgatctgtcactaactctgtgttgctagtctcaggatttcaggtggcccaggagtttaagctccaactttcctttagttttaggcacaatatttgttccatgtattttggaaggtggggattgctatggattatttaaaaaactatatattgagctggagaggttattttatctcctcgccatgactaaatgtgggtctgggttaagt

SEQ ID NO: 112153 - DNA, 1061 bp, Homo sapiens
cagaatgaaatgtatccttgggaaaaaggaatgacttttatgaactcacttttaatggagattagaagaaagtggtgtcccaaattaattggcaaattgcagttgtttcagattttgtgtggcaaatctcttagtgctcgcgggttgatttgatctattgtcagcattaggcttctttgacatgcagttaagctatttgagtggcacatagagtgctggggagatattctaatgcattttgaatatcagaaaaaaattattaattgcagggtcatttacactttgatttaaaaaaccaatctaggtcttaatgctttttctttcagagttatgaggacttgggaatccttagacaagtggaataggacatataagagtataaaagagaggcccagtagtaaaggataagcttgcgagtggtctgtattaactcagatatggttagggggtagcaacgtggtagaaggatgtagttgtgaaattaaatgtaatggttcagcatgtagtttgagatgtagttatttctcaaataattccttctgtaaagttctgtaggtaactgattagctaggatgttagtgcaatttgcccctaagtttaagagagagtgtatttgtttaagggctcttggttttggaatcctcttcctttccaaggcttagatctgtgaagtgctgaggacaaagtataaagtatttcctttttctgtacagtaactgtgaccttcatataattgtggacaattctttttctgtgcagccagatttagtttactggtgtcagtgcatttgtcagcctctgaaagaggacaaaaatgttaatattttagaaactaaaaaagcaatttatttgtatattctagctaacttgtttcttcccctaccccaaaattgccaagtccttacaaaaaggtgccctccattatttttcttgtttttggcctctgaaatcaacacttacttaaaataagagacagaaattagtcattatagcaatttgaaatatttattacttatgtggaaggtttcttttgaagtgagggagatatctggatgtgaagg

SEQ ID NO: 112154 - DNA, 1401 bp, Homo sapiens
ataacttagttatgacttgtaacttaaaaaaagtagatgttgtacatgttttttaatcaaaaactttagaaaaaaatttttttcttgctgccattttctcctccaataatagcatgctagtttacgttgagatacccacctctggtgatacagtaaatcaggctttctggaatagtttgtggttactcttggctgtgccagcagacactagtaatacacatatctgctgattctcatgtgagatatgtttattctttatcaaataaattatactcacaaatttttattaagtaaaatactttatgtataaatcccaatacatcccaaatgagggaggagaggttttgtttgaccatactggtttatcatttctgagtgtttctttggagacagcttttgcaatcttccttcagagatcacagtccgtactctttaggtttggaataggttttgtatctgtaggcttattttgttactatctatgtaattctctgcagggaaaatttttagaatctgggacagcattttcatggtgcctgtttatcctgaagaggaagtggagccaaaagtcagaactttctctaactttctgacttactttaggagagtatattcttggaagttagatgtttggtagctagaagagaaagttacagaatttttaatcctgtgctcaaaacaggaaatgtggttggattacatgatcattgatgttacaggaattaaggcaaatcagttttattcaaaacaaacctagtaactaagaaagaggtcagttttttgttttgttgtggttggtgactaatgctgaatacactttgccagatttttttctggttgtattatactttacatttatttcaaagatacatcttttatcttttgtttgtgtataactcagcccagccaccatttagcaataaacctgttgagtgactttttttgtataccattacgttgctaactgacaagtcctatgactgaaggctatattttctagccttgaaaaaatatgaatttagctgtgcagggtggctcacgcctgtaaccccagcagtttaggaggctgaggtgggcagaccacttgaacccggagctctagaccagcctaggcagcatagtaagacctcatctctacaaaaacacaaaaattagccgggcatggtggcctgtgcctgtagtcccaactattcgggaggctgaggcaagaggattgcctgagcccaggaggcagaggttgcagtaagccaagatcacacctgggtaacagagtgagaccctgtctcaaaaagaaataaaaatatgaatttagcttctgttagataaatattgagcaagatctacatttacaagttgctaacagttttcattttatttagaaacttatcccagtatgttttt

SEQ ID NO: 112155 - DNA, 1095 bp, Homo sapiens
atggctaactactttagttcagttagagcttatggaagaaagtaattgagtatattatgtatccctccccatttgttttgtttgcatggaccctgacttcactgattaggagtgaaggactttagtctcagggctcgcaacgaatccttgtcttgtggtagttctgcttcagtgttgtagcatgtgaaagagtctgttttgagatggtaagaggcttgcacttaactggtttctgtgttataattgtataattataattgtattcgtacattgtaattgtataattgtaaaacttaacattttcaggaagtcacagcctttaataaataaagaaaacttacacatatcctctctctttgtttaattaggcatattttctatttacatgctagaaaagttgttagaaatcatttcacattcattcttctctgtgtccctgcccattccagcatgctcgaagacgaccttcagctcagtgacagtgaggacagtgacagtgaacaagtaagtgttgcacagcctgtaataccaggagtccttttaaatacatctaacagatctgagctgcttgttctaacctgttttttgttcttttcctggtctttcttccccttattgtgaatgcctagaccccagagaagcctccctcctcatctgcacctccaaggtaccgtgtgggtttctccccatctgtacagaatgtttgcaattttttaccaaatgggaaaaataaagccttatttagtactttcacattttttgtcatgggaaggagctgaaggatcacagtaaaaggaaagtacctgtttaatattttggaagcttaaatcagccatagggaggttgttaaccctatagaagcgagagccccacactcatctacatcatcagtatagatgttaaagatttttaagagtttacaggctgggcgtgctagctcacgcctgtaatcccagcactttgggaggctgaggtgggcagatcacttgaggtcaggagttcgagaccagcctggccaacatggtgaaaccctgtctctactaaaaatacaaaaattagccaggcatggtggcgcatgcctgtagtcccagctac

SEQ ID NO: 112156 - DNA, 1948 bp, Homo sapiens
gggcgacagattgagaccctgtcacacacaaaaaagagaaatgatctcatcttgaataaaagtcatctttagttgaaaaatatgtcaaaaaaaggataaaatgtgagcccactaaaaatttattcattagctgccttctgcaaatacttgatgaaatgattttttactcatttcctcctattattccttaatagagtagttcacaaaacaaaatgtgtcaattctgtttaaattatactataattaccattagaatatattataaagatttctcagcagttggcaattgcctgttgattaatatttgctattaccaaatttctaaatcccacaaaaaagtgaaggttgctttaagagttaattgttatagaacttataacttgaggaggatgaccggaacctaaattctgggtttggaagtatttgctcctctgcaggacagtgttgtataattgggtgactaacacaaaagaataatttgtcatcaatggtcagttaacacttttctttctttccttatttttagcctgagcctccaacaacaaacaaatggcagctggacaactggctgaccaaagtcagccagccagctgcgccaccagagggccccaggagcacagagcccccacggcggcacccagagagtaagggcagcagcgacagtgccacgagtcaggagcattctgaatccaaagatcctccccctaaaagctccagcaaagccccccgggccccacccgaagccccccaccccggaaagaggagctgtcagaagtctccggcacagcaggagcccccacaaaggcaaaccgttggaaccaaacaacccaaaaaacctgtcaaggcctctgcccgggcaggttcacggaccagcctgcagggggaaagggagccagggcttcttccctatggctcccgagaccagacttccaaagacaagcccaaggtgaagacgaaaggacggccccgggccgcagcaagcaacgaacccaagccagcagtgcccccctccagtgagaagaagaagcacaagagctccctccctgccccctctaaggctctctcaggcccagaacccgcgaaggacaatgtggaggacaggacccctgagcactttgctcttgttcccctgactgagagccagggcccaccccacagtggcagcggcagcaggactagtggctgccgccaagccgtggtggtccaggaggacagccgcaaagacagactcccattgcctttgagagacaccaagctgctctcaccgctcagggacactcctcccccacaaagcttgatggtgaagatcaccctagacctgctctctcggataccccagcctcccgggaaggggagccgccagaggaaagcagaagataaacagccgcccgcagggaagaagcacagctctgagaagaggagctcagacagctcaagcaagttggccaaaaagagaaaggtgagtgtggggagactgccctgactccagcgtggaccatccttgctgttggcctggcggtatctttgatcggcctttgatttaggcccagttgagttgtctcacaagtctttgctttgattcgctgtagcctttgcatcttcttccagcattacctgtctggactttgcttctcattctgcagatgggcattaacacgtgttatgtccttccatcggtcttgctagtttgaaaaaaggtgaggcagtcattaaaaacaatagcttcttttaggataatgtagcatctagggccgcccccaacccacctcttttttttttttttttccaaagacaggcccttgctctgttgccaggctggagtgcagtggtgcgatcttggctcactgcagcccctacctctggggtgaaacgatcctcctacctcagcctcctgagtagctgggaccacaggtgtgtgccaccacacccggctaatttttgtattttt

SEQ ID NO: 112157 - DNA, 1073 bp, Homo sapiens
atagtgatcccttcatcttaatcgagtgcatgatttctttaaagcgctgtcaagctgctgagagatctggcctggggaacagtctgcctccgtggtactgtcaggattgatgtctgacccactggttccaaaccccggctacacattacattcacctggtagcctttagcactgatgacgggaatccccaacccccattggtattttaaaaattcctctggtaatcctagtgcctatcagggctggaaaccactgaagcagagccgtactgcagggcccaagagcatacaaagctagttatttggatccaaagttggtcaagtgtgcagtgtttagacatcatgatctaggcaaacagaattcctggcctgaaatatgtcactagttagaaacattagaagctttcaggtaaataaatataaaaaaccagtcaaccgtattcttatttcttcgtcagagaatcatgtgtcgtttggtttaacttcctgctggattctggatgggagttgttgaacatattaatctcattattttctgtagaggacaggttgtccccccttcctcattagcgccctgactgcttgttagggctctctgcctctggccctgtgaccagcacggttgctccagcaggcagcagtgtgtgggcctgctctccatggcagagacagggctgtgaagcttgggtactgctcacatttggataatgaagatatttttcattgtgttcattttaaatgtgaacattagaaaaaactctgagcatatagtcagaggaatagaagaacttgcttgatccttcacattagtggtatttagtgtttttatttaaaggcctcttagagtctgtccctctcttggcacaaaatttagccaaatattttctttcagaagatttacagatccttgaatccacttcagacttaaaagtgtatgaagatgatcataaagagttaatgatggctaacagctgtgatgaagccattagacatggcacctatagaaatgcacacgtttttttactactctacaacagtgggtaaggaacaatgcatgaggaaaagtagagaaaa

SEQ ID NO: 112158 - DNA, 1040 bp, Homo sapiens
agaagtagccttgttaatgcttagttttgccttgggggccttaatgtgtcattaactgcctggaaatacctttcatttaaaaaagtatactttagtacctaatgttcaatttagtatcgatctggatattttagcaaattttgacttttcaaagacaaagtttctgtcttgtaatgtttcttgggccggctatactgcctttcatctaaaactcactacagttcactgggccgtttggtaacagggtaacctgggcataattaggtgcttgattgacaagagagttaccagtaccagaagtcaggttctattttaaccccatcatttccaattgattgtttttctctccaccattattcactgtctctcaagtgttagcactctgagttgttgaacggaggtttgtatgctgcgcagagccctgtcgcaatgccccagcaagcttcttgttggcatgtggccactctaaattgtgctccaggatctgctatgggtccatgcttgcaggagaaacagctgtgtagaatttcctattgcatttcatttgtgggtttagaactcggttgcttatttcatattgtctcccttttcagtccttcaaggtacatttttccaacttctctaatgaattattacatttctgagtagctgatatgtttttatcttatctaagcagtatatttataattccttctttgcattggctaatctgattagtagttcagaacccaattttcagattgtctatagcaaactgtgaagaactgtgctgtcaagtagaaatagaatataagccacatatgtaatttaaacttttctaataccacattaaaaactataaaaggggaggaaatggaaaattagtaaaaaaaaaaaaaaaaaaaaaaaaattctttttgagacagtctcattctgatgcccaggctggagtgcagtggcgcaatctcagctcactgcaccctccacctcctgggttctagtgattcttggcctcagcttcctgagtagctgggactacaggcacgcaccaccacactcga

SEQ ID NO: 112159 - DNA, 2309 bp, Homo sapiens
ttctattgttgttatatatctttgtagtcctttctgtaaaatacacgggattttgtagacggtttcctttcaacattgtacttatttttcagtagaaaataaagtaagctttaagtagtccattttgaattttatacaaacaataaactagtgggtttaagtggatggttctttcgaaagaagttggaggaaacctcataaaaaatcatctctgtattatttgatgtaaatatgcatgttttgtggattcttttctatttagaaaaacatcagtggtctattgaagtctacttactggcattgtctgttactttaggcatcttcgttttcttgcatgggaggaattgtttttcttcgtgcaaaaaaatctgtctcaatagaaattatatcaaatctacattgtcccctgcccactccccatcacactcacacacagacacacatggtaagtactaagaaggttgctgtgcgtacagagatgtctccaaaggttcctttaccctctttgccttttctatattttcttttctgttttgtctgtacaattatgttggtaataatttgctttgctgattatactgtaatagggtgaagcagaaagagactgtgataacaagaaaatcagactggagaaggaaatcaaatcacagtcatcttcatcttcatcctcccacaaagaatcttctaaaacaaagtgagtatagagattagcaaccacctaatctacggtgatcaacacttcttgggtcttgacatagcaaagaaatttttcttctgcactagaatcagtggattaataaactcaagctcatttggacaatgtaataagtttgtttttctttcttgcatccatgaggaccttacaggaattaacaattcatgtggcagcaaatttagatttatcagaaacattttcactatggacaatttctttagacatctggattttttttttccctgagggaaagtaagaaaggtacccttatttctactttgcagaattggaaacaaacacacagagaaaatgacttgtccaaagtcagagaattcttactgtgtgttggagccagcatttggactccgggagcctgtgttcagtgctccttcttttagagatgactgagaatctgtcagaccactcagtgtctgttgttgggaagaggggtggcaggtgagaagtggtagtgccaggaagacgtaaatataacaagcagctattatttactgtgatttactcaagaaattgcttcaaaaaatgtattggcaaaaacaagtgcatagtgtcaccgtgtgggaaccgacagagatggggaaggctcagatgtggagggtgtgtgtccactcgtcttcttgtcagggaaaggcaccggttgggaagcagctgaagcaggcgttcggaatggttggggaaagtcaggaccactggcagactctgcaagcttagaaactatacagcttcatttatcactaatgggtagggctagatttttgaaatgcctcaaaaagtccctgaaatttggcctgtttacacagtttcatgctttgtgataccctactcttttgtgccagcagccagtttgtaactaaacaacgaagccgcttgatgtgtactttgcctcctcttagttttacgtgatgtttcactccaggccctccaggccctcctcacagtcctcaaagaaggaaatgctccccccgccacccgtgtcctcgtcctcccagaagccagccaagcctgcacttaagaggtcaaggcgggaagcagacacctgtggccaggaccctcccaaaagtgccagcagtaccaagagcaaccacaaagactcttccattcccaagcagagaagagtagaggggaagggctccagaagctcctcggagcacaaggtgagcaggggcggcggtcactctgtaagatgggatgcattgctgtacctttacgttcccaaagaagacaagttgctagtgatggcacttcagaactgtccattgcttttaatgaggcaactgtttgtgtttaaaatgctactttttggagggagagtaaaaggtattaataatacacaaagatttaggtgtcgatttattcttcttacagtgatttcagaggtgaaaaatcaaaatagatttttgtgctagtttttgttagggtgttttacagtaagaaatagttaccctgtgtagtcctgctttgaatgtttgatctcagatactttcattcttggttatagtggggaaaaaatgatccactttctcaaataaaagttcttctcttcctgttaatctgggtggagtggagtggtgtgttt

SEQ ID NO: 112160 - DNA, 1021 bp, Homo sapiens
cttatctaaaggaaatggatattgacaaattgctacacagtattgtagtttagtttatttctagcctaaagccaatattaactttggaaatcccatgaaagagatggtgttgaataagtatatttggagaattcagttccatcagtgaagcaaaccggtcatgccaaatactgctgattaattggggaatactcatttgatttttgttctgtcactaatctgagcctcggttctctagagaaagtattttttgattaagttaccttttaaaataaaaaatgttagaataattgaatattctgaaatatacatgtatactacatgtgtatatgtatagcagcctagttcattctgctactggtaaaacatgagaacagtatgcactaaagtcattctgttgtcagctcactgggagaagcgttgtttctgccctgtgtagagtgcagcagcatgcctaagtagcatgacagcccataccgctctcattgctgacgtgtctccagctccttgtattccacttacatctttactattttctttctttctttttttctttttcttttttttttttgagccagagtcttgctctgccacccaggctggagtgcaatggcatgatctcggctcaccgtaacctctgcctcccatattcaagcgactctcctgcctcagcctcccaagtagctgggattacaggcctgctaccacacctggctaatttttatattttcagtagagatgggattttgccgtgttggccaggctggtctcaaaatcctgacctcaagtgatccactcacctcagcctcccaaagtgctgggattacaggcgtgagccaccatgcccggcccctattttcattctttccttttgaacatatcaaatacaaagcagaaattacaaatgctaatcagttgctctcaaggtcttcatgggcagtacatacgccacatgtagagagaaagacagttgcatcacactgtcatcagctgcacttgccatatgccacttagaagcgtg

SEQ ID NO: 112161 - DNA, 1062 bp, Homo sapiens
gttttctttttaataaacttcagcacgcacaaagaaatatgcgtctgcattactccagacatgtggaataatctgtttctcaaggaagttatagaatgagtaatttgacactaataacaaggagactatgtacttactgccttagtttgcgtatgtgctttcataaggctttgagagcatggtcttaatacgggatcattttctttttcctaatgaatttttgctaaaatagttttcagcaggtcatagctgacaggctttggttatcatttttagttcattcatcctcacacttctccctggccataattaaactaagacagtggaggaaagtcacactaaagaatgtgggtgagaaactaaatcaaggtttgtcttcagcctaacaatgaccatgttcttctcctgcagacggacagggttggaaaggcttttaagtacctggaagccgtcttgtccttcattgagtgcggaattgccacagagtctgaaagccagtcatccaagtcagcttactctgtctactcagaaactgtagatctcattaagtaagtgccgagtcattgtgctttcctcttaagtccttttctttcctcacctttattgttttaatccatttgaaccttagtgtgaagatggctcaataaaggggagccttaaaaaagttattggtctaagaactagtgtttgtcctgaagttgcgttctagatgaagtgctagcacagaataactgggtccaactgcatcattttgctaagtgcgccaagaagtgccaaagctttgagggagattggtttttccagtttagcttttttatgaagtgtcctctcctctcagtttaagcctttgtttacttacctacatttcaacaggggactcagtaaggacacaacttcacttggtttcaagaggtagacaagccacacaagagacgtgtactcacctagttttctcaatggcctggattgttgctctaaagccttgggtttttaaatttttttcctgtgatgctctcatctcttcttcaggaaaagtcaatataaaatggaaacaagcatagt

SEQ ID NO: 112162 - DNA, 2509 bp, Homo sapiens
tgcatacattacatacatagagtattgtcttactaggagattccaggcagaggaagtagactatgcgaatggcatgggaaagcatatttggaatacagattagcccagcagggtgtctcgttgaccttgtaggagtgactttagcagtggttatcattttggcaggtgtatagtgaaactttgtgtcttggactgtagttccagacacgtaaatctgtgatccaggggtctactggtgactgactgatcagttatctcttctcttccacctcccagaagcacaggcacaccatcccctctttccccaatgccttctcctgccagctccgtagggtcccagtcaagtgctggcagtgtggggagcagtggggtggctgccactatcagcaccccagtcaccatccagaatatgacatcttcctatgtcaccatcacatcccatgttcttaccgcctttgacctttgggaacaggccgaggccctcacgaggaagaataaaggtaaataaatggctttgtggtggtaattactggggtgtttggattgggaggaataaacattggtttatattttataagttcagtttcttggagaaaagggaatgtgtagctgttttactttaattatattttctctattctgcctcaaaacctagttgcggttgttccttgagcactgtggcatggagctgagtttctgtggctagatcttagcaaaaccaaaatacaagtggctttagcgccttgccccttctgaagctctgctgtcattacttcagcctgagctgaaatgctagctgaaaggcagggcaaatgaagaagaggagccactggctgttcctaggcccagcacattggagatacaaagtagcataacccaaataccgagattatttgtttttagtatatgttaagaaagatagtagctatggtacgagagatacagcgtagtaaacattattgagacttgtttggggaagaagacccttggagaaatgcaaggttcaggagagttggagccagctggctgtaactacttactttcgacatagagcctcttagggccttatctgtcttatcaaactgataatgcttttaacttttttttttcattaatgcatcctttgaggcaaaggtataaatttggtgttttccaagtgccagccattgtgctaagcattatggattcagctctaaagcaaacctggttggtagtctagtggagaattagcaagcaattacagtagattgtgatttttttgatgtgattaagtgcagaatattgtggggacctaccttctggaaccttgaatttttgtttccattttaatttttgtgtgtgcttgtgtatttacttgtttttgttttgttttgttttttttgcagaattctttgctcggctcagcacaaatgtgtgcaccttggccctcaacagcagtttggtggacctggtgcactatacacgacagggttttcagcagctacaagaattaaccaaaacaccttaatggagccccaggttgattcaatgccttgggaactatttttgcacattggaagcctcaaaaacagtccagacatttgtttcatcaggacaccaaactctaaaaaagaagcaccacgagatggccaggacatttgtccacttaaactctcaacaacagtgtgatcattggttggacactgtggttatgcagaagcagagatgaggaggctggccccagagatgatcttgcccttcctaactaaaggacagaagtgcaatttagcttaaatgggtgtatgaatggtctagaaacatttctattttttttttaaaccagcaggatacaagttgcaaatgaaatgaggagaaacagtttcaactctgaaagtgaatttcacgtcatctcagtagccacgctagtccattcccagaaggaaatttttttttttaacaatgacttttggtaaagggttttgtggatgattttttttcttttgagttttgggagaaatatttgtttagtaacttctaatggccatctgtaaaccataagtaatgaaggactccactgtgccccactttctgccaatgaacagtggcttgataataccaagtattgttgtaatttataaaattgaaggcaacccccgctcctgccgcccccaatctccccattgcctagagcgctgcacattgaccccagctctgacttctcattactgtgctgaaagtcagcccacgtcggagcggtgaggaggagccacagcacatggggtgccacctcgaggtctgcacaggaggacttggcgctgccatttcctacccctgccatttcccacccctgcttcagcgaaagggactctctaacagggcagtcactgttgactctattctgaatttcctcccttggggaagaagggaaccaacatttatacctgaccagatggctaaagtgcttttaaagttttgtttaagtagagctggaatttgaggtgctgatctgtggtctacagttatgtggtaa

SEQ ID NO: 112163 - DNA, 1028 bp, Homo sapiens
cgtgaaattcactttcagagttgaaactgtttctcctcatttcatttgcaacttgtatcctgctggtttaaaaaaaaaatagaaatgtttctagaccattcatacacccatttaagctaaattgcacttctgtcctttagttaggaagggcaagatcatctctggggccagcctcctcatctctgcttctgcataaccacagtgtccaaccaatgatcacactgttgttgagagtttaagtggacaaatgtcctggccatctcgtggtgcttcttttttagagtttggtgtcctgatgaaacaaatgtctggactgtttttgaggcttccaatgtgcaaaaatagttcccaaggcattgaatcaacctggggctccattaaggtgttttggttaattcttgtagctgctgaaaaccctgtcgtgtatagtgcaccaggtccaccaaactgctgttgagggccaaggtgcacacatttgtgctgagccgagcaaagaattctgcaaaaaaaacaaaacaaaacaaaaacaagtaaatacacaagcacacacaaaaattaaaatggaaacaaaaattcaaggttccagaaggtaggtccccacaatattctgcacttaatcacatcaaaaaaatcacaatctactgtaattgcttgctaattctccactagactaccaaccaggtttgctttagagctgaatccataatgcttagcacaatggctggcacttggaaaacaccaaatttatacctttgcctcaaaggatgcattaatgaaaaaaaaaagttaaaagcattatcagtttgataagacagataaggccctaagaggctctatgtcgaaagtaagtagttacagccagctggctccaactctcctgaaccttgcatttctccaagggtcttcttccccaaacaagtctcaataatgtttactacgctgtatctctcgtaccatagctactatctttcttaacatatactaaaaacaaataatctcggtatttgggttatgctactttgtatctc

SEQ ID NO: 112164 - DNA, 1878 bp, Homo sapiens
ggctttatttcgatattgaagatgttatttaacatctttcttttttccttactcccttagccatcccctccccttttgtcctatcattccctagaacaagccacctgtcaattgtgaagggttgtgttctttatggcaggttctatgcagattgtgccagagcatgtgcgtgttctgttggcaagccacagtgctcccttgactgaagacatttccaggtagatttctcagccagctctaaaacagattgctttttcagtggccttactctttgtgggtttttttttttttctctgaacttgatataaagattttatttgtcccttgaaaaagtaacaaatgtgcatagatcaatttgtactactttggtcattggatatttctgatccttattgcattgtacctaaaggagagtaactaatggtaacctttttaatagagtatgtgaaaggtagtggctgatgaatccttaacgttcatagggtctttttgctgttacggttgtatatagaggtctgaaggatttttaaaatgatttgcactttttcactgcatgcttacaattcccaaaggcaaaatctgtactgaggtagatcatttgaaagggctagattataaaattaagccttagagtatggaaagttcttataacaataatagtacacacttcagagtaagacaaatgcaaagcatcttaaggagtgaaaatagagtgtaaatcttgcctttggcactacaaggtgtgtgtgtgtgtgtgtgtgtgtgtgtgtgtctttagtaggaaatggaagaacactgttttattttttaaagtgtttaatgtttctgtcctttctgtgaattattgaatttaagagccctgctaaataatgaaaaaacactttactaaaatttatcaaattatactgggttcggattgtgaaaacattggccacctagtagcagtggtgaggagtgggagggcccagcaagcatttatcagaaatagaatcacaataggaggagaatttgactgtctgatattatgatttgattacaatactgaatgggaaaagtatctaatattttgtaacaaaaagaccttcatattatctgttttgaccaaaatatgtagctatttcccttacacagattggaccgcacttatctcccttgtcctgtatcctttaatttcaggtctcaggatgtttagaaagctaaaaccccctacccctttctggctgaaaacttgccttatttggtatcttacacattaatgttactagcatcaggagcttactgttttattatgattcatcttcagtaatttttagaagcaagaagaaagccattgtgtcctctacaattaacaaaacttatctctgatatacaaagggatataaatatatacacttaaatagagaaaaagaggttgattgaattgtgcctttgagtgaacccagtttttaaataccgctgtgtttgtttcgccatggcttcagggatgctacatggctcttgcaccttttactcctctgctttatgaagtttgagttgtatttgtgcatcttaaagtaggttgaggcttgaggctgggctttcgggtttttttgttttttgttttgttttgttttgttttgttttcttgtacttaaacctgcttgcttcctaccacagattctttattttcccaaacactacaaaaaaacttttaaaactttgccatttcatctgtttacactctttgccactgattagcagtatttaaatcttgcaagaatattttgtgctttctttagaaacacaagagtatagatttttctcactgaaaagtgagagttacgcattgcagccatgaagggatgctaggatcaattatggcagtaccttttttcccct

SEQ ID NO: 112165 - DNA, 1455 bp, Homo sapiens
tccttgtgagcctatatattagtatatcggcctggagaggacaagggaataagaccactcatagtgaggctggccaagctgcactggtcggaccaggcagtggctgacctaaggaagacaacttgctttgcttaaaagtagattttttaagcaatgcttaacacaggcagcattcacctttgttcaggccatcgacatgtattgttaaaattactgcatatccccctcagatatcaagtatacactgttcatgttggggttgtgtgtgtgtatgtgtgtatgtacgcacgcatgtgtcccaaatcttgttttaattttttttttctgaatgtgatcatgttttggatgatacctgagcagggttgccttttttttatttattaccattatatattatattatattatattatatattttttgctttcttataactttggaggaaagtcaaatcttggtattattaaaattgttttaaaaaggagtaaattttccagttgataaatgaaaatcactggcctatgtttaataagtttttctttaattactgtggaataacgtgccagctatcatcaacacaatgattttgtacatagggtagggaagcagtgatgctctcaatgggaagatgtgcaacacaaattaaggggaactccatgtattttacctacttcagcaatggaactgcaacttggggctttgtgaataaaatttagctgccttgtatagtcgtttgaaagaatatgtgatctgtgagagaattatagtttttttttagaagaaaaatctgcaaaagatctttccaaagacaatgtgccacagatcttttgttctctgtaatgaggattaattgctgtttaaacaaaaatgtaattgttcatctttaaattctttccttttcataagaggatcaagctgtaaaaaaacaaaaaaattaataaaaatttcgagaaatcattggggttgaatccatgctttctctttacctgaatacagttaattcctaataccattatgtgaaattgccatctatagccaaggagtttcatgtgagcaatgtgtccttattcgcaatatttattgctggagtggagaaagaactgggttcagaaggcagcttatccttctgttcagtggatctcgctaagatcataatcggacacaaattggcctaacatcaccagtgtggcttcttatcctaacatcaactggagggtgtagtagtgaccaaatttgcctatttccaaatttgctgggtagacaggtttgtagaatgttggtattgaaaggaatctaaaggttatctggccttttcaccctttgccaccgttaaagaaaaaatactctttgtgatttcatgaaatgggaaaggacctaggtgctgaaatctgacttccttgtgtttgaatctgattttctggtttgctaattatgtgacccttggtcaaattaacct

SEQ ID NO: 112166 - DNA, 1037 bp, Homo sapiens
gctgggttttattgtaacatgattttaactttttaagaaactgcaaactgttatccaagtggcagtaccatatgtttccatcagcaacatatgagatttccagttgctccttgtcccctccaacacttgatattgccttttcctttgattatatccattctcctgggtgtgagacatggtgtcattgtggttaaatgaatgtacagtgctttcaaacagcatctttttcctaaagaaaatgattgccctctagtggctcattctgcacattacacttgggaaaggggcactaatgagaagtctaaagctcagaacaggcttgttaaaatttacattcatttcacagcatccctggtttagcacactgaacacaatttgagtccagtttcaaaatgttttacttcattactactattaataatacccaggagctgagctggttggctgtggcttttacataatcccaagaggtacattatagtcaaaactaaatttgtgtgctttagatcttatccactttatgcactaagatcttttgctataacaagggtttagacctgtagagtggctaacgcctacaaagaaggggaaaaaaggccagagatggttattgtttactcaaacctattacatcctttcaaatcagagccagaggaataaatcatttttactagtggaatgaatataaattctttttaatgaattggacacaaatgtgtctggtggcttgttggtattttcaggtaacaccttgtaaatatgcctatggagagttgtaaaaatttaggagactaggtctcggctgctcctagggctctgctgaaaggacagaacactatgcatgtttaaaaaaaaaaaaaaaaagttaaaactttgagctaagtaaggaacctggccagggatttacttatttaaggcatgtgtatttggtaagtaaaaaaagatgtggcttcaggaaattagggtagtagaagcaaacatttaatgatttaacataagaagtttttgctttaaagctatcactcacacaggtgatg

SEQ ID NO: 112167 - DNA, 1053 bp, Homo sapiens
tagaagcgtttgatccagtgctgaataggtaatttacatgttgtctccgtgctttatattatcttctggtataatagtagattacttcagagtgttaaaatgttgctagtcgtagttaatactaagctttgggatatcttatctcccactggaagcttgctgtcctacaaaaccagtctcacatagggaatttttgtctttggttagtattttgagtaaagtaaattatgctttgtaacattttttcttctccgtcttttcaggtgggagcttgttggatctgtgtctcactgcagagctggagcaggagtagctgtgtgttcctgtttaactagccaaattcgagatgtaggtcatggatccaataatgtggttgactgtatgtgatttgagttctggccaccaacaatttagtcatatctgataggtacaaaagaaaaccaagattttgatatgaccacctttcaacactttttactgcaactagagtcttatttaaatgttaactgttgtattgtgactaagtacaacttttggaatgatacctgaagaattattagtaatagagttaaatttgatacttcctgcttttgcaaataatggagtagggaagaagatagtcgaacttaaaatcatacctaccctgaaaaatgcttaaagtagtgccaaaaatcttgaaatctctctctctctctctatttggatgaatcaaaatgtaatttgttgagttttgccttttcttttgcctaaagatgttaacgtcaggcagtgggtttttcctagaggagagattagtacctattcattaacacaaggatacataagagacttgccccttttgaagatcatttctacttggtgctgatgaatttatgcctagctttttttttctaggtggtgatttttcaatttcttttatatttacggaagtagaaaaaatgttctgtctttttgaatgccacttagctgcattttcagaagcttataggctataagaagcctttaatttcagtttgaattgctaggacaccaaaagacctagctgggctaact

SEQ ID NO: 112168 - DNA, 1005 bp, Homo sapiens
gagattggcttctgacctccgctgcagaacttctctgtcaactcattaacctctcagttatgccgctgtgtgtgcactaattgaatattttgaactcttttatactattttgttgggttatattttattgttttgagtttaaagtagcctgtgtaggctatgcactgtacaacttcagggggcagtattcacatagagttgcacagtttggcaattctgtagccatctagtcaaaagctttgatagatctaaaaataatggaaacaaactatactgtttgaaggttaacatgataaatgatttgcattagcacaattttttatatgactttttttcctggaaacaaactcatttgctaaagtatgttttattgtctttgcaggcgaggaattgccttggcttccttaggaggcccaatttatgcaattggagggttagatgacaatacttgcttcaatgatgtggagagatatgacatagaatctgatcagtggagtacagtggcaccaatgaatactccccgtggaggagttggctctgttgctctagtagtaagttatatggcaacttgtcattaaattacattgcattacattcataaccaaaataaggaaaggtccaatatatcatcaccagtatgaagatattatatatcatattatttcctgaaatactgccttgtacattctaatttaccattaaaacaatatataaataaattcgaaatctaatgtgttttgtttgactctcttcatttagaaccatgtttatgcagtaggtggcaatgatggaatggcttctttatctagcgtggagagatatgatccacatctggataagtggatagaagttaaagaaatgggtcagcgaagagcaggcaatggagttagcaagcttcatggttgcttatacgtagttggtgagtaaatgggtatttctctaatatatcagtatatacaatgacaagtgtcatataacagagtaacaaaaattacattgcattta

SEQ ID NO: 112169 - DNA, 1057 bp, Homo sapiens
ttattaggaaaagtgtagattatttcaaggaatatagaaattattgatgtaataaataatagaaatggcttttagctctctaattttcctgttaacttgctgtgctgtttcaggatgaatctaaatttgtcacatttgaattagcaatatcattctctgcttttaacctgaatatttaaaatattcctttgggatactaatgatgaatattttatttatgccaatagaaaatggtttgaagaaatagctctaaattaatatactttataattattgttttataatggtttctaaattttaatgaattattttgctaataaaagtatagttattcctaatgtggatagatttattatgtaaacaaccataggacatcacttctattttcttctctcaccgtagtttgactttttttaaacctcagaaatgtgtctcattgttactgttcttattttttactgtcaataggagttaccaggataagaagattataggcccttgtgatctttttttcttttgtcgtcttcctctcctttctctcccttccctccttcccttcctccattttttcctttcttcatttattcctgagaagtaaaatgacattttgctacttaaaagaagagtgttcttatttacttattttttctaaattaaatgctttgttaaaacttagtgcttgataaaagcactcagtgataattctcgtgatttttaataacaaagtttcctaatagcattatcagaaacttaaacaaatagtaagaagaatgaagaagaatgaaagtgcttataattaccagtgttctcattttagatatttataggcagatgaagtaaacctattcagagtatgatgataagacattttttcaagtgcatatcacaatatttatgcattcatatgagtatcaaagttcagaacacatttacatcttctcagaattattttgaaagtaagtttgtcagcaaagcaaatagaaagtttcattatcttgcagctatatcttatttgtgtatatgtgtttttctttaagatggtaaggcagatttcgtt

SEQ ID NO: 112170 - DNA, 1119 bp, Homo sapiens
gttgttctgctaaaaaaaaaaaaactcccagttaagcctcaaaacttaagatttttagttcatggccacgtatgatggttcaagcatgtaatcccagcactttgagaggcctaggtgggtagattgcatgagcccaggagtttgagaccagcatggggaacatggagaaaccccatctctaaaataaaaattaaaaaatagaaaaattttagttcatggcctttctctttgaagatagcatattacacatctcaaaagtcatgtgctcaagtcagttgttcttgttggattttaaaggagttcctttattgatataaaataattagcaaaagtgaattatgtgttatttagcataaaaacaaagtttttgttcttttataaatatgattgatatagttattttgcatatatagtattaacaaattatagttaacaataatttttttcttttcgtttgtctctacctgttttattgttgatttttcagtcacagcaaactgtacaatggcagttgagtgggttttgaaaaacgtctgaattgtagtgtctacatctaccttctgccttctctctaccctttgaaaaaaaataaatggcatgtttgagaagagagctctattaaaagaggaatattgcaaatggcttcagattctatgagtagtaaacaagctaggaatcacattacaaaggggaaaaggcaacaacagcaccagcaaataaagaacagatcctcaattagtgatggtgatggagaagattcctttatttttgaagcaaatgaagcttggaaagattttcatggttctcttcttcgattttatgaaaatggagaactctgtgatgtcacactcaaggtgagattgccttttttgtacttttctcaggcctcttcagtgtaatatgagaaatgggggtttctgtaaccatacaaggcaaattttgttgctatacatatttgatacagtcagaatgcttttagtctcaatctttttttttagtgtaggagaaaggacatagagggtaaatgaagagaagttagcataagataaaattattgtactaatttaatgttgatattcattatctcttagttaacttctgagagttctgaaaccctag

SEQ ID NO: 112171 - DNA, 1162 bp, Homo sapiens
caaggattgaaatgaatacatgtaagtatttaactcatgatgacaattatatatatatatatatatatatatatatatatatatatatatatctgttatgtgccagtttgttaactcatttaagttttatagcaatcctatgaggttgatactattattttcctcatttttacagatgaggaaactaaagctaatgaaacgttatgtaacttaaccaatatcatacaatgaatatacaactaataagtagatagaagcacccaattaatgcttgctgttgtcattaaaaaaaaaaagatgacttagggtattaccatcttttctatagtgggttcctaataattgcaatctcatgtagagcattataaagcatattttatttctttgctggaaaaaatgttgattgcaggactgtgttcctgaccaaggactcaggatcacataatttataaaagtaataacatctgtttattgaatcttactatgtactagatacagagctaaatactttatataaattacttcacttacccatcacaacaaccttagagctgaggctcagagtaattttaagtaacttgcccgaggctgcacaattaacacagaatcccaaaactgtctagctctaaagtgtctgctgctaaccgccagtttatgtgccttgtgtcgcgtatggctgacagatatctctcaaaagcaaggcaacagcttctataattttaaatagcaaaatgtgctactgtaattttgaaccagaaggaaactgattacctactgcctgtaggctaaaccaagcttgctgcctgtttttgtaaacaaagttttattggaacacagccatgctgtgttcttttaaaaataaagacattgagacacagagagattaggtaacttcccagtaatgtagctagtagtaatctaatgtcagtaactatgttaataagcctctgaaagtctgccaatccctgaatcccatgctaccccctaaactctatgtaagctcagcaatgtgctctattcagagggaccgtgcctggatggcatagctatcccttcagtaagtagtaaattcagctttgtgcttttcgtttggtttcaaacatccagtgtgaaatattccatactttgatacttggcaacaaattattgataaattaatttt

SEQ ID NO: 112172 - DNA, 1131 bp, Homo sapiens
aatatatagtagtgactcagatttaagatgcttaatcttatttaacatgaacatgactatacatgataacttaaaagtatttctaaagagggtattctacaaatgcacttaatattaattttctaattatttgcatatatctttcttttaggatccttcctgagcgtttcctggcagttttaaaacaaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaacttttggtgtttccatctttttgtcttaaacagaacatgacaaccttcaaattaaaggaaaataaattgtgcaatctttttttaaaaactggaaatttcttggatgtgaggctcattgagatgggactataagatcagatctataaatttaaaaatttagtaggtttgttaggtttcttctacgaaagaaaaatattttcaagactatatcaaacacggctgg

SEQ ID NO: 112173 - DNA, 1569 bp, Homo sapiens
ctgggccctggagattcactggtgaccaaaacagtcatggagcttataggaaaggtgtgggaaacagatgttttaaaaaatttaatctcagctgggcgtggtggctcacgcctgtaatgccagcactttgggaggccgaggtgggcagatcacgaggtcaggaaatcgagaccatcctggctaacatggtgaaaacccgtctctactaaaaatacaaaaaattagccgagcatggtggcgggcgcctgtagtcccagctactgcggaggctgaggcaggagaatggcgggaacccgggaggcggagcttgcagtgagccgagatcgcaccaccgcactccagcctgggtgacagagcaagactctgtctcaaaaaaaaaaaaaaaaaaaaaaaaaaaaaatttctctaatgaatgttcagttacaaatctgagatagatactatcatagaaaactgaaaattactatataatgagaaaataatttagactgggggttaggaaaggcctctttgaggaagtgaagctgtgacttaaaggaagaataggatttatccaggaaaagttttcagcaaattctatggacatcttaaagtaaataaggaacagcttatagtgacactgaattttgtggaacaacaacaaaaacaaatactctactaattttctttaaaaggctttttaaggaaatgttcttattccgtaagtgatgctaagatgcagtaaatcttctatgtcagggcttcttggaccttaatgtgcctacagatttacctgagaatcttgtaagatgtgggctctgatgcagtagctctgggctggggcctgagactcagggaatgcccacattgctctgcagaggaccatgctgaactgaggaaaacaggcagacatttcagaattcttgaattattttgtaaactctctattttcagttcaagcaagtttgctgctgttggatttcataaaactttgacagatgaactggctgccttacaaataactggagtcaaaacaacatgtctgtgtcctaatttcgtaaacactggcttcatcaaaaatccaagtacaaggtaagttgagaaattgagacaaaaggattggtggttgctatgaataccagccattctgtgggttttcctaaatgttttaatcctgaaaacacctgatagttaaagctcttagttcattttgatttcagtttctgcagattgtgggaaaacaggtggaaagccaaaaagagagaaagcaagggagcgtgactaaaaaagtaaatatgaatgacattggtaaacttgctaactcttccttttttcttctcctgagtaatgattcacaggcttaaatatgcatacatgtcaccaggtgtgcttgggaactatgttggggcttcaccctcagatatgttgacttactgggtttggttggggtagggtagtggcagggaagggagcctggaactctacatttaaaaaaggtgattatcataggtgattctgatagagataacccaagaccacatgtgaaaaacacttcccttggaggtaatctagagattagcctccgaaagg

SEQ ID NO: 112174 - DNA, 1116 bp, Homo sapiens
ctaattaaaaaaaaaaaaaaagagaccgggggtctccctatgttgttcaggctgatctcgaactcctggggtcaagcgatcctcccgccagggcttctcaaagtgccaggatcacaggcgagagccgccgcgcccagcggcaccccctatctagtgataagcaaccttcaactatgaaagaagcatctggcctgtggacactgtcggttatccttggaacttatccaatttaggaaaacaagtgagcaactaaccctccaaggccggctcacgacaccgggagaaagtggtgtaaaagacaatcgcggccacacaccgcgtgggggctgcgcaaagcagaactaggaagctttgctccggtctggacttcgtccctcccagatctctgagctagcaagcactgcagcccgagccaattgcgaaagaccaacaaagcccagcccagcggaaggaacggtttcggagttgtttttctttgatacgggagttcctccttgctctcgcccctactctttctggtgttagatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataaggtaacagtgtttactatgttttactttctggtacctttaatttgtggatgtgtctgcattttgctggcaaccaccctttacctcatctctgcaaagcagggaggaaaaaaaaattagtattgccattttgcagatgggagggcatgaattaatatgttgtatgatcacatgataaacagacctagaggttataatagtcccagttactgccccatttgtaaattgatccccatttttgccctaaggataactcataattttttcctgaacctgatttcattgatccctctattttaaaaatag

SEQ ID NO: 112175 - DNA, 1026 bp, Homo sapiens
aattctcccaaagtgttgggattacaagtgcgagacactgcgcctggcaactaccagtaatttttaaaaggggattcgtaaacttattttttaaaaaactttgataaccttttctttaaattctattctgctacttctttttttgttaatactttaagtagtaaaaattgtttatatcctgaattttcattacagataatgtagtgtcttttatgtaatgtagacatttgtcctggtttgtaacagtgatgaatatagaatatttccagtaaaaatcaatagttttaaataaaactagctgatttgagataaatttatatatactctgctttaaagaaaaagtccttgtaactttatctcaagtttgagatagaaccttagtttttgttgtaaatccgttatgattttatattactattcacagatggaaaagggatagcagtggaaataaaatcatgcatcctgtttctgggaagcatatcttacaatttgttgcaataaaaaggaaagactgtggagaatgggcaatcccaggggtaagcattaaaattaaattagtgtttaagttccttttagttgctttacttactacagggttattgtttgtgaatcttttctattccattttcctctattccttcccacttcatttagtaattcttatgtttttcatccctgcatgaagtgtcattgtcagcaacaagtttaggataatccaagactgttagaatctgcgtgtaattctgacacctttgggaaataacgtgggctttgaagttagatgtaggtctgtgttctggccgttctacttgcagctgggtgattgggagttcaggccctcatctttaaaataaagagatctacttcacaggattattagagatcacatttaataggcattcattatgttgggtcccatttcagaatttaacctccactccaagcccaaggtagtatttttaagcactttttggttgaattctgataacttttgacaatatttaaaaaattagcttttgttattta

SEQ ID NO: 112176 - DNA, 1006 bp, Homo sapiens
atagcaggtacaaaggctctcagcgggcagcatgttaggcaggtcctgggaacattgaggaggtcagtgtggctggaatggaatgaacaatgggggaagaatcaatgtgctgtgttatttctaacctccagtcctttttccttagttcgagtttggcaagtaccaggaaattggtttgattgccataggctaaccttggaccaatcactgtggccaaatacatgaggtatccttattggctccttctactagcaacagatggtttagagaacagtgtatcacagagaaatggggatcactattataggcagattgaataataaatgttcactctactactcaataaatatttgttgaacaaatcaaagctgatcccttttttcaaaatttttaatgtgactcttaggggatggtggatccaggagagaagattagtgccacactgaaaagagaatttggtgaggaagctctcaactccttacagaaaaccagtgctgagaagagagaaatagaggaaaagttgcacaaactcttcagccaagaccacctagtggtaagaaatagtgtttctgggagggatttagttctgtggattgatgaaaatgacttaaaagttgacctggaaatctgtatgtccttctctaaataaagtggaatacttgtatatttaaaatatattcacaaaaacaaattacagatcttcactgtaaataggtttctatttaaagttttatagcccaactttaggctatataggctaaaatgatatatatttagttcatttatatcatttattataataacttttttcttcttagtttttctttcttttttttttgagatggagtctcgctctgtcacccaggctggagtgcagtggcacgatcttggcttactgcaaccttcacctcccaggttcaagcaattctcctgcctcagcctctggagtagctgggattacaggcttccaccaccacgcccggctaatttttgtatttttagtaga

SEQ ID NO: 112177 - DNA, 1336 bp, Homo sapiens
gacctcaggtgatctacccgcctcagctttgtttatttttttacatttaaatctctcatccctcttggactgattttgatgtaaggtttcatattcatgtaatataatctcgtttttaaggataatctttttagagaaaactctttgtgtttatctaaaatttagggacttggttaaaatttggacattttggaatactctagttttttttcttttattcattctgctgaccagggatggaatggtctagtttttaattcacttggccggctagtacaatgatgatataagattattttaaataagaatacttgacgacatagatatgctaaaacagaaatgagtttttcttggtgatggtttttctttggcaaccaggtgagataatggataatcttatgctagaagctggagatgatgctggaaaagtgaaatgggtggacatcaatgataaactgaagctttatgccagtcactctcaattcatcaaacttgtggctgagaaacgagatgcacactggagcgaggactctgaagctgactgccatgcgttgtagctgatggtctccgtgtaagccaaaggcccacagaggagcatatactgaaaagaaggcagtatcacagaatttatactataaaaagggcagggtaggccacttggcctatttactttcaaaacaatttgcatttagagtgtttcgcatcagaataacatgagtaagatgaactggaacacaaaattttcagctctttggtcaaaaggaatataagtaatcatattttgtatgtattcgatttaagcatggcttaaattaaatttaaacaactaatgctctttgaagaatcataatcagaataaagataaattcttgatcagctataacttctgtttcatctagttcttgtttgtcaatgccttccctcccgctccccatcttctgaggcctgaaggatgttcctgccacatcaaactcctttaggcagagtaccgccactggatgtatagtttaatgtttcatctgatttttctttaaattatttccttcacattttgcttcacatgatcttgttgaagctaattttgaaaatggaaactatgttttcttgactttagaagcattagttttaagaggaaatttcagccactagtcaatagagatcaaaatcagtgaacaagagctgatactctcattttcaaaaattctgaattaaaaaaagtccaggaagttagtaatttaaatcagtatgttcatttcactctagtgaaactactatatgttgtaaattagttaaaaatggatgttcagaaaagaattgaaatcaggacaaaaaatta

SEQ ID NO: 112178 - DNA, 1020 bp, Homo sapiens
tctcacagtaactaacctggatggctctggattaggatctctcattaggttgtggtcaaggggtcatgcagtgcggcagttatctgatggcttgactgcagctaagggtctacttctaagcccactcccatggctctttgcaggagccttcagtatcccatcgtgtaggcctctggtctacagggctgcccacagcatggtatctggattcctccagagcgagtgaccaggcagaaagagagaaaaagccaagactgaggccccaatgtcttttataacctaacctcagaagttatatatcatgatttctgcctcattctattggtcacactgaccaatcctgctacagcaggaggaggagaaggagaccacagggggttggatgtcaattgtctttctaacatctatgatacaagcagagtacttataaaaattcaaatatatccttctgtcctgccctgcccaccattatctagaggggaaaactcagctgggataggatgtatttatggatgcctgtttatatgacatgtgattttaaaggactgataaaaaggcaaatttaaacagaggccattttacttaagaaaaccagttgcatctcattcttccttttgcaaagcttctggcagctcttcagtgtgtaagctcacccaggctccgctgggcggttgtctgggaggagcaggaagggcttaaaatccagtcatttacaaagctgctaatgatcttgtttgtgcactgtggtttggccatcattgccttattttgaagaaaggaaaaaattatcacataataaaccaataaagcagatattaaatattcagtcagaacacgtaaacaacttactgctttggaatgtagctaaagaaaaacaaatttatttgtaagtatacccttctttccttcaaggctgagaaatctacaggagaagataaagtttagccaatgttttcctgaattttaactgcctgtgatagacgtgctcatatattcctcacatagctgttattaactagc

SEQ ID NO: 112179 - DNA, 1109 bp, Homo sapiens
aattgctccagcccaggaggtagaggttgcagggacccaaggtcacaccactgcactccagcctgggtgacagaatgagactctgtctcaaaaaaaaaaaaaatctcaagcaatgcttatttttattcttaggaaggtcaccttgacaaaatggatgaaaaaatagataaagatatttaaagcaggtttagtcattattcctgaggtatgacttcattattgcaagttggaatcacatagttttagaaagccacacttacagtttcaagtggtttttaaatacgccctttaaaaagcactggaaaaacaatctagtcagtaatgaaagtgtggagaacatgaccacgagtgaggactaatgcctggggattaaatttgcagcatcagcagatgtttagcaacttgcagaaggattgatgatgtgctctgtattagataattacagcgtggatccagtgaacatacacattggtgttaaagatgcgtatgaagagttttaacaaaattgtttcatgaaatgtgagaaaggaaaaagtcatgttaataagtataaaatatttaaattaaagtaacatattaaatatgtatgtgaaccatagattaaatatcccaagtgtacattacaatatattacccatttgtacatgctgtttggccaaacactttggttgaggatgttctcactagaaagatgaagatggcattgtatttgggggcaccttatgtttggtcctatgcagttttcattattgtgatggtttgattaatgaccattttcataactacatagtaagcaccacaagagctcagcccctctctagttttgctccttgctgcatttctggaattttgcatgggatagaacactgaatacattagttgtttgagatgtaagataaaaatgctaacttattttcataattgcatgacctagaaaacactggaggaactgaaacagaaacgtaataaaaagttaatgaaagataagatgttttaatactttttaccctggtgttaatcaagatgagatgagtctttataaatgtaaaaagtcacaattcttttttttccccctgtagaaatcaaatggttcacatttatgcaatgat

SEQ ID NO: 112180 - DNA, 1022 bp, Homo sapiens
taaaatcaaggtaaatatttacaagcagagaagtccaggaaggtgaggtttgagggagtaccagggctgcacgtaaataacagaaccggagcctgctcgcagactggtacagtgaccttttctttttgagcacaaggtggcaggctaggtcaatttccatcgtctcttataaggcagctacgtgaggctgaagttttttgcccaatttcagaaacagatatctattttttttttaactgagattagcgcagcctgatggctaaaacatggttttggataaggcatgggcctcactcttgactactgactgtccttgtggatctctggtcctttgtgtttggactaattcctccacgtctgcatcaaatagcaatgcattgtggatgccaacacacttctagtttctgttaactggatgaaaaaaatatgaacattgtcagtgttttgaagaaatatccatgaacactgaagcttagagagaggaaacaaaatcggaccagagaattgaaatacgcagtttctccactagatagcagactacgacaggtgacttttggaagggtccatctgtatttacccaaagaaagcatccgtttttctccatcagttcatatttttcttttaccacgacaagtgtttttatgtgatcagaccattcgcatgtaaagctctgatataaacctgaaatataagtagcagtttgatttcaatttattaatctgcaatttaaattctgatagagttttttttttacttcattaattgcctccagttttttttcccccaaattgtcttttattttttaaaaagcaaattactaggaatagtttattctggaattctgatggtaacattgggtgatatgttcagtctttcccttgattctgacctgttatttccagaagatagggaacaaatgagggaaaaaaagattccttgtttttagattctactttgtattctttcaagtttctctctctctctctgtgtgtgtgcactcatgaacacacatatactcacac

SEQ ID NO: 112181 - DNA, 2798 bp, Homo sapiens
cccaaagtaatttatagatttgatgctattcccatcaaactaccactgacattcttcacagaattagaaaagaattactttaaatttcatttggaatcaaagaaggtcatgtatagccaagacaatcctaaccaaaaagaacaaagctggagacatcatgctacctgacttcaaactatactacaataatgcagtaaccaaaacagtgtggtactggcaccaaaacagacaaagaccaatagaatggagcagagacatcagaaataatgccacacatctacaaccatctgatcttcaacaaacctgacaaaaacaagcaacagggaaaagatctcctattcaataaatgatgctgggaaaactggctaggcatatgcagaaaactgaaactggaccccttccttacaccttatacaaaaattaactcaagatggattaaagatgctctcaagtcactccagcacagcgttggtgctgcctgggtatcagaaagcaagctcacattgctctccagtacgtgtaagccttttcttttcaagatgcctgaggaagtgcaccatggagaggaggaggtggagacttttgcctttcaggcagaaattgcccaactcatatccctcatcatcaataccttctattccaacgaggagattttccttcaggagttgatctctaatgcttctgatgccttggacaagattcgctatgagagcctgacagacccttcaaagttggacagtggtaaagagctgaaaattgacatcatccccaaccctcaggaacgtaccctggctttggtagacacaggcattggcatgaccaaagctgatctcataaataatttgagaaccattgccaagtctggtactaaagcatgcatggaggctcttcaggctggtgcagacatctccatgattgggcagtttggtgttggcttttttctgcctacctggtggcagagaaactggttgtgatcacaaagcacaacgatgatgaacagtatgcttgggagtcttctgctggaggttccttcactgtgcatgctgatcatggtgagcccattggcaggggtaccaaagtgatcctccatcttaaagaagatcagacagagtacttagaagagaggcgggtcaaagaagtagtgaagaagcattctcagttcataggctatcccatcaccctttatttggagaaggaacaagacaaggaaattagtgatgatgaggcagaagaagagaaaggtgagaaagaagaggaagataaagatgacgaagaaaagcccaagatcaaagatgtgggttcagatgaggaggatgacagcagtaaggataagaagaagaaaactaagaagatcaaagagaaatacattgactaggaagaactaaacaagaccaagcctatttggaccagaaaccatgatgacatcacccaagaggagtatggagaattctataagagcctcaccagtgactgggaagaccacttggcagtcaagcacttttctgtagaaggtcagttggaattcagggcattgctattcagtcctcgtcgggctccctttgacctttttgagaacaagaagaaaaagaacaacatcaaactgtatgtccgccgtgtgttcatcatggacagctgtgatgagttgataccagagtatctcaattttatccatggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagattataagaaattctatgaggcattttctaaaaatctcaagcttggaatccacgaagactccactaaccgccaccgcctgtctgagctgctgcgctgtcacacctcccagtctggagatgagatgacatctctgtcgtagtatgtttctcacatgaaggagacacagaagtccacctattacatcactggtgagagcaaagagcaggtggccaactctgcttttgtggagcgagtgcggaaacagggcttcgaggtggtatatatgactgagcccattgacgagtactgtgtgcagcagctcaaggagtttgatgggaaaagcctggtctcagttaccaaggagggtctggagctacctgaggatgaggaggagaagaagaagatggaagaaagcaaggaaaagtttgagaacctctgcaagctcatgaaagaaatcttagataagaaggttgagaaggtgacaatctccaatagacttgtgtcttcaccctgctgcattgtgaccagcacctacggctggacagccaatatggagcagatcatgaaagcccaggcacttcgggacaactccaccatgggctatatgatggccaaaaagcacctggagatcaaccccgaccaccccatcatggagacgctgcggcagaaggctgaggccgacaagaatgataaggcagttaaggacctggtggtgctgctgtttgaaaccgccctgctatcttcgggcttttcccttgaggatccccagacccactccaaccacatctaccacatgatcaagctaggtctaggtactgatgaagatgaagtggcagcagaggaacccagtgatgcagttcctgatgagatcccccctcttgagggtgatgaggatgcgtctcgcatggaagaagtcgattaggagttcatagttggaaaacttgtgcccttgtatagtgtccccatggctcccactgcagcctcgagtgcccctgtcccacctggctg

SEQ ID NO: 112182 - DNA, 2884 bp, Homo sapiens
actcgaaatcacaaagctaagcttgagtagtaaaggacagaggcaagttttctgaactccttgcaggcttgaacaatagccttctggctcttcaataagtacaatcatacaggcaagagtggttgcagatattacctttatgttacttaaaccgaaagaaacaaaaatccattctatttaattttacattaatgtttttccctactttctccctttttcatgggatccctaagtgctcttcctggatgctgaatgcccatcccgtaaatgaaaaagctagttaatgatattgtacataagtaatgttttaactgtagattgtgtgtgtgcgtttttgtttttttttgttttaaccacaaaaccagagggggaagtgtgggagcaggtgggctgggcagtggcagaaaacctcatgacacaatctctccgcctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggtacagcttcagtttgctactgggttgtgcattcagctgaatttcatggggaagtccaaattctaaggaaaaatatttttaattgtaatgctgttaaacagacttaaattttctagcctttttaataagcagattagatacattgcaggtctcctggaacaaaggtgtctagatattttgaatgccaatcaaatttaaaacttaaaaatacttccactgggtcctcaaaagaacggaaaccaccgatgctaatcagaaaatagtaaaattaaattcccctttggaataattatacctatataattttcagtgggtgactgtgcaggaatttaaaagaaaagggatcttttatgctaattaaaccaattacaatgctattttttaaatgatgtatctcacttttaaggggaagaaaaccctttctgaatatgccactgctaaatttagctgttaaaatattcaccaagatacctgtatgacactgtgtaggcttattattacaaatagaaaagctgttggctattttcaatgttttcctttgaatttcaaatttttagaacatcttacttaaataacaaatttcagagatagtttgatttcacctaagtagcacctacttgataattaagctaaaagtcacatttaaagtacatgttggaaaaatggataaagcaaatttttttcatttttttctgtgagttttttcttctctaaaaaatattcccatactagcttattaatataattaagttactgttgatctgtttgtaggtttagagagctagatatataaggtagtaatggtataatttctggaactctaaattttaaagttgaataaatacagacttgcaaaatttccctttcccttgcctaatagtgaaagatggataataggtggcaatataaatattaacttgaaagactataatactaaaaagaaaaggcatctctaagaagtagaaaagattctatagaaaatatattttatttgtgatcattttgtaatgtggtagtataaaaaggtatcactgttgtaacctatgaagatgtcagctattccttatgaaatattttgcaggaaaactcactaccatgagaattgcagtgatttgcttttgcctcctaggcatcacctgtgccataccagtgagtacagttgcatcttaaagaaaattcctgaaaataactgaattgtgtgcttccatgtgctaggaggacattcttgtaatctttcttcatcttttctgtttctaaggttaaacaggctgattctggaagttctgaggaaaagcaggtaagcatcttttatgtttttatatagttaaatcatttactcaattatggcgagaggtgcaagaaacgtatttgctgcgatattacttatcttctcagtcaaatccattggtttacaagtattgattgactgcctgctatgaatctaggccagtaccaagcacagtatagtttttaataaatataagtttataaaaccaacccagatattttaaatataataatatctaggcatgtatgatgagttatcgcatgtaagataagttatatgaagttgtgtgactttttttccattagtccacatactgatctaaaagcagaaaattccagcttttgctttgtttagtggattgctaagtttaaaattcacattggatattagtcagaactgtttgtatgaccataatattcacaatattgtctgagatattagctgagaagcccattgtgaaaagaaagtctatgtgtgctgtttgtatctattgtgattgtcagctgatgttagatcacattttctaaccaaacataagaccaaccaaactctttattataattatttgaccagcactaaagatgtacctacccctccacaacagatgaaactgtgccagccaaacaacaaatgggcattgtccccagaagcttggacaaaaaggcacacagagttcaattccagttgaacagaataaaggccaaaatagagctgccttgggggtcactgcaattagactgcttaatgaagacattaaaagaagtattctgtgttcgtttgtgtgtggaggggtgtgtgtgtctgtttttcaactgatttgaaaatacaggtgttgaatcctaataataaaccagaaaaattaacatctccagagaagatagaggtcatactatttgaggcaagaattagcgtctttttaataaacgaaaatatggcaaagatgcattttagaaggcacgtggagctataacaatttaagaaatacgtgaagagctcaaggctcagccttctagaa

SEQ ID NO: 112183 - DNA, 4272 bp, Homo sapiens
tggactggacacaatgaagattaacagtaattaaggtcacttctggtttagatgtgctttatctgagaggaaaattcagccagcaaacatacaaaaagaaagcacagtgtgaagttcggtgttaagagctagtttgcctgcgtttgaaccctgcctggctctgccatttcctaccacttaactgcactgtggctgagttttctgatctgtaaggtgggaataataatgatacctatctcataggggaatgaaaggatcaaatgagttcatatttgtaaagcaatttgaaagagtgcctagcccacagtaagtgctacataagagtttgttaaatgaatctgcaaaaaaaaaaaaattacaaaaaggtacctaagggtccgggtgactatatgcttccatcaagactagtgaagaatggttgttttttccattcatccctacatttctttttttaataatgataaacatgcaacttttttgtagctttacaacaaatacccagatgctgtggccacatggctaaaccctgacccatctcagaagcagaatctcctagccccacaggtatttttaaacttctcataattaaactacagtgatgaaagatagccacactcaggccatttgggctgctcagatgaatcctgcctgcctgctggcaaacatgtgcttaggacattgactgatctgccatgttggcttctctctgtgttaagccatccacagatgaggctgaaaaataaaaactgctttggattaaaaaggttaacttttgaataaaaaagctaggcatgtgtgatgcgcactaacacgtgccattccttcttcagaatgctgtgtcctctgaagaaaccaatgactttaaacaagaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataagtttagcattacagaagatgtttattaatgcctgttatttgaaacattaatctgcttgcaatttatttaaggtattttgtagatatctaatatctaataagcatctaattaatgcatatcaaagctaagattttgcctttaggaaagttttctttcctaataaaatagtttatttgacaactattctttttattaggatcattcatatatttgctaagcaaagagtaaatttattttccttaagattcaatttgaatatactaagaatattaaagcaagttagataaattacccaatatatttgtcaatttgaaatttgatagacattagttgtttaattcaatgggcagttttgagctgcagtttatacacacatgcataacagagtcacctttcaattatccatgttaataggaaagtggttatagattttagtacacacattaaaatatggatactcttctcttttgataaatctcatttcaaataaaaaaaccagtctcataattatgtatctgtatctattacatcattgaatttagtaaataatgtttaatatgtataaggaaaaacaatgttattgacatgaagattatactcacatatttggcttgaaaatatctataaaaataatttctgttgcaaagtaagaaatgttcttcagaatgttattaatccctgtgttaaaagagaaattggaagatgctcactttagctcctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgctcaagtctaggaaaccacagtttgcatattcattcattcattcatccattcattcatccattcagcaagaattcattcatattctactttatgaccattgaatacaaatctttttctgcttggcggtttttgtaagtctacataatttctctctagatttgattctcaaacacaattctactttttgaaatcctggatcacttattttcagattaaaataaatggaaaacaccaattatttaaaaaaaataatggtcatgttttgaagttaaatacctaagaggaattgtagttgcaaattacactgaatccttagtcacagaatctggatttgacatagccttgccgtttactattctctttactttttaactaacaattcacttcctctttatgtaggtttcaatataatgaaacctacctcataggtttcattacatatgtaagtgatgtagttattaaactaaatgagatgacatatgtgaaaggccttggtaaagtactatacaaagtaacatgctagtattatttcagccagatttagacaatttttagtataagatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaaggtttattttggtttcaattgatacataataagtgtacatatttatggggtacggtgtgatgttttgttacatatatacattgtataattatcaaagggtaattatcatatccatcacctgaaacacttgtcatttatttgtgctgagaacattcaatcctcttttctagctattttgaagtatacaatacattattattgactatagccaagctactttgcaatagaatactagaatttattcctcctagctaactgtaactttgtacccattgactaacctcccctcatccaccttcccactctcccagccgctggtaatcactattctactctctacttctatgaggtcaacttttctagattccacatatgagtgagatcatgcagtactcttccttctgtgct

SEQ ID NO: 112184 - DNA, 1049 bp, Homo sapiens
aaccactttcctattaacatggataattgaaaggtgactctgttatgcatgtgtgtataaactgcagctcaaaactgcccattgaattaaacaactaatgtctatcaaatttcaaattgacaaatatattgggtaatttatctaacttgctttaatattcttagtatattcaaattgaatcttaaggaaaataaatttactctttgcttagcaaatatatgaatgatcctaataaaaagaatagttgtcaaataaactattttattaggaaagaaaactttcctaaaggcaaaatcttagctttgatatgcattaattagatgcttattagatattagatatctacaaaataccttaaataaattgcaagcagattaatgtttcaaataacaggcattaataaacatcttctgtaatgctaaacttatccgaggaaacctagtatttctgatatttagtaaatacatgttttatttatgagcaagttttagactgccaattagctggaaaacttgctaatgaaatttcatcagaagagaatccaggcaatgccttctttcatctcttcaaggcatgatgggcctctgattgaaaatgagaacttacctcttgtttaaagtcattggtttcttcagaggacacagcattctgaagaaggaatggcacgtgttagtgcgcatcacacatgcctagcttttttattcaaaagttaacctttttaatccaaagcagtttttatttttcagcctcatctgtggatggcttaacacagagagaagccaacatggcagatcagtcaatgtcctaagcacatgtttgccagcaggcaggcaggattcatctgagcagcccaaatggcctgagtgtggctatctttcatcactgtagtttaattatgagaagtttaaaaatacctgtggggctaggagattctgcttctgagatgggtcagggtttagccatgtggccacagcatctgggtatttgttgtaaagctacaaaaaagttgcatgtttatcattattaaaaaaagaaatgtagggatgaat

SEQ ID NO: 112185 - DNA, 1048 bp, Homo sapiens
aacagagttctttgaaatactgtgtgcagctcttctcttcatcaactctagtttattcactagtactgtttgggtatagttgtattttaaaaaaactttaaatccaattttcactagcccagatttttccaaagcttatcacaattttttttcaaataccttttgatgccaacatgaatgaggcttccagcattcccagatctaccagactttgcagagtacctgttttatgtccccttcgtacaatcttagatatgattaggatgctaaagaagttgtttatgcctgcaagaagcttgtaactagcttgctatacatggataaaacatttaaccaataagagctttatgacattcttctgggaagttttttttgttttgttttattttaaataaagattctggagtctaacttctagggattctgattcattatgtctcagctaggtcctaggaatctgtattttaagagagtagatcaaagagacagagaaagactaggttctcaggacatcatttgaacccctgagttagaactaattgaagctagatccacccctggactccatgagccaaaaaatatccttttaaaaaattaaaaaaattatttcaactttacccttgcccctttccctccctccctcctcttgtattccccactgtctattgttgccatctttatccatgggcacccaaaggttagctcccacttataagtgagaacatgtggtatttggctttcagttactatgttaatttgtttaggttaatggcctccagctgcatccatgttgctgcacaggacatgattttattctttttcatagcttcatagtatttcatagtgtatagtaccatgttttaaaaaatccaatccatcattgatgggcacctagattgactctatgtctttgctattatgaatagtgctgcaatgaatatacaggtacacatgtctttgtaatattatttacagcattcccatcagcaataaataagagttctttttccacatcctcaacagcagtagcattatcagtgttttggat

SEQ ID NO: 112186 - DNA, 1069 bp, Homo sapiens
agttatccaccagccacttctgcctcgattcaccaaagggcagggaaagaaccttttggtgagatggtgtgaattagcgacatccagcctgagctgaagtctccagcgggtcaaagaaatctttccatttgcaaactaccaaggctgacttgctgtgcatttggcgggcctcctgcccctgattctgctggtttggagatgctttctcgctctttggttggcttctgtctccacacattgtggggatcccagggattcgtcataggactctcggatcgctggtgcctccactgtgatctccggtctccctgcggccagcactgacttctagcaacagaatcctgcatgagggcctaggcacagaactttatttccactcttctgaacacatctaatgtgatgctctgcaattgtctgaaatttatcctaccctaagtcattatcttgtccccttctctggaacctgcttcacttcccgtatcccaaggtgaggtttggggcttcgctgtcctcctcacttcccaggccactcttcttcatggaagcctcgcggtttaccctccaccgcctacaccttatcttcttgttacttttgccccacagatatcaccctgatatgatctctgtttctcactcctgctggcttgatcttatgtcttgcattattccgcattagaacaattgatccctgtcaactcccatctctattctccacgtcggtgtcctcactatttccaggttatattgcagaaccaaagctgcttatttgtcacgttgatgcttagacacctctgtgggcttctggcagctgaaaggataaaatttaatttctgtggtttggtttagtaaattctcataatctgctcctgtatttgtttgttagggctgccataacaaagtaccagagactgggtggcttaacagaaatttatttgctcaccttgtctctacaaaaaatacaaaaattagccaggctttgcggtgtgtgcctttggtcccagctattagggacgctgaggtgggaggatcgcttgagcccgggaggcagaggatgtagtgagccaagatc

SEQ ID NO: 112187 - DNA, 2353 bp, Homo sapiens
ccagtgcccagtaagaggacatgaattttctagtaccagaggaaattctctttttacaaattttgtcagaggtatccttgggaaagtatttcatttgcttttaccctccaaattattttaatctatatttttaagagtttccattctcagttgagtttttcttgttcttctccttctgtcagttttgaaagtcttgcacaaaaacaatccaggtgttgttacagcagtgtgattaaaaccaggtcaggcctacactgaaatcccagttccaccactcattagctgtacgaccttgagcaagttacttatcctctctgatacccaatttttggattttttttttttttaaagagatgatcataacgcttaggacttgactctttgggagaattaagtgagttaagacataaaatgtgcagcatgtatttgtcatgttattagcgcttcagaaatataaatgtaaacattttggtacttcgtttatggagattcttatactagttaattttattaaaagcatgatggggaacagaagatccttttcggataacctgtgtgagtaaattaataaaacactaacactttttaagattcaaaactggattaattatgttattttacaccatttaaaatgtgcatttaaaaaatattcactgaagtgagagagaagttccttttaagttaataaataatggtaagttgcatgatccttttaactcagtttaagcatttgataacacccctaaccttgtttgaataaactcaataacagaatatagagaaataaaatatatatttcatatgagtatgtatgtaaatttatttcttttaaaggaaaatttcaggaaacaaaatgaataagctcatagtcataaaacctctagccaaagtgtgtcaatggtctgatttgtaggagagcagactcaggaatcgggaattttttttttttttttaagagtcggggtttcactctgtcactgaggctggagtgcggggaagcaaacgtagctcactgcggcctcaaactcctgggctcaagctgccctcccacctcagcttcccaagtagttgggattacaggtgcaagctgctgctcctagctgaaaagttttaattatataaaatgtttaaataaattgttattcctttcttttatgaagaaatataattgatattcttgtcacttattaaataagcaacattttaaaatgtttagcacctactgtgaagatagcactgtgctagctgctatgaataaactagaatagcatatcactgttttcctatggacaaaaacccagaaatgtaaaataaatagccatgaatgggttgagattccccctgccccctttggatactgatgacagaaatcttatatgcactatgtaagcagtgccctaggatcagaacagaaagtaacttgcaatttttaaaggtgggagaaatgactgaagtttggagtggtcaggagtttccctggaagtctcttgcctttgtgactttgtatagctccctcaaactacctgagcctgagctcctcatttataaaatggaagaattgaacctagcttccaaggtcctttctagcttcaccatgctctggtctgttgtttaatgacatgaatccaagatggacaacaaatggtcgattttgctccttctacagtaaatagatctatcttcttagcagaagtaaaatagtaaagaaagaagacatgtttgaggcctgttgaggcctgtttgctgtatgcattgtatctaatcaaggaattgagaatgtagccctaaatattaggaaggagttgaaagtttctgagcaggaacagaacatgctgaaaggaaattgtgtcagcagcatggtgtacaggagagcttggcagagagaaaggaggcaagaagacctgtgggaggcagccagtaaggaggtgaagagggcctggaccaaaggaagccaaggatgaccgaaagatttaaagatgaagcccagatttaaaagtatcctcaagtatttgtttattcttttcttagcaaattctttttagtacaaagataaaatatggcactctgagtcataaaattttctgaatttcagaagttgaatgtttttctgaatgtatcaacctgttaaagtcagttcctgtttgttattttaggcgtatattcttgggcttttttttttttttcctagagaaactatgaagtactagctgtgcaagtcagggtgggctaagctgctaaaacagatacctccctccccttcaataccctgaagaacaagaagttaattttttgctcgtgtaacattttagagagggtattccaggttgaatacctggaataatgaatgaaataa

SEQ ID NO: 112188 - DNA, 1052 bp, Homo sapiens
gctcgggcggtaatgctcacttgcctgcggctcacctcctgctgtggggcccggttcctaacaggccatggaccagtacccgtctgcagcctggggactggggaccctgctttagatgatgtactctggctttgcattctggcattagctaagcaccctcttaaaggaaattgggtctatactctcagtccgtgttctccctaacacctggaaacattgaataccttcaatgctgggaagttaactcccaccacaactagaacagctatgggaaagacaacagttgattttgaagagtgtcaccaatttgcacatgattccatccttaaccattcttatcctatcagctctgccaaacatggagaatagttggctgcaggacagctatttttcctacttgtagatgcaactatttctcacccaccaggatgtaaaaggtccctgtaccctaagattggtcctacatacacacccaatgggaaaatgagatgaaaaatttaaagcagtaaatatttgaggaagtagatagagtaatttagaaaaagaaaatacacagggccaagcacagtggctcacatctgtaatcccagcactttgagaggccaaggtgagaggattgcttgagctcaggagtttgaggccagcctaggcaatgtagtgagaccccacctctacaaaaaattaaaaacttagttgggcttggtagtatgtacctgtagtttaagaaacttgggaggctgagctgaggcaggaggattgtttgagcccgggtggtcaaggctgcagtgggccatgattgtgccagagtactccagcctgggtgatagagtgagactctgtctcaaacaaaaaaaaaaacagagacagaaaaaaagaaagaaaatatatggatgtatatcatataaaaatataaataagggaggccaagtgcagtggcatgcctgtaatcccagcactttgggaggctgaagcaggaggatcacttgaggccgagaattcgagaccagcctgggcaacgtattgagacctcatctctgcaaaaaatcaaaaaa

SEQ ID NO: 112189 - DNA, 1037 bp, Homo sapiens
tgcctcaagataaataaattcatacatacatacatacatacgtacatacatacatacataagaagacttgtttctttccatttgcaatgtttcattcaaaggctagaattaaattgccgtaggccatcacaagtttagcttgaatattattattttttcaagatggagtctcactctgtcacccaggctggagtgcagtggtgtgattttggctcactgcaacctctgtctcccgggttcaaccgattcttctgcctcagcctcccatgtagctgggattacaggcgcccgccaccacacctggctaagttttgtatttttagtagagacagggtttcaccatgttggccagactggtcttgaactcctgacctcaagtgatctacccgcctcaccctcccaaagtgctgggattataggcttgagccactgcacccagcctagcttgaagaaaatttgataggagtttgtttttttctatttataggccaagcaataccacgtataaatattaagaatcatggctgttccttagtgcctagttgtttataaaccatgggaaagaatgaaatcattgaccaaatgagacagggtaacagtcttccctgggagtaaagagactagcagtctctattgacatatattttaggcctggcctccaaaataaatttacccaaagaagtgatgtatttgtgtccagggctaccgagcctaatctttggctgcctctgtgttattctaagttgtaattttccatgtcatctaaatttgtaataattctttaatatgatagtgtttcagtgaacaaacattctgcttgctgcatttcttctgagtgagtaattccctgacaactaccagatcttggcagaagcaaagttggtcataagttatgctccactctcagtgctggtgaaacgtatgatgcgtaacacagtgtttttgaattcagtgctgattttcctaaaggacatttggaaggaaaaaagaaaaggaaaggaaatacccaaattcaggaatagaacttacatattatt

SEQ ID NO: 112190 - DNA, 1231 bp, Homo sapiens
tcggccaggcacgatggctcacacctgtaatctcagcactttcggaggccgaggtgggcagatcgtttgagcccagcactttggccgatactgtggtttactgtattttgttctagtttattttatggaaaatgggaattcagtggttaagacaaggattaaatagcagaagaaagatgtgtacatatgtacagatgtatgtgtcctttatatgttttttagtactcttgtctcctttctggtcctcatttaaggttatctatttcatgcagtaaatttttcttcacaattcatttcatttagagagtgaatgctaccttccaagtgggctttctccagttttcctttcagggacttaaaggagaagtgatgttaacagttttatatttccattgcattttacagtgtgcagatgtcttcacatatatttccccatttgagctttacaaaagcccttagtattattctcattgtctagattccaaaatcaggcttagaggagttaaatagttgtccaggatctcaagatgcaagacccacaatcatgaacagaggcagatgttcaggatggaggcaagctgaaactcaaaaccaaatcattatgactccaaattcaggagtcttttagctgccacctgcatgggctcttggtgtagctgaccaccagagtttgtagagctgtcattcaggtgtgccatggactttcctgggacctggcacaggagaaggactgagttaatgtttgctgattaaatatctgttacaggctgggcgcggtggctcacgaccgtaatcccagcactttgggaggccgagcagggaggatcacttgagctcacaagtttgagaccagcctgggcagcatggcgaaaccccgtctctacaaaaaatttgaaaattagctggccatggtgatgcatgcctgtagtcccaggtactcaggaagctgaggtgggaggatcacatgagcccatgagattgaagctgcagtgagctgagatggtgccactgcactccagccttggccatagagccagaccttatctcaaaaaaaaaaaaaaaaagttacaataatcttcccttcaaagctggaaggcattatttacctgtctgtccagcagatggtgctacataaccaagggaatctgttgcttgcccttggtgaagctattaaagccaatacagatcttgagaatttcaaaagcaaaaatcaatactggattatgagtgc

SEQ ID NO: 112191 - DNA, 1034 bp, Homo sapiens
aatgtatagaacatgtttccttccccttgaaactttttatcagctaattataggaattatattatacctgcaatcattaaagtccagaatgagacagtacttggtaaagtgctgaaatttataataaatgcattatagcaatccagttaaggaggaagagccaccattattgaacatttgttaagtgtcagccattgtactagataaattttagttattatttttatttaggcaccaaaaaatccatgggatagttggttatccccatcttactgaagaggaaactgaagctcagaaagtttaagcaacttgcacaggtcacatagcaagtaaggagcatggccaggaatcagaccctgatctcctttggtctactaagcttgcaaaggatcttcccgcctccttccaagaccattcaatattatcagtaaatgtccatggcaaggatgtagttcgagttatagggttccattcaagatatgattggtaggtgggaagcagatatgtctgtgtcaatcagtatcctggaagaaggagatgatgaactcaagtggtgattaagggaagtttaatgaagggactatttacagagatgtggtggggttaagagaaccaacaaggggaagtgatgcactcaaaaagttactacctccaggctttaggggattgggggagggagtggcacagtgtgaacccagtgtggttgtgagaaaagggattccctcagcagccatggccaaggttagagtctccactgccaaactgcatccaggtggtgagggaatggagaataggggtggggtaacaaactctgacctcggtatccccaaagggcaaaggattccaggtggtacagttcgtaaagattagcctcagggcacagaacagggcagagaagaatggagaattgatctggaggaaacaaacaatggcttgcccatgttattgcagggagagtaggctggtgtgcacagcaggagggtggggagcccagcatatagctgtgttggggcctgtgcagatcagcctcactg

SEQ ID NO: 112192 - DNA, 1055 bp, Homo sapiens
ttcatagagttgccaaatgcttggttatgcaaacgatgcaggcaggggcaagacagcggctgagcttggaactttttcagagatgtttcctttgcttttagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcgtaagtgtctgtgactcattgccactcggtgatattcattcatttattctctgaactcccaccattcattcattcattccctgacaccttcaccaaggcaaaaataagttcagtgactcttcagtgcttatatttaaaccttggccaacttgacctttgacttcttaagttttcactacttcttagccttcttttagtttctacatgcatatttttcagaagactaaatcgttgaccatataacccctcaaaaattaattatctgagcgtttgaaaatttcatttaagatgccctgggccctgtttttacaggtgcagtaacatcatccactaagttatttaacacaagttttctggttcaggaactctttttataggtcttgcaaacaggtttttgttcagaatggagttatttaatgtgtaagcttgtgaggcaattttttgttaggtttaaagcccattttgttcaaatgtttgagattttaggtatatatttgtacacgtgcatatttacaggggctttttgtacactttggtactcctacttcaaacatcttgtgtattaagggaggtcacttactattttagaagtattgtagttattataaagaaacaagaagacctccaaggccgtttcagggtgggcctttgcggttgctgtccctgggtacgtcactggtcggagtcatcttctaagctttgc

SEQ ID NO: 112193 - DNA, 1200 bp, Homo sapiens
aaagccttttctaatccatccctccactgccagatccccaaataaggacagctttcctctgatctgccagccttatttcttttctcttttgcttcttattattatccaccttgtattttacttgtttaattataactcttatttccctacttgttataaatttgggagggaaaggacctttatatccccattagtgctgaagaagcatctgttttctaagagatcctctgaatatttgtggatgaaattcccaaatgctgacaatgccacttgatgaacttgtccctcttttggctgtaattttctctggggacctcaagtcgtctagtccctgagcacagttacccagagaaggcagccgtataaactgagcagaggctctagagcagagcagaggctctagggacaaacagccctggcattggttcccgagtctgccctcaaaagctttgggactacattgacctcactaagcctcagggccctcattcctaaagaggctaataacagtatgagaattaaccaagaaaacatgaactgccaggtcaggcacagtacccagcttgataggccttaatacatactttattttacaaggaaccagctgtccttgtaattgcctcaagtgttccactgattgtaactgtttgttttttggttttgtttttaatcagttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggtgtgtactgaggacatgcatccctcctatttctgtgtggttgtacatacatcctattctggggttagccagaaaaacctttgcctgcagttagctacatgaggatgccaaggacccagacggatagcaagggaggggtaaaaactgaaggcttaccgaaataaaggatatttgaggaagggagttgggatcctagaatattacgagttggaaagaaccataactctggtccaagttcatctcaatgctggaacctttccagaaaaagtattgtgtttttctaacatctgtctttacccat

SEQ ID NO: 112194 - DNA, 1361 bp, Homo sapiens
ccaggcatggtggctccttcctgtaattccagcactctgaaaggcccaggcaggaggatcatttgagcccaggagtttgagaccaacctgggcaaaagggcaagactcagtctctgccaaaaaaaaaaaaattagttgggcatggtgctgcacacttacattcccagctactcaggaggctaaggcaggagaatcccttgagccctggaatttgaggcagcagtgagctatgattgcaacactgcactccagcctgggcaacaaagcgagtccctgtctcttaaaaaaataataacagaagtcctagaaaagtttgtgtgttgatttacttttacattaaaagtatatggcatgttgagcagcgtaaatatagaaaagtgtagggaagactgagcaggaagtactcctttgggactgaaagacctcaggaagtcttattcctttgatggcacaaaattctccaagtatggaattattagctatgataaaaatgttttgccgctagtttggggggactcatggtagcagtttcattaccttgtaatgcatgaacagaacagatggacatccattcctggctgtattcatgtgttgttgttgttattgttttaattgttcttatttacatgcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtggtaggtttgagaacaacaccaaatttcctattctattctacaagcatgttaactagagtctttgatctcctcagcattgtggatcttgatattcccaaaaaagaatctaaaagtccccctcaattatatcaacttctgttactaattattttctcattttgcatgagtaactttgctgagtatgaagtggagaggtatttacagtatgctctcagccacgctaataacaagagtatctcagtaattcatatttggctttagtatgccgtatgagatgtggaggagaaaacagttttttttctttgtttttttttccactaatgatatttttcttcaactgctggtaaaaatcaatttatattttcctgcacatgtgtgaagttacagcaataaaaaaacttgtcggccaggtgtggtagctcatgcctgtaatcccagcacttggggaggccaaggcaggaggatcacttaagccccagagttcaagcccagccagggta

SEQ ID NO: 112195 - DNA, 1287 bp, Homo sapiens
tctgcagagtacaaatgtaagttatattcatcaaagttttctgtatgaggtataagaaatcaaaggcaggccatgcacagtggctcatacctataatccctgcactttagggaactgaggtgggaggatcacttgagatcaggagtttgataccagcctgggcaacatagtgagaccccatctctaaaaaataaaaataaaaaataaatcaaaggcagagtcataatcaagaccatgacaccatgtaaattctgtgtctgctcttgactctattataacttctaagatttttttcaagatgttttcccttcatccttatcacttaattaagcatccgtcacttccttcctgtggtttcagtgtataaaagaatttttacaagcttttctcccttcagcaataacaggtaacatttcgctaagtccagttgtacatttaagcatataacaacatgcttaattattagatgcttacaagctttgcttggcataggtgtaccatgtattattctatgtctttccttcccactgtcctatgatagccattaccttctgaaatctcagtaaatgatgcactaccctattagcattctctcttctgttagccctccttatgagagttattctttccctcatcccactcctaaaaattcatttggcctttgtggagtatttagatcaagtcattattaaactattccccactagaattattaatagttgataaaatatggaaaatatattattcatatgtgagtgaaagaacacttaaagcataaaaaagaactacatggccatatattgcatggcaataactatattagcagcaataataattgtaatagtaataataataatggctaacactttagaagcttctgtgttaggcatttccgggtgcttttcatggtacagaagctcatttgttcctcatactaaccctcttcactactctgccactgcctctcaagccatggatatgtgcactttagagtttttacttaaagtaaaaattcctgtagaatagatggtgttgaccccatcagaccgtgatgcagttagaagtgcatcccgtcttttacgatggccatacaacatcacacaaatcaaggtaaacccttgatccccaaattctcaatgtattaataatgaacagagttacacaagaattttagcatttaaggaaacaggagagacgataatactggaaataatttttcagaatatttctgttcggattgatggcagagtgcaggccatatacattgacaattattccagaacacaa

SEQ ID NO: 112196 - DNA, 2058 bp, Homo sapiens
acagtgctgtatacatagacatctactatatttttgttaaacagagcaaagaatggctggcaattggagaatgcagagaaaccgaaaaattttaaatttaaaaatcacaaataaaaacagcaggatgaaggcaagaaagcaaaagggtggaaagtgattaaaatgaaggtggcagaaaaaacagaaagcattcctctttgagtttgagtctgttatagtgtgatctcttctgtgtatgcatgtatgtgtgtgtaatgtatatgtgcacacacatgcatgcatgccttcgttgagtttctattccgaactaaggaaatgcaagcaatatactgttttacttattttatggcagggcttaacactttccatttgagtgagtgacttttaagaatgacatcgggtaagtataatggtgagcccttataattaatacattggtgaagaaaaatatactagtcatattaaggtaagtttcatatttctaaaacactgtaataaaatataaatattttgcttttcagctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaaggtaatttataaatttcatgttctacattttaaataatattttctttaaaaaaaatgagttccacaaaatcatggaatacttgaatttgaaattcaagtgaccagccaaagctgctcaatatttactttgagacagggtctcactctgtcacccaggctggagtgcagtggtatgattacagctcattgcagcctcgacttcccaggcccaagcgatcctcccaccttatcctccgaagtcactgggactacaggcatgtgccaccatacccggctaatttttaaattttttcgtagagacaaggtctcattatgttgcccaggctggttttgaactcctgggttcaagcaatcctcccacctcagcctcccaaagtgctgggattacaggcatgagccaccgtgccaggcctcatattttacatataaagtaaactattgagactcatgtgatcattcctctcactgtcaatgacatacttctgctatctgaattagtgcaagatcagtccctataggttttgtttaacaaatgcagtaagaggcctttcagtgtgttagctgggcctggggccccaggctgctaacagatgagatgaacaggtgaaggaaaaggaacttagagaaagagagggaaggagcaggtggagggaaggggagagttgctgcacttggaaatgcttgctagaagggatcgcctcttttccaggtagaggctgtaagggaagctttacctagaattaaggttggaacagacactgcttccaaatagttccttgctcactattttccttattgtcccaagatataatgtgcatttccatgtgtgtgaaaggttatgacatttcatatacaacaagcctcaattctggagatgcaggaaatttcaataattctcaggcagcagctgccattcggtcaccagcacaggctctgattgtgctgtccagacagtaagtactagccacatgtgcctatttaaattcaaatttaaattagttaagcttaaatacaattaaaaacgcagttccttggtcctactggccacacattaagtgttcaatggctactgtctaggacagtggaaatgtagaacatttccatcatcacagaacgttctcttgaaaagcactgttctggaaggtacttacccgttatgtacttttctgagttggtattcatacctagaagacctgaggtttatcacaagacatagacttggaccaggcgcagtggctcatgcctgtaattccagcattttgggaggccgagataggtcccctgagcccaggagtctgataccagcctgggcaacatggcaaaacctcatctctactaaaaatacaaaaattagctgggggtggtggcac

SEQ ID NO: 112197 - DNA, 1039 bp, Homo sapiens
agtgccgggattatagatgtgagccactgcactcagcctttttttttttttttttaattgtagatagcataaaacctactgttttaaccatgcttaagtgtacaattcagtggcattaagtacattcacagtgttgtgcagccatcgccattatgctgcattattttcagaactttttcattattctaaactgaaactttgtatccattgaacactaactcccaattcccccagtccctggtaacctccattctactttctgtcactgtgagtttgactattctaagtacctaatttaagtggaatcatacagtatttgtccttttgtgtcaggcttatttcactttgcatgatgttttcaaggttcatccatgttgtaacctgtcagaatttaatttcttttcaggatgaaataatgttttattatatacagtcacaccattttgtttatccattcatctattgatgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatgtaagtatatatgaaattaagaagaaaaatttaatcagagttgtcactgcttctcaagaataaatcttcatatgaggttgctatatgaccaccaattatttaaaaccagttattttaagtaagaattaattaccttttcccaaaacattgatctacccatgcaaagaagacaatgcatcctgaaatgctgatgcttaagatagcagcccaaagtagtaaaatacagttaacagacataggaaaccaacactgttctgaagactgagtttttctttgcaccaaatgcagatggtagcttctagaaggctgtttgcctatattcttactcctgttgaatattgttgccatatatttagaacttcaagttatttt

SEQ ID NO: 112198 - DNA, 2136 bp, Homo sapiens
tgtagcatgaaagcattttattattattgcagaaggctttaattgctgatacaagtagcaagactttgtaaatgggattgacaattttctgttattcggcagctacctatactgctaaaaggtccaaaaataatgaaatcatctttaagaaatgttgcatcaactagtggacattctttgtttttgtattgtggtgttttgttttatttttatagcttcactcaattccgtatcattttgggcgatatcaactttgcagagattgaggaagctaatcgagttttgggaccaatttatttcactacatttgtgttctttatgttcttcattcttttggtatgtacatttttatttatagtgaggttcaatttaaacttcgtaaatccttgtcttctcttttctctcacactttatgtcctatcaattttaaataaagacccaggaagtagaaaaaagtgtggatgttggaaaacttattttccttttattaattcacagttttgagactcatatcaaatgtcttttctgtggtctttcattgatccatgtatatgtgtctattcaatgcaaaaaaaattagatctcttccatggtctttcatttctctctctatatatgtatctattccatgcaaaaaagaaattagatcaagtacaaatttataaagatacctaaaatagtgctttgcctaaaaagtagaatatgcttacatgctttttaaactcatatgtcagcactttcgtagtcacttgctagcatgacttttctctctttcttcttttctttttaaaaaataagaacggaaaagcaagctagatctaagatgtcgagtaatagttgagtgaatcattgcatgtcaaaattaggatattctgttttaaattatttatatcccattcatctagagactgcctacagagaatattcaaataattaagtttaaaactaaatgtaacaatgaatggaaattgcattaaaattattttcaaaaataatttttttattctcttgatttggtacaaatgaacatttttaatgtttttgccctaagtcaattaagtttttttaaggtgttttgttctttttcttaacatttatatattcaattgtctactgagaaggtgttaagccagcttaatttaggcaatatttttcatctaaacactaacagtcatcttaagaacaattttcttaagaaaataacattttttccatttcagtaaattgtgtaaagatcccttgaggaaggttaagtgatcacattttcagtaattcagtgtaataactctaaagtcagtccaggtattactggttaagtatatggtatttattgattgggtattagatgtactgtattaatttcctgtttaaaaaaaattttttttccggggagacacagcctctggtgtaaaacaaaggtgtgttccctagctgtactttaacaggactgaaaaggtcaggaatatcattcaagttcatatgtatcttgctgtatgcatggtttatggctcatttttaaacttacacctcttaagcttcttcttcctatcatatattaaaacaatggagagaagaataagcctctgttactctaccattgatagtacttcggattctagagtacctgaatctctactaagaaggcaaaaaccaggaattgagagtcctgcacctgacccttcagttgatctcaggccacctagttttctccgtttatcaatctgccaaacaaggatggatagagtcgtggcaactggaaaggctcaaatgtggaattgtttgaatgtggtcctttagtaggcagccatcttaccagatctagagtattcagtcatcttaccagatcagtcaccagaacatgaaaagaagctcttagtttctatctttatactaaaattgtttttttgtacgactgcacaaaaaagaattgctctccttgcacctcccagagatataggtggatagatacatacatacgtacatacatacatacatacatacatacatacatacatagacacatacatagatagaagtctactttcaatacaaacctgtcttttaaggaaatgacaagctgagcatagggttggccacctttctgagccgattgcctggtattagtttattgcccct

SEQ ID NO: 112199 - DNA, 1443 bp, Homo sapiens
tctcaaaaaaagggaaaatcctcatctacatttcactgggttttttgtttgtttgtttgtttgtttatacacacttaaggaaattactgtctagaagatagataatataaaaaataaaaatgcaattcatgattcgggtttcttggtattcctaagaactgttgcacagtactttatgctctgaggcagacagctatagcatatatagtaatttttgtttctatcacataaacttgaatacacatatgagtaaaagacctttagttcttcatgacttactgaaagaccctgactttttccatgtaactgttccacaagtgttttatggaaaactggatacattaattcttcattcatccagcacgtacttgttgaatggccaatgtacaccaggtttgtagtagttactactgtgaatggaaagtaaaacagatgcaaaaggagaatacactaaaccaagtcttttattttttctctctctgatagggctaccataaagctttggtcaaactaaaactgaaaaaaaataccgtggatgacatttcagagagtctgcggcaaggaggaggcaagttaaactttgacgaacttcgacaagatctcaaagggtgagaatcatgcttcctgaggttctgaaaaattcctgcttctaaagataaattcctggtgataagagtatttctagcccaagggctcatacagatactttttttttttttttccagaggcaggtatctttctggaacatgttataagaggaaaacttgcccccatttggtgatttctcctttcctcctgcattttgatgtctctgtgttgagggtgaactgggtacaaggaatgatttttatctgtatcctctctctaatttcaggaagggccatactgatgcagagattgaggcaatattcacaaagtacgaccaagatggagaccaagaactgaccgaacatgaacatcagcagatgagagacgacttggagaaagagagggtgggtctggtttaggagaaccggatttgatttggtacctacaacaccacagatgtatcaaacactatagaagtagtgggttattgagtctcttgcccattccccaccacactctctctctctctcagtcggtttatgtgttagtaccctgtttattccagaaagaatatataacacaattatgtataaaaatgggtggttagcatgatataaaaacgtcaaaatgaaaagcaagcaaaacaaaagtaaaaataatggattattaatgaagcttaaaaatgcattcataaaaacacatatgcttattaagattgggctacaaattgggccctaagcttgctggtaatcagcttgaaaagagaagcctgattagctgcagagtccacaatgtccgtgagagtgaagaaaacaaaaaatgacttaccaagagatgtgaaattattctggttag

SEQ ID NO: 112200 - DNA, 1458 bp, Homo sapiens
cctacccccccatcaattgtttgatgtagccatttttcaatgatccgcgattaagaagcagcactcttttatagccaaaaattacacatatataaaattttcctttagaaaatgttctaaaaatggaatgtctaactaaagggttaggcatacattcttaagacttctgatacgcgctgacttgcaggaaagttgtttcagttaacactcctaccagcggcatccgagagttaatctgtaaagcttgagacaacttagaaagtgtttcaaatgattgtgttgcttaagaaaaaaatcttagcacttccttttgaaaagccagtggggctgaaaagacaatgacaagcactttgtccctctgtactgtgttttccttgcagcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggtcagtagtcatgagctgaaaacaccgctgctgagcatggtgttattaatgaaaatatatgttgctgacagttgtatttgaagtattgaagaagagtaaaaaaaatttacgtttatagaaattcacaatgatgtttccatttactctcattttcagatttttttctctgaaacagaaacactctttctataaaatctcttgctataaaacatcaatgtagtcatattgtctaacccttaggctgagatgtttatctttctccataactacagataaaattataatctggaggtgttactttcttaatactccatatgctaatggtcctgccttcactgcagggtagaattaagtgaaaaattactccagcaactctgagatttgctattatatgctgtaaatctccagccttaccaaactacagattatttggtccctggacttcctaaggcatttccttctactgcccccaacaccagtttctttttccctttttaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcat

SEQ ID NO: 112201 - DNA, 1020 bp, Homo sapiens
aaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaagg

SEQ ID NO: 112202 - DNA, 1053 bp, Homo sapiens
atgtatgtttttggaattgctgaattcccaagagttgcacaaaaatggtatcaggcagtaactgtggctgtccaaggtctttttagtacaagatgatttcctaacctgtggcaaggagttcatcctactctactctagctgccacttaaggcttaaacctgatagctgagtctgctgggaatgtcttgtacctgagtatctgtgatgctcctcacagtcttggtgcaagagctgacagaacatgactttggcaggaaacccatgcacacctcttttcctggttttggaattcttaacctgtgttgttttttatggctatttgtaagcgtaaagagtactgtaagagctttgatcatcttagtaagggtcacaggtgtcatctgtttaagcagatattttctttatcagggataagggaactattacttgataaatatttctgccctttggagagagcagcattacagatttggaaaccaataaatttgagtaggctaaaaacttggtgattcaaagtatgactctgtaaacctggtcaagttccttaaacgttagtcccctcatcttttaagtgtgtacaatgtctatcacattggattgttttaggaattaactaagttaggtccatgttgtttgttagtgtctagcaaaattgtaaacacacaatgactgttagctatgatatctgaaggggtaattattaaaggcttggttcaattttaggctcctttaaggaacagtggatatactgagtaacatttgacggatgctaggaatgaagttatattctttttctgtttaatttcagatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttg

SEQ ID NO: 112203 - DNA, 1050 bp, Homo sapiens
acaaccactgtgaggtcatggcatcccgatcgtcccagtcccttcactcacaaagttacagcacacaatgagtaatgtgaggatgtatgggcaaatgaatgtgctattgatgagtttcctgtgaaaagagaaggcagttgaattttggttagttgtactgcctgtagctcttcatctcaggaactcagaaattgtctgtaattatacataatggcacataagtgttataagagaactttatgcagttacatggacagacacaacattggagaccgagggtggttggagagtggatgactttttttcattctaatattagtttctcaaaatattagtgttaaatttgcacaataagcaatcccaaacatacggtgacctaggcagttgggttaactacttcttctctttctgactaaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatggtgagtctgaactgtgtttgctctgataaggaattgtttttttccttcatttcttcctgcacattcacttgtcatgtaaaacctgttttgaggattctgtaaatggggctctgctttacttaaggccatctactggaatagattatgttagagaatatactaactttcctctttgcccttatccaaccttttttgctactgttctaatgaagttccaataattttagttaatattgttactaatgagcttttaaaaggcgtttctttgtgacctattatgaaaccttaataaattggaatttcaaaaatcagaagacatttgatcggcagattctcttgagaattacagattatttgcccgactttcatgctggcattagagaactgctagtttattttttttttaacatttttaatttatgttttaaagttcccacatacagcattgaactgctagcttgtttacccaccagcagag

SEQ ID NO: 112204 - DNA, 1025 bp, Homo sapiens
gggattacaggagtgagccactgtgcctggcctgttatacttttctaatgacagagctaataattttttatttctattttttcttttttgagatggagtcttgctctcttgcacaggctggagtgcagtggtgtgatctcagctcactgcaacctccacctccctggttcaagcgattctcttgcctcagcctcctgagtggctgggattacaggcacgcaccaccacgccaggctaattttttttgtattttcagtagagacagggtttcaccatgttggtcaggctggtctcgaactcctgacctcgtaatccacccgcctcagcctcccaaagtgctgagattacagtcatgagccgccgtgcctggcctattttttctttctaaagctttagaatgaaggtgttagggaagcatccaagaaagggttcacagaaaaaatgggctaaatttgttgttatcttgtttgtgtttcctttttatccactgattgcaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcaggtaaccagcagattcttttgaaatactcaaatgggaacaatgtggttctgttatcatctgcttcaggatatgtttatcttctacccacccttccaattatttgttatcttcactccacctgggatatagaaccagtcagcagaacaaataaaggacaattaagttttacttttggaaagcttccctttttttgagacagagtctcactctgttgcccaggctggagtgtggtggcatgaactcagctcactgcagccctgacctccctgggctca

SEQ ID NO: 112205 - DNA, 1047 bp, Homo sapiens
tgagggtaataataataatattggaactgcctcatgacaatattgtgaaaattgaaatgaagttatctctaaattatttagcaaagacatagtaagtactcagttatgttaattgcattattagggcagaagagtgaaaaccaatttttaaagagccagaagacctaaatgataagtcagaatgagatatatgaccattgttttaatatgcagtccatagttagttctcaaacttgtaaatacttgcagattacctgggttgcttcttaaaatatggattccctagacctactgccagagattctaattcaatgtctgggaagactgtcctagaatctgcatttttaataactattctagttgattctagattgtcaatacaacacactgaaaattcctattctgttttaataaaagcattgaatttaggtttgctaactatagctaaataatatgagatgaaaagttagtaagacaaagtcaggctgaactagagcaaacaatctaaaggcaagaatagagtattttactgagaaatacaagtttcagatatttaatgacttagtattgtctcacttttaacttaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggtatggttgacttttttatgctgtaaaatgcttcattaatagaatcctgaaggagagcaaagggggtctgcaggagtgctgtttggtctttgggtagacataccatgagaatctatcacttcaaaatgtgtttgttccatttggtgctagtatttttcttcatttttgtagcaccagcttgttatttaggtatctttcttgtcttatttcaatgtgcatgcatgtgtgtatttctactgggcctatattctgcttcctagttacagtgaccatttcttaaaagctcagtaattaatatgttggcctta

SEQ ID NO: 112206 - DNA, 2617 bp, Homo sapiens
taggtagcaaatgtgaccacttgaagatacagtactgatcatcaaacagtactcagaacacgccatgtatttcgtttcacactgtgttaagagcagtaagtgtaacggagatgtttcacaagaatctgttagttatttcaaggaacgttaaatgttgaatgtcattttccagaaaatataaatgggttagagaataagtgaaaggaatttagaggaatctatgccatttttcttgtaggacttgaccagtgattaacatccattatatattacacatcaaatcaacaatcttttttttttttctttaagtagagacagtgtctccctatgttgcccaggctggtctcaaactcctggcctcaggcaatcctgctttggtctcccagagtgctgggattacaggcctgagccaccatgcatgacctgttttgtttgtttgttttctttaagagttggtttgtgcttgtgttctatttgtaatttcatcaaccttcattgagtatattcagtgcctaccctaaattaatagaacctgacttaaaatggaatagtaaatcagtctgtttttgtgtttacagtgggatcatgaaacctggtctcaacgccatcctgggacccacaggtggaggcaaatcttcgtgagtataagagagtataagtaagcgttttctgtgcacttttaatgtgcttttaaaagccacttttttttgtgtgcgagcaggtatttattgagcatttgcaacgcatgtcaggtctggttctaggtgctgtggataactgtagttgcgtggttttttcccaaagaccaggtagtcttattaggttagctttactaataggatttgataaggtgattgacatgtagcagttgaccatgttatcagctaatagggaggaaaaagaatgggagaatattaaaagtagggaaaggaagcagaagatgtaagtaaaggcatgagtcttagataaaagagcacattgcctgtgttagtacctccaaggtcagacagctggaagggccatttgggagatctgtacttgatcagccaatggtgtcttgctttatgttttggggctttattgtaatgtacaatgaaaagagaaaggtgagaatttttaaaagcataattttagttaaaccatagaatttcttgaccagttaattttctaactaaagtagaatttggattcaaagtagccatgagatatatagcatgtgttggagggaaaaaaaccccacaacatatatattctcttataggttattagacccacaacatatatgtcctcttataggttattagatgtcttagctgcaaggaaagatccaagtggattatctggagatgttctgataaatggagcaccgcgacctgccaatttcaaatgtaattcaggttacgtggtacaagtaagtattagtgggtttgcattttctgtttcctctgtttctatatgggtaagtgctttggctgatagttcaatgtgcttccagttgattatgtgacatggtcctagaactgacgttctttacagcagcttttcttaatttctcatagacacttatgtgaaaaggcagggagaatctggaatatggcccttgtaaggacagtgataccaattctagtttttgtatcatttctaaaatgatacatactactgttatccttttttgcctttccttcacctttcttttcccctagcttagaaagatattttggcaaatccttgtatgaagcagtttggaaatgtctgctggtagttaacataattacttgcattctatttgggtgtacagatagggggtgaaaaatgattatagcaggctttgcagacatctatggagttaactgtcatttgcagaactgcaggttcatcattagctagaactttaccttagttatgttatctttgtggattatgttatgtatactaaacagtcatggtcttagaaaagactcattatcattatgtctcattaaaatgctatttgccttaaggatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggtaatgtggaaaaactgaaagcatcatgatcagcataagtaggactttccctgtgtggataaaatgactctgattcagaagtttcctgtaatgtgtatggtcaaaaatggttgctttccataacaatgagaaaagtggcttgttacataatatgaacgtggaaattaacctggaaaaaaaatcttcacattggttgaattctgcacctgaagtgaggcaatgtggtgttgtacgtgaaagtgttcatcacctggcctttccttatgctcctcccccacctcatggtttaagtcacgtctcattccgtgtctgcactaacttttcttcttcctctttttctcttcctccttttagtcactcttcctccaagggactttgttccattgctattgaggtatatttctgggattgataagtgatgagagtccaaggattcttgctctgtatcagcagtccccaacttt

SEQ ID NO: 112207 - DNA, 1065 bp, Homo sapiens
ccgaagcaccggggacgctgacgcacaggttgcccagtcacaagcgctgctcgcacccagagcaagttaaatgggtggtttctggtgaatgggattctgagaaagtggatgcttgcgccccagggcctaaaaaaatcaggcactgaatctaacccaaggaaggaaaggggagaaacttactgaatgaaaatattaccatagtttaaatgttattctttacactcctgtgactgacatacttctgtgcaatattccgatggtgtggaaaggctagaaagtgattgcgcatgttcaggaaacgggccatcaggctttgtgagtgtagccatcccaacatctacctgctgcatctaccctaggaaattagtacctgcatgcagatattttctggtttgcatttacaaacaaaaatcatagtatcatttaagttgtttaaatcaacactaggaataactattaatggttcacccaatgcaggaaagttttagctaggaagcctagataagaaaattgactatacataattttttaaaaagaattttaaatataccataccgcatgctttttaaaagaattttaaggtatatattcatgatgcgcccaaacatttgggtaaaattattcttttgaattaatttctgtcagtttcaagacccttaaaggcccatatagaaatacatgttagtcatacttcattttaagacaaaattaaggccagcacggtggctcatgcctgtaatcccagcactttgggaggctgacgcaggcagatcacttgaggccaggagttcgagaccagcctggccaacatggtgaaaccctgcctctactaaaaatacaaaagttagctgggtgtggtggcgaggctgtaatcccagctactcgcgaggctaaggaacaagaagcgcttgaacacaggaggcagaggttgcaaatgacccgagatcccaccactgcactccagcctgggccacagagtgagactctgtctcaagaaaaaaaaaaaaattaagataaagttttcagacctggccgttaacgactgtttgcaaaaactgaaaaatc

SEQ ID NO: 112208 - DNA, 1007 bp, Homo sapiens
ggtgtggtggcagatgcctgtagtcccagctactcgggaggctgaggcatgagaatcgcttgaatccaggaagtggaggttgcagtgagccaagatcatgccatggcactccagcctgggcaacagagcaagactctgtctcaaaataaaataaaataaaataaaaaattcaaacctttgctatatgaagtaaaatcccatctacattcatggcagccttccaggatattaaggtattcttttcaactaaatttgtttctaatcagcctactagcaaaaatgtagttgagcttgatatcattgtattgcctatgatccaggataattcagatactttttgttttagcaacagaaacctcttaaaaattaattacataaccataatatataaaaataataatatagttattgatgcaagtactttaggtgctaaaattataacatttgcttatcaggaaattatacagtgaaaacagtatttttagcacaaaaaccttgtgagaaaggttcactgatttcagctgtagtaagcctctgaaatttatttctgtatttgttttgatcgtacaatattgagaaaaaatctcactcatgtactagcagtcagaaatgattttaggtttttgtgttgtgttgttttgttcatcttataattttatagttctgattaaacagacatggcaaaggaagatttattctgagataccaataaaaatagcacaagttaacatatatgttcccaatatgttaaacttcagtatatagtacgtgagaaggcatggtaaatatgtttttatacaaattgttaaatgttttaaataaataattatatatttttaatatattttgaaagggcacattgtcacttattggcttttaaaaaaatagctttggctgggcacggtggctcacgcctgtaatcccagcactttgggaggctgaggcgggtggatcacctgaggtcaggagtttgagaccagcctggccaacatggcaaaaccccgtct

SEQ ID NO: 112209 - DNA, 1044 bp, Homo sapiens
ctgcagagcatataatattgatgatatatgtttagggtcccatttggacatggagaataactttgctatagatattcaatataaccaagagcataggcataaaatactcactcacagttgccaataattccaagtgtatgcacaagttttgcacatcttcagtatattttagatcctagatcagttagccttacttggtaatgcaagaaagcttcattttattttatttgttcttttgccttaaaataaagggaaatagttggcagtgttttaaaggaataagaagactggttgcttttggcagaagggaatttgtcattctctccatcagagaaggattaattgtattgttttggaggcagtggggattaggatgggaatatttgaatttcattattagagtaggtgtataaaatatacttgtataaaaatatacttgaaactaaagtcctatgctgtcaaaagatttgccatttaagtgcaaaatatgtttgcaaatcccacaaaacaggaagaccagactgtcttgaacaacttgctcagtgtcttgagagtactgccaattcttactcttggctttgttttctgaaagctgcttcctctttggctaggagctgttcaccttttcctgaagtacgtctaccaacaggggcacactaggaaatgtctaatgaattcctgtagttttatttccttcaaattccactggcagagaacttcacagtgtggtgaaatcactaaagatgttagtacttgggcttttccctacaaaatcattgaaaagtcttccaaacactccagcagattgctcttccaagtctcaggacagtcttaatcttaatcttaaaatgcatagcattaaacctctaagatatgtgttccaattatgttttgaattatgttttgaaagttgttttctctgaaaaagtagggatctaaacttttcttttcacactacctttctatatacacacagactccaactaacttggcattaaaaataaaaactataatataaatgacccatagatgtacactttattc

SEQ ID NO: 112210 - DNA, 1016 bp, Homo sapiens
aaaggggagcagaggagctgagggcatttgcaaggatgtaattataatgatcatggaatttcggcaggtatggtgactaaagaaagcagtgaggggtgaggcacagtgaaatactggtgtaattaatgggttttaggccctggtggagcaaggtcaaaggtttgccggagttgggttattagaggggtttaggtggaaagatagactatgcttacaagttctatggcatgacctgcaagtacataggtaacgcagggtggagaacaagatcactgaaggagagaagttcaaggtagtcagaggccagagtgctggggagatcgttttcggagatactgaattcaccaagaattaagacagaagtagtgtcacagagagtgacagtaccaggggctacaattactgatacaggcgggagatgcttctgaaatctgaagatggcagcaaccatgcaggggtagtcagtgttaaagtgtaatgacatgaaattcaaagctgagatcttctggggaaagttattagatgatccactttgggatgttcatattttttggtagtcgctcatctcagaataagcaatatcagaaagtgaaattttaatcacaagagggcgccagagtccagcaaatgattacttttggttttcacctaaagctagggcaatcatacttttgagagaggaagaggccactactaataattatttgggggcggtatgtgtaaattgggacatagactcacaccttctcctacactatgtaagcatgggcaatttaagaatgaactagctgtgcaccaaaagctctaattcccataaatcactcgaaatgcttttgactgcaatcaggtaagacaaaaatggccaaacttgattttatctggaagagaggcttgagaaagactttcccctctggcccacatctctagttctatttattgcttatcccgtttttccctttagtgcagtaccggtttgactgtatcttcaagttaagagaattgctgtattccccaaa

SEQ ID NO: 112211 - DNA, 1091 bp, Homo sapiens
gggaggctgaggtgggaggattgctggaggccaggagttcgagaccaccctggccaatataacaagaccccgtctctatttaaaatacacacacacacacacacacacacacacacacagagagagagagagagagagagaaatgcctatttagcacagtcttgacttcctattttacttttggtttaggaaagaataacatgaaaagtatagcatgctccaagtatacagcttctcggtcctctttagatttctggtgggcctttgcattgaaacctaactctttgttttggtttaattcgcttccttttcaaattatgtcatagtcctgcttggttgtttttttgtgtgtgctagaaggcagggcctgtgagaggagaccctcagttacatcagggttaaaaaagcacaggaagtttacgcacagagcaaagccatttgctagaattggtttttatccttccatttcgaaaataaagttgctgtttgtgttggagatgctgtcatcagaattccgcggcacaaagagaaagatacaaaaatatctctctgacatgtaactttcccccttcttctagccccttgctaggaatgccagaagaggatcccacgctgactggaaccattaggtcttttgtttgaatcccagtgatcgagaaagaaatgtggttcataatcagctagtagtggagaaaaaaggaacccaaggagataggagagctgttaatttcactcgggacatttcctcgaggctagtttactcggaaagcctcaatgttccctggtagctgcaggatctactttgggggctgccaagtttcctctctcattctttctcctgccccaagagcaggcaggaaggaaagttcctggactgatactcgtctgtttagtaggcgtgggtcctggttgaagtctgtctaggaaaactcctaagtgtagaaatcttcttcgtattaccactgtctctgcactgagatttgggctgctttgcttccagcgtcacacatcataactgaggtgagttgtttgtttttgttttttccaatcttcatacttcgtagaaaatcttgattcttttttgatatgtg

SEQ ID NO: 112212 - DNA, 1005 bp, Homo sapiens
caaaaaaaaaaaaaaaaagaaagaaaagaaattaattcagatgatgtgacattactaaattgtatacatatttataaatgtgtatttcagctgtctcatcagccctcccctccatttattcctatttttctgtagttaagaatactgtaaaaatgtgactattccttaatatcagaaaagaatgcacaggctgagtcttccggtcaaaagttaaatactgatggaatcaagtattttgtatgaagttctcatttgttatctctaacgctattttgtgttttgcatatagtattatagtatgtgtatatcactttttgtatagagtaagcaattgaataatttgttaataaaaataataccacattgactgatactgctatagacatagcttgagttttatgtctcctttttgctcattttctaagacttaggagaaagaataaatctaaaatgaccattaaaacattctccatttcagcttgctgtgtaacttaggaagtataaaactatacttctctttatctgcatgtaagtttgctgttaaaatgtgaatttctaaatgtgtatttggaattatttccgtagtttatttctgcaaactatgtaaatttgttatatgtgtgagtatgtgtacatatgtatattttagagtaatataaaattaaagggaacaatcttgcatagctctttcaccagttttaaattattgatacgttatttttaaggactcttgacaaactaggggcaattttcttatagtggagacccagtgattatcagcagatgaggaaataggttaaaaattgctatatggcaatttgtatataaagtaataggatgtgagaaaaatactgaatcttaagaatgacatggaattctgtggcagaaacaaaagaaaaagttgatgtagtatataccttcaactgtgttttgagttgacttttttttttttctttaagctttgggtaaaaatgtatgaggagggagagggcccaatataaatat

SEQ ID NO: 112213 - DNA, 1028 bp, Homo sapiens
taggttagtaactgcacataagaccagtttggctttctaggggaagcgtatttccaagggaaggaaaggctgatttctctttgtatagactgtgatttccaatgtttttctctttcttcctgccaaaccttgcaggcaatacagtacggtactgaggataacagtactgcagtagtagtgccttttggtgcctggggaaaatataagaactctgaaatcaacttctcattcagcagaagctttgcctccagtggacgatgggcctgattaccagctgggacttagagtttctgtgcaacagtttttcactgagcatgtcaagaaactgataagatcaaaaaggtctcctaactcactagatcagcgcacaagtcagtgtaaaccacttagatagtagttttttcataaatgctcatcatatttatgttccgctgtacatgttcagtataaatatatgtgtagtgaagctactgtgagtctttaaatggaaagagcaaatgagaagtggtttggatacacttgatgagagatgagagtgtcacattaataatttttaagactcttaggcagctatgggtttcttttgatcatttttgttctttattcatttgaacacgtttttgaagttcttcaaaactagtcagtttgaattttgacagctattcaatatgtgatctccaagtttaaaaaaatttttttccagacttccctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccaaggtgggtagatcatctgaggtcaggaattcaagaccagcctggccaacatggtgaaaccctgtctctagtaaaaatccaaaaaaaaaaaaaaaaaaaaaaaaaaaattggctgggcgtggtggcagacacctgtaat

SEQ ID NO: 112214 - DNA, 1028 bp, Homo sapiens
ggaggtgcctgcagcccccgccgccggagccacgggaggagccgcagccgcccctccgggagccgcgcgctgactgcagtgccaggcggaacgcggcccagcgcggctgcagctccgccgtacccccctccctggaaccccggcccccgccctgcgcacctcggcagcagccgaaccgcagcttgggactccgactgtcacagcccctctcgccggacccggggtttctccgttttcggcgtcacaataataaggaagtttccccgcaagcctgcgggcggcggaatgcgctgggtgaatggcttcgcaccgggccaatgggcgccgttctgggatgggcccgcgccaatggcggccgccgtggcacgggctggaggcggggcggcaaggtccgcgggcaggaggaggggagaggcccaggccccagagccaggcgcaggctgcccgaggtgacaggactcgagggcccggcgcggggacagcggcacgggtgtgtcagccgaaatcggactgcaagacatagagcgttgacgctgaaataagattgcttttcactggcggggaagcgagctggaccgatcagcggttgcctattcaggttctggactctggtttttattatttatgaagaggtgaccgaaagccttgggcacgggggaaaaagctggagggtgacaattgagggagagtgcgctagtcttctgctttactccccttcgtaggactgtaggaagcgcggcgccggcccgcggcgctgcgcggtgggagaggcggggaaggaggtacgcggcagccgccggcgctcttctggagaggtggggatcgaagaccggcacggggctgcggaagaaaggcgggcctgggggaggctggagggtggacccggggggagcatagcaagaagagtctgagcaccagatcttaaaatcttgtaatctgaaagacactctgtggcctatacccagtaacggattttttaaaagtttgtcctcttccacttttccctagcgccgaatcccagagcttcc

SEQ ID NO: 112215 - DNA, 1047 bp, Homo sapiens
tgaaatctcaaagaagagcactaggagtaggagtaacattgactaaagcagctgacatttactggtcacttactactacatgccaggcaccatgctaagccctttttacatgcattttctcattaatcctcacaacactctagcaccttctcctgattttggagcttaaggtgggtaaacatctttcctcaggtttcacagctaacgtggttaatgtagggcttggattttagttcctttgacccttaagctctgctaagattatcttgaatctcttaccaagaatagatgagaaggactcaggaaagtgccaggttgacattgagagaaagttgtacttcaaaagtagtccttccttttgttttgtcatggggaaataagaggcaggaaatgcagccaagcggggctggtgtaggtgctgagggaagtgtagtcctatattttgcagcgaatttcataattgtgtattttgaaggaaaataaaagattctgctcttctaggagcaagcaagagagtgaatgaggaaaaatgggtgtaaggaccttggagatcaaaatgcccagcgatgcagaccgttgctgaaactagacctttaaagtcatggacatcagcagctacaagatttaggggtccaactggagtgtactttgaagtgaaagctgtgctaatggctggcttctctccaatgtgttgaacttctctcctgaaagctagatgattttagttgcttttttctttagttccggcagagcattgtgatgacctaggccgtatttatagttaggattgatagtttatttacagatacacatcttttttgtggttgctatttaattctcttggtgggcagtttttatttgaccaattgaagattccattactgtaactcagttggaagaatttttgaagttttcttgaacaatagtcctttttattatcttttttcataaattgtttttactagtcagtcagggatgaggccatacttcaggctgtttacacaggattgtgcttggccaaagcacccagaactcagatgactctca

SEQ ID NO: 112216 - DNA, 1046 bp, Homo sapiens
atctaaaatgaggattatagtctaggtgtggtggcacacacctgtaatcccatcactttgggaggccaaggccagaggattgcttgccaaggagttggggaccagcctgggcaacatacagatgcaaaaaaaaaaaaaaaaaaaaattagctgggcatggtggtgtgtacctgttgttcctgctacttgggaggttgaggttggaaggtcacttgagccctggagatcaaaactgtggtgagctgtgattgcatcattgcactccagcctgggcaacagagcaagactctgtctcaaaacaaaacaaacaacaacaacaaaaaaccccaaaataaataaataaataaaaatggggattataatactctttcataggtagagtaatctgtgtaaatattgaatgcagtgtctggcagttttatatcatgcctcagaaattatgctaccgtgcagtttcaccatcccgtgtaaaggctgatactgtctctggagttacagggaaagaagcctaagctgggagtttgagaactgggatctagttttttatctaccaggaaataattgcctgtccctgggcaagtttcttcctatttctgagtcacagttccctttcctgtaaaaggagtagacttcctgttctaatcagatagttcttggtgaaggggattcacatgataaagaagacaccacaaaactgctggtagtgttacagacagagaaatatgttacaggaaaggggtcccgatccagaccccaagagagggttcttggctctctcaagaaagaattcagggcaagtccgtggtacaaaatgaaaacaaatttattaagaaagtaaaggaatgaaagaatggctactccatagacagagccctgaagtctgctgattgcatatttttatggttatttcttgatgatatgctaaacaaggtgtggattattcatgcctcccctttttagaccatgtagggtaacttcctgccgttgccatggcgtttgtaaactgtcatggcgctggtgggagtgtagcagtgaggacaaccaga

SEQ ID NO: 112217 - DNA, 1017 bp, Homo sapiens
cctcctgatgcagctccaaggagctaatggtaggtgttgctgggcctctggatgtgagtgagctctggcaaagcagccgcactgcgtctgtctgcatactgggtcagctggccctcagtcatcctgcagacgccctccccacagggctgagtgactgcaagaatcccaagctagaggtgtgccaagaaggctttgggattcagcctcggaatccagcccatgcttgtgatctaaatttggaataaggcaggctgtagtgtaaattacaagagattccagaaatttctgttgttggttaagcttgtctgttaattataaactccatagcagcttggaataatgcctctttgaatggaaagattatgtgggtgggtgcctccctctctccatttaactttttcgttggtaggtgtgttctaaatctggatatgatttgcgtttgtttttaatgagtgggaagaagagaatgaacttgttttctgtgtttgcttattgagaaccatgacctggagagctgctagacatggaagggaagtctgtggcaggcctagtttgttacaggtatctgttggtcttggcccacaggaatgctacccccaagtagcttctgtggtatttgggaagggaacatgatggaaggccccttccttaaaagaggatttttctgggggttatgggcaggtctgtgatttcagcttggtatcattgcccagattggttgactttgaaatatgaaggattttaaaaagtgagtgtatgactgttcctctaaggctttgagagtgtgaagaagtgagttgaaggagttaattccatggtggccaactccaagtggcttacagagttttgaacccaagtggcaaacttaagtttctttttcttgctttgcagtactggctgtgaatggagtaatgcctgaccatcaacacttactttgctgattggacttgttaatatttctagtcctagcagggtgtccaccagcatgggtatggtcatctagcactagtctggagg

SEQ ID NO: 112218 - DNA, 1783 bp, Homo sapiens
gaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaaggtaggtaaacccttcatatgtatgtatttagtttaaaagcacattcatttaacacatgcttcttgaggatctactatgtgctagccccatgtgagatactaagggagaagcagtgaacacaatagagaacatcctcgtcttagtggagactgtattctagtgagtagaggtgcaacaaaaccagtaaatacacaggatttgagagtgcagcttcctgctttacataaggtggtggggaagggcccctctgataagaaaatgtttgagcagaacctgtaggaaatcaggtgggagatgggacatgtaaatgtctgggtgaaaaatgttcctgtcagagagaactgggtgtgcaaaggtgctcatgtgggaagagatgtagttggagagaaggggaagagtagcacagctgcaggtcagagaagtcgtgtagacccagttatgcagggccctgaggggcagggtgaggatataactggttttctcagtgagaggggaagaccctgagggtttggaggagaagcgtgatccactttggctttggctgtagtgggtcaagggggaagctggaagaccagcttggaggttgtgggagtaaagtcagattttaaacatattttgaagatgaggccagttggttttgttcactgttggatgtgtggtttgaaataaaggaacagctggaagggcaaaatgactgtttctgaaatggggaaaaccgtgtgtagtaaagtgagctggagagtgggcagggttggagagtgtagggaaaccatgaggtaggttttaggtaaattaaaactgagaagtctgttggatatccaagtacagatgcaggcaggaaactgaacatgcgtcaggaatccaggaatccaaaattcatgccaagatagttgtgtatatttcatctcaaaggcaaatggtagtgatattctgatatttaatttattctagatcgagaatctccatgccatgtaaaactcttacgcacgcaaaaagttgtctatattagttgtggagaagaacacacagcagttctcacaaaggtaaggagctcagagtattttactttggtgctggggatatgatgggtgattagaattgcttgattatgttagtgtagtgatggtgtgtgattacagtattgtggcttgaacttgaatgctctcttttatgtgggtttgttgttttccaaaggaatagaaaaagactacttttttgtatgtctctgttatcctctttggtaatcttgtagatttttcatatatatatatatatatatatatatatatatatatatacacacacacacataatgtagattatatatatatacacacatataatgtagattatataaaaatgtagattatatatataaatataatgtatatatttatatatatataaattccttggttctttatggaacaaagacagcactttgttatttttatttgttattttatgtatatataatatatataaaatgatgtcctatgttcctttaaaacaagtcatttaaatatgtaaaaaagaaacagcaatttaattaatgttttaaaataatcatgtttcttttgct

SEQ ID NO: 112219 - DNA, 1048 bp, Homo sapiens
tttttatattgaacaaatattattctacgttcactttgataaaatgccttaacatttatttaaatacagctgttaaaaaaacagcttacttaccaaggaatttgtagagcacctaatttcttacatgtgaatgatcatgtaaaatcatctcatttagcctagctcctagtttctccttttttaaaattttgcttcctaacacatcattgtactttcaaacgattttaaaaatttacagaaggcacacattcctttgagcattgctatctttgttccataaagatgcagtctgaaattccctttttattatttttctatttaatgaacatccttacaaagtgattttggccaagtgtcaagtgaatgtagtgctcttgtgcacattgttgtgataggcattttgtatacagggtttagaggtatacccttaaagatacagtgaagtcctatggtgtttgttccttgttagagtggaggtgtgtttacctttggcgctggttcctgtgggcaacttggacacgactccatgaatgatgaggttaaccctagaagagttctagagctgatgggtagtgaagtaactcaaattgcttgtggcaggtgagtgttcctcaaagcttgcttgtattcactaggacccagaaattggtcttatctttgtagtgatgaagaatgtgattatacctagtcaccgtcattttaagagatcttaactgcatgcacgcctatggtgaaatgtggagaaagaccttgatagagtgtggcaaggaagggttttagataagcagagcaacacggagacattaggcttcttttgggataaagagtagcaggatgtggggaagggataaagaaaggaaaagtgagagagtcccaaagaacttcttggaaatttttgcctgagtctaccctgcttctctctgttcatcttagaggccacatgcagtagatcattcagctctttcctgacttgccaccctcctcatgatctagagtgttagaggatagtattatggagagcagccgctgcaagaagagtcacgtgtta

SEQ ID NO: 112220 - DNA, 1043 bp, Homo sapiens
tatggccattcttcggctggatacaaaccccagcaaagtactaggtgaatttgctaacctcgatatcagtggttttatggtcatttgttttgttggtgtgactcctggctctcagtggattgagatccaagaatctatttgttgccatttaatatccttaacacttaaaacctttttttctttgctgttaatttttagctaaccctattttcaagttgaaaataaaaccattatttagattatttgaaatgactcatgccagaataatcttgattttatagtattcacaaacctaatttatttaacttgaaactatttttttctaccacatttgctcagtacctcagtattactgtacgttggtctttctcctatgtctaatttagggggtgggagtgaagtgaacagtttcggtgatacagaggtctccaaaacaggagaggaagaaaatgacctagtgtggacttaccaaatgtttgttttgtttttcttttttaggaccgttgagtccacactgatttttgcaggctccggacactttgctgagataaaaaccttccattcctcagtgatttggagagtgtctttcatgggagtagcacctgaaatgtttttattactcaagtgcaggaagtctatcacctggctttttacttttttcccccctggtaaattttgttaggtgtcattgcagctcagtaacttctgtgttccagatggactgggatgttacttgagtgtggtctcgccgtgaataaagagattgtgttcctgaaggtggaatactggcttttctatattgcctccacctttgtagaagagataaaaacagaaataataatgaaagcactagtaaatgttagtacttaattttttttaagatcaaaagccttttgggggcacattttctcaggtgttctagttgatgtgaaacagagaggtggcaatatcagaagaaatcttacctgactttcaagttttagagttttttcatttttatttttccaggctggaaaatacaaagagaacataattgttcaatt

SEQ ID NO: 112221 - DNA, 1048 bp, Homo sapiens
gggccctagaagaacccatggattggaaaagttgaccttccatatccttgggttttacaccctgcaaatactgtattttctttctttaattaaactgtttttgttgttgaggcaaaatagatacacatattttgggggtacatgtgataatataatacattatataatttgtaaagttcaaaccagtgtaactgggatatccatcaccttaaatatttctctttatgttagaaacactcgaattattctattttgaaatatacaatagattattgtaaactatggtcatcctactgatctatcaaatactaggtcatatttcttctatcaaaatgtaatttgcgcccatcagtcaacctctctgcaaatactataattttgattggcctttggttgaatccatggatgtggaacatgtgaatatgaagggccaactgtattttattttttaaactgccaaatagtgttttgttatatggatatgccacattttatttatccattcatcagttgatggacattgggttgtttccagttttgactattatgaataatactgccatgaacatttgtgcacaagtttttgtacaaatgcaagttttcatttctcttggtatatgcctaggagtagaattgctgagtaactctgtatttatccttttgaggaacttccacgatgttcccaaagtagtagagccacattttttttatatttatatttattttcattttattttttttaaattatactttaagttttaggatacatgtgcacaacgtgcaggttagttacatatgtatacatgtgccatgttggtgtgctgcacccattaactcgtcatttaacattagatgtatttcctaatgctatccttccccgacccccccaccccacaacaggccccagtgtgtgatgttccgcttcctgtgtccatgtgttctcattgttcaattcccacctatgagtgagaacatgcagtgtttggttttttgtccttgtgatagtttgctgagaatgatggtttccggcttcatccatgtccctaca

SEQ ID NO: 112222 - DNA, 2022 bp, Homo sapiens
taggattgtggctgtctctcttaccatctttagagtgatatttaacattagttcttcttcaaatcatagaaaaaagtcagagacttctttgaatcaaattattttagtcatagtgtcttgagtgttataggggttcagtgggcgtgttgaataaatgaatgaatgattaatctgttatttattgcatttattggcaactccatgtcctaaaacaaaagatgttttttaacctgctaatgttttctgactcaagttctgattattctcccactaattttctgtaatagtcatgaaactacatttgttcctaaagcctctctcagtcatttgagttctagaaagatgaatggttaacaaaattgaaatatttcttttttccaccttaaatatagatctgccgagaaagctatggagtgattgaacagaagaagctgatacctgggggagataatgtaactgtgtgcaaggataacaggttagtcctgaccttggactgttgcagatactgctacttcatatttctgcagttttacatttaagaccaaaataaaaattactttttaatattaataccttcttcagaggaggtaagtaagggtgatagggcaataatttacagattttaaataatttttaaagcagagcaagcacccggcctagattcaggagatgactgttttagttctagagctgcatctttttggctttgactctgagcaagttacgtaaactggtttcagttttctcatctgccaaatggggattataatcactgtgctctctacttcatgggatggttgtgagaatgaaatgagataattcacaggaaaatactttggaatgaatggactcccagcatctagcacagagtttctagtatctaacagagtgcctggcacaaaaatactcaaaaaatatgtgttgaagaaatgaattttataaaggtgcttactatcactgctattttactgctgattgatttgtcatagagtctggatcataacaacaaattcaagtacatttgatttttcaggatgattcataatctctgagttaactctttagaggagagaagatactcaattttgcttacttttatattaaattatgctaatctgcatgaaatcaatttactttacaaacactgagtgcccactgtgtgccagccatagtgctgggtatagagggtgaataacttctatccttagaagctttgggattagttgagaagggtcaatgtatggaataattgcaatagaatccagtgtatgtgatagaagttgtagcccaggtgccacggtactagggtaagaggctacaacacttttatcagacactaaagaatgcaagttggaggaaacattttaggcaccagatgagttgggactctgcagtttgacacatgatagagaatgttgggtacttgtggagtgggtactggtgtacggatgaagggagactatagtagcatcagagtggaggttatcaaggccttgaacggcgcttggagtagaacatgattggtttctattttagaaagattactttgggggtcctgtggaaatagaccgtgtgcagggatacccattaggaggcttttgaggtagctcaggtaaaggatgttaacagccagaatgaaggcagtgggaaacagagttggttatataaccaaataggagctagtgtctgattatatatggatggtatgagagagttatatattgataataatgctgaggtttctaattcaaacactaataggaaacagagtctataaagcaggttcaagggaaagttccattttgaatatattgattttgatatgtctttgtgatacccaggtgattgtgtttagagcagaaaatttatatatctcaataaagaagtcttatatgaatattttttaattagttatgtgagcctcaatcactattaaatttgaggtcgcttacagcaagaatcaacaagaaagaagtggtgaaatgaaaaacaagagcaaggaaaacgtaatttcttagagga

SEQ ID NO: 112223 - DNA, 1116 bp, Homo sapiens
gggccttcttccacgttgcagactgctgacttctcgttgtatcctagcatggtggagagcagcgttgggaagcaagctctcatgactcttataaggacaccagtcccattcatggttactgctgtactctttactatagctgttttggttagggaccaccagaaaaagacatgaatgaatttttttttcttttcattttatgctgcacaaaatagaaatcttaccaacaaagtacattgaggtcctggtaagaaaggctgtatgaagttgtaaaagattgatcattatagtcattatttccttggctatatgccataatgtagtcattagcagtcctaaattatatgactaagaaaatgaaatagctgtaagaagaatacctactggccttttaacttaggcagttgtatacacagatacttctggcattgaggctgtttttgttaacagtaagatatttgctggcattgctgccccaggggaaaatgccagaggaataccaattctgtattcataatttattccatttcatttggttttaaaatgctttctatccttggacagaacctacacagtcaaatgagttgtaggcatccaggtaaaagaacatctgtggctgattactggtggctgcatcatagacaaatcttgccaccagctggtagtcacatctggataatactatatcacatgactactcatggttaagcatttcttatggtctataatatggtgttaattaccattagtgaaaaacccatatgtcattctagattccctaaaatttaccttaatttgatgcaatcaaattaaatgcaattgctgtcttcccattttccccatattaaaaaagaaacagatgacacacacatggggctggggggtggggcagtggggggcagagagtagagtaaagagatcacatagtaagaaatgccaaacttaaggtaagtgcttcaaagggcatctagattccgtagtgagaacctgagaataaaactcatgcatgacaaacacttcttgctccttaagatctacttcaggaccgctggcagacttcagttgatctttcaggatagtttctgagggatgcagtctttaagatctgcattgtat

SEQ ID NO: 112224 - DNA, 1035 bp, Homo sapiens
aggaagcacgaagtttaggttcactgattatttttatatagccaaaaagtatagatctctttttcagtcttggccatgactatatgatagtcttttcatctaaaatatgctcttttaaataaagaaggttccagaataattcactagactctaaggtgtgggaggtcagggattctgggctttgttcacctagtggtgaccccagtcctcagtgtctagcacaagacctgacacatgacacaggcccaataactatctgtagaatgtctccttggtggcattttaattctgaatttatcaggtttaaatgtaaaaaaaaaaaaaaaatgctggcactgatgattcttctgctggcctgtccctgcagtggaaaaatactgacactctgggataatgttcatgtttcagccaagctttgtttgggattttttttgaaggcattgaaccaaatagtaaatgctctagagctcaaatacactgtgaaactttctccttctccaccggaatattcaaaatgtgtagaggcagaagtgaacttcttttatcagagagacactccttctccacaataggcttagaaccctgctctgtgtagccatctggtaggcctcatggagaaggtgtgttttccttcttgaacatttcctcttttacttctgtggatttgggttatgacattgatagacacctttaaggacttccatgcccaaggcccttaagagctcacagctgtgttctagatagacttcaccttgctgccaattgagtattttgtgtgttgtagtatttgttgctctgagttgggaacagattccctcattcagcctggactgggtcagacacgtagaattggcagacccagattcaaaacccagccccactgagattagctctatgactttgggctgcttaggtaacctctcagagccttggtgctttgtctatataatagatatctgttatagattgccaaggagattaaatgatgttacagacacacacacacacacagacgtttatctgtatatacttacc

SEQ ID NO: 112225 - DNA, 1056 bp, Homo sapiens
cgcgcgcgtgctctctaatcccccgccttccggctccggcggcgacgctcgtccctctccgctcgtccctcgccgctgccgggccaccagtgccagcctgcctcaggagactccatttgcgcttagtgtggtctgggcgccgcgcaggcggtcccagggcgatgcccggggccggcggactggcgttccctgtgccaagcggccgcccgctggctggctggctgcagcagtgacatcctggtcgccggcgtccaggcggaatccgggctccctccgcgggaggaaagacgtcccgcgctctgaagctcgcccagcggggagaggccctcgctaacacggcttctccctgacctcttaatttcaggaggtaggctcttcaggtccctctctctgtcaccccagattatgcctgaaagcattatttgtcgtatttagctatcacattgataggaggcgttaattttctcaacatagttgcaggataaatgtggataatgccacagatcctgatgttgaattgaaagaaaatgtttttggtattttcctttaggtttcggagcctccgagtatctctacagcccccacaggaactgcttctgttggtccatcgaggatcgtctttcaccaggattattgtaacatcatcttcaccgagcctgccaccccatagcctctaccttgggtcctcatttccaccgatgcagtttttttgatgctttctttagtaatgtgacatcacatgtccactatcctcctttccagctgccaaatctagtaggtttaagtcgcttttaaagtagagttttctgcctgttccactttcaccttatttgcactgttcacttctgtccgggtcatcttctcttgcgtatgatttccacaagcactcacttgcgcaacctatagcagagtccgtgcctagagagacagcattccatacaatccactgcttgacaaagaccacatagtcagagggtgagttttcccattgtattttcctgtatgtcaagtttgcaagtcctctcttgacttaaactgtttactccctagcacatt

SEQ ID NO: 112226 - DNA, 1089 bp, Homo sapiens
taccagtacagtttctagcctctagtgtgattgcacttcatgaaagaccctgaaccctgaggaggaagaaagatagaagataagagttaattggcgctaggctttgttgtaggaagtttgtaagttttaaaatagcaagtagattcacgtagaccttgtcaggaaattggtcactatccatctaggccctagaagtgagaggaggaatcttacgaactcattttctagttgctttgtattcaaatcttagttgttaattatcttgttctagtaatcacctaaaatattagacacttaaaatgttggggaaacgtaagcgtgtggtgttgacaattaaggacaagcttgacattattaagaaacttgaggaaggcatctctttcaaaaaactttccgtggtgtacggaattggtgaatccacagttcgtgatattaaaaagaacaaagaaaggattataaactatgcaaacagttcagatcctaccagtggagtatccaaacgtaaatctatgaagtcatcaacatacgaggagcttgatagagttatgatagagtggtttaaccaacagaaaacagatgggattccagtgtccggaacgatttgtgcaaaacaagccaagttcttttttgatgctttgggaatggaaggtgattttaatgcatcgtcaggctggctaactcgatttaagcagcgccatggtattccaaaggctgctggtaaaggaacaaaattaaaaggagatgaaactgctgccagagaattttgtggtagctttcaggaatttgttgaaaaagagaatctacaaccagagcaaatttatggtgctgatcaaactggattgttttggaaatgtctaccatcaaggacattaactcttgaaactgaccaaagtacttctgggtgtaggtcaagcagagagagaatcatcattatgtgttgcgcaaatgccacaggtttacacaaacttaatctttgtgttgtggggaaggccaaaaagccccgagcattcaaaggcactgacctttcaaaccttcctgtgacatattacagtcaaaaaggtgcatggatagaacagtctgttttcagac

SEQ ID NO: 112227 - DNA, 1040 bp, Homo sapiens
ttcattgaaaactgaagggttactctaattgaaaaatcacttaccaccccctggtaggctttgtgatgtatgcaggcatttaagatatcttaggtggagttataacaggaaatgagaatggaattgtaatttctttggtccagttctgttagcactttgctaataaaaagatgttggctttattcatagaagaaaatcttaatattggcataataataaaatacctttacagtggataatatagcaataagcaagacacctggaatattttatctaactaaagtaatacgggataagtagaaaaagcaaaagaaatgtcatgggagacagtggttatagtaattaggcccagctatatatagggagcttgtcatttggtttgaggggaatttagagcccacatctgattattttctttcgtgaggattatcatcagtgtcttcagctgagcctctggattctagaatagctttttcagaagacctctcagaatatactttctttggataattcatacatcattattaaaacactttcctcagtttacactgtttcacctacctgatagccttgaggaaatacaaccctgcaagataagtcctgaggctatttggcttcctggagaccaaggattctaaaacttgataagggtaatgacttacatttgaacactgctttgcattttcacattgctttttgctaacacaaacttaaactttgttcagtcatgacactgaactggtttagtctcatgttgtatcattaatcgtaatataaattatgcattctcattccgcatttcattgcaatacaaaaatcttaacctccttgagatattgtaatagttcctctagaaagacacatcatggtaatcttggttaacacttgccccttatgtgtaccctagtttgaaaagcagacatatgtactctcatttgactttgtacaccttaaaggaaatacctacaaattctgattattggttaataattctgactattggttaattttaaaaatgtatatgttttttagaggaacct

SEQ ID NO: 112228 - DNA, 1025 bp, Homo sapiens
cacaaattgacttttttttttttaatatacacactatatatgttaagcaatgatatctacagaattgcaggtctcatgtgccaactggggtctttgtctaattcaagttaaacataagaattcttatttttaaacttgccaaactaaaacttaaaatcaattttgtatacctcatctgcacactttagaaacactagccaagcagaaggagtagggttgttgaaggttaacagattggaatgcaaactccagcttctccactctttatatagttaaccttagcagcattctggacctctctgaacctcagtttacccatatgtgaaagagttgaaaggtaagcagtcacattccaggcattcataaacaccagctattaagcaatcctacagctatacattgagaacccctggtcttcaggcttaccctggagaattcatcacagctcttctctcacagagactgtgcagacccccaggaaacccaggcacctctattgaggtccagggcactgacccatctctgggaatgctggctggggtgtatgcataggtgggcaggcagcattgagttccccggaccctgaggactgtagctgtcagtcactacaggggtccatctgtaaaaaagttgagttacagataaacttgtaacttctagtttcttctaagaccaacaaaaatgatacctgattcctgcatttcagaatatcttgatcttctggaacttacttacaaagaaagtcacctttgagtgtaaaaaaagataaactcaaggcagttttactcatctgttgaagacttgacctgaactcaagtgatcctcccacctcagactcccacataactgggactacaggagtatgccaccatgcccggctaattttttttttctttctttcttttttttttttttgtgaaccagagtctcactctgttgcccaggctggagtgcagtggcgcgttctcagctcactgcaacctctgcctcctgggttcaagcggttctcctgcctcagcctcctg

SEQ ID NO: 112229 - DNA, 1069 bp, Homo sapiens
ctctggaaggagacccaatcttaggaggatcgacaggagattcacaggcatatcagtggcttggtgcatgtcaattcaaattgcagattccttggtaccctttacatctaagcggagctttttgaacttaaaatccctcttaaaaccctgcctcatctcctcttctcattaagaaacactgatgcacacaaatgagcagtaagggcacactggcttcatccctgtttcttccctctttctaatggcaccatcaaaggcaaaatggattgaaataaataaaggttgtattttattgtattgcctcaggcaactaagtcagatgcgtatctgtagaaatgatgtattttctgattctgctatgcatttgcttcaatcttcctatcaaaagtaaggcttatctttgtaacaacagaattcttgcaatatagctaatgtggtgtgatcctcagtgatttactgagtagaagtttgtcttactagacaagttacttggcctgaaggcaaatatgttaccgtgttatctgctcatgctgaaaagcaaatataaaatgatgtctgtgcatatgaaagagaataaaaacaggttttgatatggcaactgctttatcaagtattctgtgccacctgccttttttgcattttttgatgcagaaatctgagttactattggcttccggtgacattaatagaatgtaagcatttgataacttaatcacgtttgctttaagcacatttggagtaaggggttctttctatttagattttactaacacttttgcaaaccgtggtccccagtatgcaacaaacttaccaggaagcatggtgagatcacatcaccagtaaatggcagcatgtgagaccctttctttgtttacatattttcttgtttcttacactgtttttcatgagtccttaagtccttatataaattttgattttggcaatccatatagggattaaaggatctgactaaatgtcagcctataatgggtgctgaaatattgatgcattaaaattcccctggaaatataatgaaatggagaaaattatactcattagagttcttctc

SEQ ID NO: 112230 - DNA, 1118 bp, Homo sapiens
caggatgattatggtggttatgatacttgtcatgctgaacacccaattgagcacccaataagcacataataatttaatcatcctctggcttggatggcagtgttctatcagtgttgacttcctggttgtgacagttttacagtgttagtgtagaagagaatccttgctttagagaggtacttactgaagtacttagggttaatgcaccattgtgctggaaaaagatacgcacacacacgcacacacacacacacacacactctcacacacacgcacaaatacatccatgtgttaggcagagggagcaaatgaggtaaaatgttaacaattaggaattctgggtgaagtggatagagggactctttgactgttcttgaaacttctctatacatttgatctgtttcaaattcttcagaaaatcaaactacaaaaacttaattcatttagtgaacatctactgaacatctgtatattaaatagtgttaaatgaatgtcaattaaaatgctcaaacacagtagaggttgattctcattcacataagtccatggtaggtgtttttggcaggtgggtgagtttctcccttagggagattgaggaacccagactcctcccaagttgcagccccaccgtcttctgaggggatgcatccatacccacttcgaagtagcatacattatttcctttctcattcctttggataccagccacaatttattcaaggtagacagaaaattgtagtatatagccatatgccctgacaaagaagggagaacagattttggtggacaactagcaaactctgatacaatctgttattaagcactgtgtgtggatagatgctaactagaaggagattatcttcccttcagcaaatataaactgaatgccgtttatttggttgaaactaagctagatcatgggagtatagaaattttataagaagacatagtcacttctgtcagtgagctcaagaagaattagtatgcggaatgtaatcatacctacagggggcttgtgccacttaagtaaaatgaaacattattttgagtacaatttagcaataaatgtactacgagatcattaaaaatcatgtttgaatgttattgtgtcaaggatg

SEQ ID NO: 112231 - DNA, 1099 bp, Homo sapiens
tttttctatttggctattgggaatcctcacaaaaatcgaaaattgccctttcagtgtacgttacggtatttcatgccacacagattttctgaggttgtacatacagctttgccttgaggttccaatttttgctcagtggattgagtatatattatttgctatatatcagaagaggcatgtgcttcctacttatgtcaggtaactttgggattaatataattgtcctacaaagcatagatagatagaaatacttcatccttaatttctaatattatgacatatctaaagtaggcacctttaaaagttaatctccactaaatactaatgactgcttatagtggcaattcatctttcatggtagtcctcctacaaaggtatactaacatttatgagtttgaaacaaaggcaattcacaagtgttctgctagagatggtctatatctgctgtttgatccagcatgatggccagctggccctcctgtgcatgacggctcgtggtttaactgcaccattttgtttggtcatatacagggaaaacatggcatggtgtggagggcatgggcttgaattcagggaacagagagttggtcttctctctctcactctactggatgatgtcatctcccctctctaagcatgagttttcttatctgtgaaataaaaatgttgaattaaatgagttcaaaatgctttcagtctgtgtttaatagcttgaatcttaagacaatgtattcaattatgcgttgccagatccctggcaactcatgtaacctttctaaaccatagctactcatctgtaactggccagccaactgcccagggttggagtgtgaatgaaataagataatgcagacaaaagatttttaaaaattgtagtgcattatacagttgtaatattttgccaagaacttacattttctctaagaagtgtgtcgatacatgatcacagaaaatcttttccatattcctttgtagtttgatgatattaagtaagtaaattgtataacacaaagagggaaaagcatcactgaacatgccgttttatttagctaaataaaatgtaatcactattagttttcctctgatttccccaaagtca

SEQ ID NO: 112232 - DNA, 1046 bp, Homo sapiens
agttccacatgaagtttttgtttatctcaaggtaaaattttagtttatagaaaagttttagagagaaactattgggaacattggtggaatactaaaaagatcattattattttttaatggtggaaagcataatctaaatttcttgttgataattcagtaggacagggtatttggagaacggggtatatttcatcacttaaaagacaagataatcacagaaagcagccatcagttttagcctttctcatgaacaaagacagaaaatgagtaaacattaatgtgttggaactaccaatgaaaagaaacttaggcagtataagataaacttattagatttatgacatatgcaactccatttttaaagcagagaaattccacattaaaacaaaattcttataattttctgttgcttccctccaagccacttcattctccctagtgtaaaaaggtcagtcttagaatagcttatgtatttttgcttccaaatgcaacagaaacttgtagacagaatatatggctccctatatagtagtatttgagaaaccaaataccataaaaaggctatcttttgcagacataatccccttaatgtttgtgtgtggagttattccttttggataatacgtactctgttaaaataaaatgttataccagtctcttatcagacaccagcatattagctggattaattacctaagaagggtcagagtggtgagggccagggcatagcattggtgtattttgacagggaagttaaaaaaagtcactggcctctgacttagaattaaatgaaatacagcaacccaataatgaattctgagtatccagggaacaataatactctaaagcaaactcagagatcacaaaggggcatgacaggaatacacccaacggtacacaggcactggaagaaccttgtactacatttatactttagtcttaggtgtgcccaaaagtataacatacagttctttgatacaagtcccagaaacctacttttgctcacttcatgaaaaaaagaaaaaaaactggttattggaaggata

SEQ ID NO: 112233 - DNA, 1059 bp, Homo sapiens
tccccagtaatccttagttaacttcatcctctccattctcaaccataagcttatatctttcaacattatattcgcagtatctggcacaagataggcactcagaaggtatttgttgaaattcgtatgaatgattaactaatcaatgaatctgtgctataaaacagacaaattaaaaatgcctctaagtgccgggagcggtggctcatgcctgtaatcccagcactttgggaggttgaggcgggtggatcacctgagggtcaagagttcgagaccagcccagccaacatggtgaaaccccatctctactaaaaatacaaaaatcagccaggcgtggtggtgggcgcctgtaatcccagctacttggggggctgaggcaggagaatcgcttgaacctgggagacagaggttgctgtaagctgaggtagtgccattgtactccagcctgggctacagagtgactccatctcaaaaaaaaaaaaaaaaaaaaaagcctgtaagcgtaacttattggactttaagacctcacacttagtacttcctattttcctccttgacttagttttcttctgatcatcaattattaatcatggataatttgaaaactgtgctttcatgaatactagaaaactgtgctttcatgtcagaatgtacaggttcaaatgaatatgccatcacttatctccatctatatacttaactgtgtgactttgaaaaatgtatttaactttctcagtttcagttttattatctgtacaatatagatattaatatctattgtatatagccagcaggattgttgtattaactactttaaacacattaaagtgtgtttaaaaccaccaagaattttcagcgtattgtacatgtgttatgaggcaatataacatcatattgaaatagctagaaattaaagccaaacagtccaactattgctgaagagttctgggagattaggtaaaatgtttacacatctaaagcattaatgtctcaatgcttaatcacaaaatacaagttcctaactcagggcaattttaagggctagatttgataatatgttca

SEQ ID NO: 112234 - DNA, 1007 bp, Homo sapiens
tgtagtacaggtcatgggattgggttaactgtaaaaagccttgttcttaagtccctaggtgatacctgacacactcaagcactaactttgtaggcttgagtacagaagataagtgaaaagtcacacagtggttcctttgcatttggcccagcagccaagtttaaaaggacaaacaggctgtactgcatagaaggtgaaatgcttaaatgtcagagcagcattgttaggagctatctatatgcatagcaactatcatgtgttccaaaaaaaaaaaaaaacagagagtacatttcatgaagggaaataagaataaaagactgtatcctgctttaccattcccaaaagacccaggaaaatcttttaacaatttaaatgttgttgactttattgacctatgtattgtgttcctctcaaaaccaagggaaaatatacaaagtgtttacatatttatcctctaggggcacaacaggaaagccaatcaacgttagtcttcactttcttcattttcaaaagtagcatctagcgtctaacaaatttccatgtgctcccacatacaggcttttatgaaaggctggtaaaggatttattttctttaaaaagacgtgatgtcacataaaattgttggctatttttttctttctggccaggtaattttactctttggttttttcttccatcttttaaaagtatatttcctttacaaataaaataatttagctggaattatttgtaaagtaaattggttatttattatacaatgatgaataattatatttttttctcaataaattgagcatctttggatgagatcaagaagctgctctagctcaagtggaagtaacagggagaagttttaaatgactgacggctgaaattgtcataagagaaaggagataaagaataccaacactcacctgcttcaatcaagtgactgggcaccaccacacaatcttaggtatccctcagagccagttccacaatactctcccgctttataaagttctttg

SEQ ID NO: 112235 - DNA, 1079 bp, Homo sapiens
gagactctgtctcaaaaaaaaaaaaaaagaatatgctttgaaagcaaacaagaacctccttaatcttacatgtgatttaatttgctttaatgtgctttgtctaggtaaagcaaatttttccatgaaagaaagcttggacagaaaatacgcttggtaaatcagtcttctaaaagctgctggaggtaaggaaaaaaattagtaatgtaatgctgttgctaaactgcccatctaattaattctgggtaatatattaacaataattttttgatttttttggcagaaaatttgccttttttcactactcttatctcaatttacttcaagaagattcctttagttggctaggcaagaaaatgttccttgcctctcttacataacttagtgtctccacttaaataaaatgccttaaggaaaaagcaattgcaaaggaggtaggaagaaaggcaagaacaaggctaaaagaacttggttttaacaggcatatacatgagaacctttatagactaagaacttctggagggtggggtgggtcatcctgggattaatgatgaaaggaatctgtcacctttgagcatgagtactttttacctatggctccgcaacaaagaggctattgtacttcaaagcagaagctccaaacaatgacaaagaaaccaggcaaagggggccagaggggttgttgcttaccgaacatttcggtagcattttcaaaataattggcttaactacactatcaaactaagttataatttcaagggcaccacaattaacagggatttatgttaaagttctgttaagtagttctttgttctttctttctttcttgtaaacagatctctaagggacgtacccagggcctgcaatattatgggtcaatacttcatgaaacagaaggtactcttgatgcaaggatggtaagggatgtttggaatcagaaacatatagtcactctgagtatgataggagagatgaagatatgatatgaagaactaaataaaaataaattctaagaatattaagttcacactttatatactgctccagttaaaggcaatttagtgagttgttaaaagccaggc

SEQ ID NO: 112236 - DNA, 1460 bp, Homo sapiens
tccgccgctccccttctttggcccctttgtgtccccgcagtgtcgaggcgcgggccctggcaggtcctttctcgaggcagggggcacggtagcacagggagcttctctttgtgggcgggcgcgaggcccgctagggggttatactggggaacgtgcctgcgcgtgcttgggtaagaggaggttgcatgagggtcagctcgtggtttcagtaaggaggggcgggcgggggaggcggacgaaggggagtgaaaagcaatggaaaattttaaaagatacccccgtccaccttctaattgttgcggcctaacaatgaagcgcagccataacagtcctgagccactggcatgtttgcgggccctttattgccttgggaataaactgctgtggcattgtatcgtatattgttttcatggccttttttcctctctttatttttcccctgcagatagttcatttaaagcccccatccctgcaaggtggtgctttctaccaatatgaatcttttcaacctggaccgttttcgctttgagaaaaggaataagattgaggaagcgcccgaagcaacccctcaaccttcccagcctggcccttcttcaccaatttctcttagtgctgaagaggagaatgctgaaggggaagttagcagggcaaacactcctgattcagatataactgaaaaaacaggtgagttacaatgttaaaattgatgtaacatcaaggacagtttttaaaagatgaaaggcagaagggattctcatttttattcttgatgtcatatatattgatgcattgtcctgcggtgtgcccttttaaatacagctttgggactgccataagcaccatgtaccctcaactgagcatccatccattgtcgcctcacttttatatgagttcttcgaatatggccccatggtggaagttgaaattagaatttagggcatccataggtcagaacggttgctattggaagagcgatgtcagtgattcagtcctatgataaactttgaggctatttgggcagacattttcattcattccagtattccctcaaaatattgatcatctactgtgagctagacattgagcaaggtgcctaaagacaacctctgtacacaagggaagatcagatcacatcaagttcttgcatccacctgacttcctggatgtcctcagaatgcaaatgagtaattggtattcttcatggtgaatgaacatttttaacctcatcagcagattgtcagagacaaaagtatttgaggataagccaaaaattaagatttccactcgaatctatgttcattgaacagttaactattagaggaatatatttgagctcttgttgtattataggaatagtgataagtgcttcaccttctgtcatttaatttgcacaataatcctacaaggtagatattactgacatagaggttaatgtgaaatgagattcagagaggttatta

SEQ ID NO: 112237 - DNA, 2771 bp, Homo sapiens
gttattttgcagtttccactaaagtcttgttagtaaacaacctgtgaaacagaaaatgtaacaccagccctggttgatgattaatttttttctttaaaaagtggtgagaattttgatttttagattggaaacaatgaatgaaatttgagattttagcacatgattataactaacaacagattcgttttccagttgctcaaaatatttttctcctttttattctcttgcagaagattctagtgttccagaaactccagataatgaaagaaaagcaagtatatcatatttcaaaaatcaaagaggaatacagtatattgatttgtcttctgatagtgaagatgtcgtttccccaaattgctccaatacagttcaagagaaaacattcaacaaagatacagtgattatagtgtaagctgattaatagatatattgtatttgcatgtgtgtgagattttccaagaaaaaaacctacctaatttgagatattttggtgacttccctttttttttttttcttttttttttttgccccacctgcctttcttggccacatcttggttattttctctaacttatagtcatggagaggtacaatgtgtgtgttttctggataacagtgatttttttttttttttttttttgataacagtgattttgagagcagatacttaatttccttattatggaagtttaaaagaattgtttagtacctttgatcgtgtataactgctttatgatttattctaaagtccatgaatcaagtcattttaacatgtttattggaaacagtctgagctaggcactgttttatgattagaaatacaacagtgaacaaaccatccccagctttctttctgccctcacacagcttatattctagtcaggtagaaaagtaataaaagatgtagtgtgtcaaaagataagtgttatgggcaaagggaagaggaatagggagttagggtcagggaatcgtttctttttttttttcttgttttttctagaggtggggtcttgctatgttgtccaggctgctctcagactcctggcctcaagcagtcctgccatctcagcctcccaaagtgctgggattacaggcgttagacaccacacctggctcgagggtcagggaatggtttctaaagagcgtggtcagaaaagcctcaattgagaagacagtgcttaattgagaagacagtgctggagcaaagacataaagggggtgagaaagtgaaccatgtagatgtgggggaaagagtattccaggcattgggaatatcatgttcagtgactatattatgcctggtgtttttgaggaaagtgggagggacatgatgcggagtgaaggatctgaagccatagtgtaaaggatgagatgaaggaggggcttcatcacattagttccataggctgtttggtttttattctgactgagatgggaattcctaggagaatattgaacagagaggtaaaattatctgagttagatgtttaaaaggtcttaatgactgtgagggagcagtagtaaaagcataaatattgttgtaataacccatcaaaaaatgatggagacttagatgaggctagtgcctgtgggagggataataagtggttagattctggaatatactttgaagatggagcaagagaggatttgttgctggatttcatgtgggttgggagataaaggagtcaaggatcaccctaagatttttggcctgagcaaactggaaggatggagttactaggtactgagataaaggtgactgtttctgctgtgggtgggcaaacaccttttgaaggaaagtcagcaattcattcttgaacatgctatgattgagaacactcctagacgtctaaatggagatgtcaagtaggtataattagatttgggacatttgagttctggggagagattacatgtctgaatttactaggtgacagagtattggtttgctatttaaagccatatgatcagatgaaatcagtgtaagggacactagtatagtatagctgaagaagggaagtcctcttggttgaaatactgaggctaggggaactctggatttttagaatcagggagatgagaagaaacctgtagaaggttctgaggaggagcagctattgaggtaaaaggctacatggtcttctagaagttaagtgaagataaagtgttgtaagaaagagcaagagatcggactgtctacttctgataagatgaggacttcatcttaaaatgaacttttcacatgaagctgtgataaacatgcctaattctgaaatgtactccaagataaaatgtagtgaagatcctgcatggttaatcctgaggaaaattgtcatattttggaaaaattgtagaaaagttgcaaaaaaaaatgcattatcaactctcacagtcttttcagaattacccttgttagcattttcccacaattgcattatcactcttcgtaaacagcaattacaataactactgaacactttgcctgcagtattttctcatttatctcctaaaaacaaggtcattcattcatttgcatattaacagtaatatttcaaacccagaaataccaattaacactagtacagtactattatctaatatacttttcatatttcaattttgccagttataccagtaatgtcctttagagcattgctactcaaaatactgatttataaataaggaatatgtcttagaatgcaaatcagggtactgattccttcaccaagaatatcttgcagtgaaaaaaaaaaaacagctgaactaag

SEQ ID NO: 112238 - DNA, 3672 bp, Homo sapiens
ttctgttatttatataggctaaatttcaaactaggatgttcaagcaaagtgtatgcacattttaaattttaatatgtatttccatgtccttttgttaaaggttatgccagtttatgcttttatcaacagtatgtttctgaatgctcatttttctaagtggattcttactactattaattttttcgaggtttaaaatatgtacaaaaatacaaaacgatgtgttcccatggacccatcattctccaataattatccacctcatttttcttccactaagtggcctgtattcaagtagattctacataagatttttattttatccatatgaaatattttaaacctttaatttcctccagtttgagcaaggagacagtattttgtgggtgctacctacagtgtatcaagattcttttttgtcttctatttattaatagctgtgtgaccttgagcagtgttgcttgactcttctgtctttgtttccttagcagtaaagtagtataatagtgccaaactcaaaggtcgttgtgaagaactaataatgtatactacttcttatggtgcctggtacatagtgagtgcataccaaatgttagcaactatttgtttaagggtcatctgatgatttaaaaaaaaagttagaggtgaatgttagctgtgtcttcctcattatttcgtccctagcacttactttaaaagcttctgagctaggattgtgccactgcactgcagcctgagtgacagagcaagaccctgtctcaaaagaaagaaagaaagaaagaaagaaaaaacctcctgaaaaatgatacgctcagtgaacatttgttgagctgcaaaatagcttgggaagttttgtagcttcccaatacattcttgctctcacattatctcattagtccataaacatttcattaaaaacaggttgtggaattactttattccacggtggtatctaatcttttttctcttgagcaattcatcttattcaacttattcattaatttcacaaatatttattatgctgcttttactaggtagcacaggctgtggcttaggtactgaggttacatgaggaaacagtggatacaacctctgccgtcataagagtttacaatcattaaatttatttaacttcagctgagctttttcttattccattgtacttcagattatttcaattaaaaaaatgttaaatggcaaattacaaggaaataaaaaattaggattttctggttttttaattaaacttccatgctgcatcatggaacggacagaacagtcttatcagacatcttcatttttagtgtagtgcactttgaggtagtatatagaatgacaggtttgtctaaccttgaagataaggttaatcttcagtatactatgttattgagacaggaaactatacttgccattttaggacagttttcaacaaaagacctttttaaatacctgtaagtgatctttaacagatccagaaattgtgacagttcccattgtttcttttaaccacaaattgcagtcttaacagacagtatcatcctgcgtattaaacactagggatgtttttatgctgtttgttttgaaagtttgtttttgaatatgaaattacagaaacaaaaaaatgtatatccaaagtttttactctacttcagaagataagagtacgaatttattgatgttgtccggagtctctctagctgccctgttgtgtttttttttttttttaattttttattttgagacagggcctcactctgtcacctaggctggagtgcagtggtgcggtctcagctcactacgacctctgcctcccaggctcaagtgatcctcacgcctcagccttccaagtagctgggactacaggcatgcaccaccacgcctagctaatttttgtagtttgagtagagatggggtttcaccatattgccaaggctgatctcgaactcctgagccccagagatctgcccacctcagcctcccaaagtgctgggattacaggcatgagctgtgcacctggcttctgttctgttctttttaggaaagaattcagcatgtctaggtgatgtggcaagattatctggtttgaaggtttttttcagacttaaaatattacatttagaatattgtggttagtgtttgtagtgacacaaatactctgctttaaaatgttaataacattccatttttattttgtaatagccatgttaatgaaatttttaagctgacatgtatgtatgtatttgagctgcatagttagggctctgatataattaatgctgaaatcttaaacctttgtagtctttagcaggtgctttcatagtagcacagcaatatgtctgacaaacttgttctctgaaagcaaaagtatttaagaagtaggtaaatatatacataatgtatacaagcatacataagtagcatatgtagctctagtttgttttcttccagtcacgacaatatgcagatttcctgttactgctgtactctatgttatattctcttgtttttacattaaaagcatttgttgcttaagctctctgtatctctatcctcctcatttgtgaaataaaaatgttacctactttgtaggtttgtgtgtgaaaagtaaatgaaacaatagtttataaaagaccttgtgcaaggcctggtacatagtagactcagaaattgctggtttctgtgatggtattcagataacttacacttggtgggggtcagctttatttcactgctcaacactcagccacttggaagaatccctccctcctaatgttgctctgtagaattactcatcaatttagagatgtatatttttagattaaataatgtgatggtttatgaatatagtattacagtgatttctacttctgaaagactgcaaagaatgtttactttttttttcaattcagtcatatgtagaacaacaaacactgggcctgatatcaagagaactgtctagtattcattataatacatttttgcctttgttttacattaaattgattttttgctatttctgtgcaaagtttgagtgtgctgctctgctttaaaaggtggtgggcccaggaaaagaaaattatcttcttcttcagagccatatgaggaagatgaatttaatgatgatcaatctataaaaaagacaagactggatcatgtaagtttacatttgaattacagtatcaaaattggctgcttaaggttaggatatgtggagtttgtggatattattagacctgaaaatccacctaaatgaattcctttctatcacaactaagggaatttacgtctacatttaatttgtgactgtttttgctttttaatttatccagtatgaagcctgcttaagcacagactattttgtgtctgtggatatcagacctgaaaatttgtctaaatgaatcattctttcttttctttcacagctaagccagataatttgtgcttgcatataatttgtgactgtttttgctttcttttaaatttatccagtattaattgcttatctctgccctcttcattacattgggttctctgaactgtgtgcgtgttcatctccaaatttcccctttttataaggacaacagtcagattaggtcccactctaatgacctcattttaacttgagtgtctcactgatgaccctgtctccaataaggtcacattctgaggtactgg

SEQ ID NO: 112239 - DNA, 1369 bp, Homo sapiens
tcccaatgtccagtctaaagaggcagataggtgcggcctttcttttttcttaagagtggagtttgcaacatgctccagactacactcccacgaaagtggtgggcctcagagtgaggatggttattccttcaccctgatatgtggcatgtacgtatctgaccagtaccattgaaaatacccactacctgtatcaagtccagtcaacatgatgtcagtatagtggatcaagtgatactctctagactgtgcaaaaccatctaagtccatgagtactgtattatttgagagagccaggaaagttactctaactctgaagactgaaggtatatcattaaacctgccaagataaaaacggattgtttctgtttgatctaattgggaaaggggaaaaagcaagtacttgattgataactgcatagccatattgatttgctccagcaaaaataccacatcctgtaaagcagctgcagctggagtttgattgtttatgatactcttaaatacttgcaagactcatctactttttgtataggtcaaggaggcatcttacattgggatgggatggtggtgtcaatatctgcagttcctttaggactgtagtaattgcttattgttttgattgagagggacaattctagggacttggatttggtgtttcctataatagtagcccatacatcatgggtcagggaactgatatagtatgggatttctgccagtgccaaatatgtctgttccaactatgattctggagatggaaaaataagcactgggtcgaatcatatcccttgggcccgctgagacagatacagtcccaaattttatcagctagcttttgtaaagtgtctgtgtaacctcctggaccacatgagtatattcagtcaccagggataagcagagctggcataagtgtgggacccaagagcaaacaacacatgataggcacaccatctactaaatatttgattccgaagagctgtttactgttttccagatattttatgtatttttttattgaggtgaaattcacatagcataaaattaaccattttagagtgaactatttaatgctatttagtacattcacagtgttgtataccatcattcctgtctagttccaaacgctgtcatcacctcgtaatagcatgctatacccattaagcagtttctccccattccctcctccccctaacccctggcaaccgccaatctgccttcagtctctggatttacctattctgaacatttcatttaggtggaattatataatatgtaaccttttatgtctagcctcttattttttaatttcagaaaaatgtgttttatttgttttttcttttttcaactttatgttagaattggggtacat

SEQ ID NO: 112240 - DNA, 3074 bp, Homo sapiens
atcagtacttcattcttttttatgacttagtgatattccattttatgtgtttaccacaatttgtccatgacgcacatttgatatattaacaaatgaacaactgaagtttagttttcacttatgtagtgaaaaagcagtggtctagagttagatacttggatctgttccctcctcagctggttgttgtccatctgtgagctttaaaatactgttcttggaatttcagtgtgcctgggctgtaaaggtggcagtatgaattttgaagattttgaaatggtttctccagatgggtttcaccagtatgtcttattattcccctgctcaaaatcctgttgcttcttaaaaaagactaaccttaggctttattccatgttagctctggtttaattcttcatccttgtaacctattaacattctctgcatttgagcccaagtagaccacttagtattatgaaacacatgcaattttcttctttagtccagatatccatagcattttattggtctctgttttatgaaattttattttactccattgtgcagaggaggtatcagaatttagttatttctatctaaggtactgaaagagaaaaatagcaattcagttgttggataataaaggaggttgaagaagaagattgtatttttctccatcttgtgtgtatagcatgtggtgcagttctaagcagagtagaaaaatgctttttgattgactaaaatttttcctatgcatgaacacaaggagtcttttctttttgcttaaatgtggactttaaccagtttcttcaagtgaagttaagtgacagagaagaaggaaaagtgagactatgtatagccacaattctcatattaattaatctgttcggtttatacattatttagttccacttaaattccttttatcattgtttcagttttatgttgtgactgaacaattaatatttaagccattctgtgaatcaagagtgaagtaaaagtaaactcttctcagaatttgaaatttataggtggatatataatagtgaacatagatgagatatttgtatccttttaaaatttaccgttgtcttggagaaggcatcagtatacttgaattatattgagttaatttgaggatcattctagttttttaggagatttatctcattttaagcactgagaataaagtttgagttaccggatatgcaatcagggtctttcagtgatcttaagtcagcaatatttttcatccttaaagacataaatatgtcaatgttcacagaaacaaaaagaaacagtttggattcttctgactgatgatgataattttcagatcaagtcaaaatacaatgataattgccttaagaccattgttattgatatctcttaaattgttttcttttttttttctccccattagggagaggaatcaaatgagtctgcagaatctagcagtaattgggaaaagcaggaaagtattgtactgaaattgcaaaaggaatttcccaattttgataaacaggtgagtagtcgtgtatgaaaatttaatcagtgtgtactaagtgtttttattataaaatagtgttaagagttcaaccacataaaagcttagggtgagttttgtattcttctaattaaatgttctccttttatcaatgttataaagtattttcatactgtttatttatgttgtttatttaccttgtttactatagtatctatactgtatccctaagtcattaaaaaataaccgtaataaaaattgtgaactcatttataacatgtaagtcatctagaaagtcatctgtaaccctgcccccatcaagtaactgcttagtttttttcatgttctcattcttgaaatttcttacaagaatttaaaaagtattccatttcagtgtcttaatattttataagctttctactacttcccagatagtgagaatgttttcagagtcattaaaaaaaaagactcatgccacgcatcctgttgctaaaaggccctctgtttaatcccatgatcatatatagaagcacatatttgtttagcatttagagtacatttacacttgcactgatttatttgagtatatatgttcagatagtacatctactaaattctgatgagctgaatgcaaaatcttgttgcaatattggttctttacctttgttgaaactacgttttgaagttagcagtttgtaaaagcctagctgcatattgaaatttcatttttaattgagaaaacatttcttgatcctctagtgttcacagtacttcatagtgagcattagaaatgcaaaaaaatgtcaagttttctttcctttgaagactattgtgtatttgtggaggtgaaattacacagaaagcatttgtaaagcagtgtaaaaacaagtgcaaaataatcagatgtgaattctctgttttcaggtgattaacttatttttaaaagagcatagacgttttctgcaagttgctaatttgagatttttaacaaaaagataaatgacttatttctaggaacttagagaagtactcaaggaacatgaatggatgtacacagaagctttagaatctctaaaagtgtttgcagaagaccaaggtaattattctgggtcatagaaaatacatacttctcattatagtctgtattttagtatataagaaaatggtatataagaaaagctattagctgttaatcagagggtgggattgcaaaagatgttgaaagtaatgatgtaaaaacattctttaacaaccagtttttaaatgttttgacctgcctgttctttatcatagtgtaaaacaaaacaataaatatctttttctatttgttcagtctttcttaatagttaaggctacttttaaattgccatgttttattgagtgtaaaataacctttttaacaactgtcaggatggatcttgtgattggtgatatcatgtcattactgtaatgtagatgtcttagcctatacttgcacagatatcaaaagcactagcatcaaaaacttaagggtatcataggcatgaacacattttggaacactcttaattctaggaaccaaatgatagaggagaggtggtaaggaagagtt

SEQ ID NO: 112241 - DNA, 2652 bp, Homo sapiens
cgtgagccaccatgcccagcctatttgaataattttttaagtaacgatgcaacttagaatattgaagatagtattggaaaattatggatagttgaaacatacacactttttattagtaagctttatagtagtgtaagcatcattctgctatattcttcagtgttggcatagttgagtggggctgctaggaatatctgagacatcatacagatacgcagctgccatttgtgttctcaggacctttgttagaaaacagagatttatatttaattcattttaaaaacaagttatcacctgcttttgaaacaattgtttaacttcaaattctacttaagtatttttaaagtgtatcaaatttaacaataaattgtcgttgaattcttctgtattcaataggaataggtaaatgttttaagtttttatttgaagtctatctttatatttatgtatttctaatttagttactgtttttgtcttttatatacagatatgcaatatgtatcacaaagtgaggttccaaatggaaaagaagtttcttcaagaagtcaaaattaccctaaaaatgcaactaaaacaaaactaaaacagaaattttcaatgaaagcacaaaatggctttaacaagaaacgtaaaaaaaatgtttttaatccaaagagagttgttgaagactctgaatatgattcaggttctgatgtcggtagttcactagatgaggactatagtagtggtgaagaagtgatggaggatggctataaaggtaaaattcttcacttccttcaagatgcttcaattggtgaacttactttgattcctcagtgttctcagaaaaaggctcagaagataacagaactccggccctttaatagttgggaggctctggtaaggctttattctttttttccccttgtatgtgtgtgtgtatttaattcacagtaccggttatagtcaagttgtcttcagcccaggtaagcatagatgggtggccttatcctgtgtaaagtcaaacattactttcattgtaagccaatagtatttcaaatagtgtcatatgacctaattttgaatgaattaaggggtgattttcctgaaaaaacccaagctgattggctgggaatactgtcactcattcctttgcatagaaacttcgttcatttcactgcagaagaagaaattagagcttacatttaggaaggagttgtttgctagcctgttctgatctgttactgctgagacaccatgcagaaagcaagaatgtggcagaaattttactacaactacttgaagagcaatagcaacggccaggggagctccatgattcaaaatgccagcctaagtgttttatgcttcaccacaaaagaagcaattgtttattttctttttttcttctaaaagtaacagctcagtctctaacatgtttttgttggttaagcaacgtggccattttatggagtgtagcaggctgcagcgtttttaattggaaagatagaaaaatttctggaagcctataattcaagcgttaggtgaagggaaggcataagcactggtaagtacactttgcatgatcattttctggaatttgactttctataaacaggttgtatacagaatacctgcattttgagttttatgaatgccaacagtcatcaaatcttattcatacagataaatataagaactcttaaattttgcttcaacccttacgtgggcttttatagcaggaattgtatataggcctgttgtaaaagcaatatggatgattttttacagctttaaaagatgcagcgactcttgatgctttataaaattttttaggaagttttattccctaagttagggagcaaagttgcttttgtggttaattttatacttgaaacaaatctaaatgagcattaaatgccctgataagtgtcttgaagtggcaataggggagagtccctgaacaatggttgtaaatacatttttttaattaaaatatttgaaaaatacagaaacaacattaataatattccatagctttaaaaaataataataaaaccatttgttttgcctgaagcctttgcttttccagagaacatctgtcaaagcaggccctttcaaaacttgtttggctttgcctgagtgatttatttgttaaagtatttgctgaagggctttcttgttcttcttttcttccttttcttctttcttttaatctttaatggtctcttatgttgttgcagagttgggttgctcaggcttgttgagattctaatttatttaataagatatgcaattatctgcactagtttgtttagttgctgtaaatacttgcccgaatatcttatagtaaaagtaaattatacaattttaccagaggtatatgtgccagatgtttttaaaaaatattcagcaacttaacatgtggaaagcatatttcccctactaattaatcagcagagtttaaattagtcttgacatgaatttggagattatgcattacttacttaaacctcctaacatcttgcccctttctaaaagttgaacataaagactatattgtttgttctaaccatccatccaaatgtgaaatattttatgtaacagtctaaatgtatctgaaaagtaaactttctacttgagttcagtgaagacagcaaagtaggtgaatgagct

SEQ ID NO: 112242 - DNA, 1026 bp, Homo sapiens
cacctggccaatttttatatttttagtagagatggagtttcaccatgttggccaggctgggctggaactgctgacctcaggtgatccacctgttgcggcctctccaagtgccggggttacaggcgtgagccactgcatctggtcctttgctttgtttaactggtgatttctgtaaaatacctggcctaaattggccacttaaagcatggtaatacatatttcttccttctgaataaggtggcaccagtgaatttatttgtaagattactatatattcaggctttgttttaatttgtgtaagtttgataagtttgtattaaaaaaatctgcaagtacattttgagtactttgtaggctgctgccaggtatttataataatgaataagcttgggattctgtcctcagggctgtcttttggtaagtggggatttaatgatttgaaaattaaatctgcttttaaacagtttcctccttcctatggaaattcaaaaatatctgtacagtaagagtgacacactgtggcaagagagtgatacttcagatgctgactgtttttgaaagaaaaaagtcctttgagtagtcacttgagtttttaatgaagagatatgattggggccatattgatgagtttttttcatgtaattattcaggaagtagcaattagctttttaactttcttcctcctgaaaaaaagatttatcattttttgagaatgatttgttttacctaaaattgaaacagcatgtgcagaaatgaaaaagtaaagtttaccccaaattctaccaaagatacccaccatttaaggtgttttgagcatcatctatttatgtatacatttgtatacttcataccatgtaagcaggatcatcttttctgtggttttcagtaacttcagatttactaatagatcccacatttacagggtactttgtatttcttaaatcttttttgggggaaagttaagtaacttacaggattaagtgatttttgtgttcagaaaacagtaacatggtggcagtagagtgt

SEQ ID NO: 112243 - DNA, 1801 bp, Homo sapiens
tttctccagcttacatctcttccctaagatacagatctttatttaactaaccactggctctttctcgaaaatttggtagctgccccaaatttaatatatccagaaacagacttcctttgccatcttggtaaattttaatctcaatagatggtaccactaatctgttagcattgaagccagaagtctgggagtcaggcttaactcttcattcatctccccacacttaatgggttctacctcctgaagatcgtgaatcttatcagtttctccgtgtccaacacagaccactattgtctctcaactcaaagccttcttaatagttttttgctctcaagccttcttcacattactctcatagagttctttctaaacaggaactctctaaaacccttcaatagctttttaatgcccataagttcagtttagaacgcattaaaatgattcatacccttactgccttcctgttcagacttgtctgttgcttctctaggttctgacatgtgaatttatctttccattaaaacagttcttttattatttctggcttcttactccataaggaattactaggtcttagattttattagtctttttgtgatgagtgcccatgaacttttgttgtttcccttgtttataccagaggttatgcttgaaattgttacttgtgtttcccaatgttcgtagaccacaaggacagggctgtgtctatctcccagataattcaacagttacagtaatttctgttaaaaaaaaaaaaaaaaaagaaagaaaagaaatggtagttggttacagaaaaaaaaaagtgtattttgaacttttaaggtcttaaattattttatttagggaggtactagttatacagtgaaaagggcatggaatttttctcttacccagctttgtgatgttggaaattgaaccttagttttttcatctagatttggtaggctagtcttggtagttgttacgaggatttaatgagttactgaataaaaggtatctaatagttactagcacataaatggcacctaatgtatgttcattccttatttcctgattaatttgttgggtttctctcacatttcaatgtattacacacacatactacaatcagcatgagattggtttatggcctataatttttggttgcatttaaaaataaaagtattttagctaaaagttctaatagaacctccttaagacactgattgttatctatactgctgcttatgaatagatctttcccctgaaaagcacaaagtagggggagtaggagatcatattgtgattatgaattttgtccctgtgaaaaatatagagtagtatgcaaataaacttagtatttaacagtgccatttttgaagtgctaagaatagattggatattttgtatatttccaagttattctaggataaatatggaaaatgtatattgctataaactgtattttatttagttatcttagtatatccaaaaagcacttaattactattgcttgagctttttgctgaacttagaaatactgtgatcacagtgattacttagagttgttaatgtgattcttgtcataacttggaaaaatatgctaaataggatgacatgaataaaaatcgtgtggtattttcctaatagatggttttattttagtttcctagatttagttctggcttatgggattttcatttttgccccaagtatttcaaatagcttttggactttctcatcctttccactaaaaatattttttgtcatgttttatagaatatatattttcagctatctatctgaaaaattctagttctga

SEQ ID NO: 112244 - DNA, 1116 bp, Homo sapiens
tcttttaagattaatcttaatatgtaatagtcataggaaatgacaagtagaggtgagagatcagatttgcagtgactacatttgatactattacctttggtattagggaaaagtgaatttaagattttgaaatgtttttaaaaacttgataggagatagtaacaattacttgtgaatgtttctcttataagagaatagctgccagggtcaaagtaacaagtttgggattatgcattttttgaggtaagatatattttactttaacataatgagtttgatgtgtgacagtagaatataaaagtgaaacatgtagcaactcaaatataaacatgaagaatcaggttctcttagtagttgactataagctcattaagtaaaagtttaaattagcaaacttgttttcctcataaagaaatcaggattgcctttctctttcctagatctgaactattcaattatttttctttttatgctatagttcacaaagatgtccaaaactaatggcttatcagaagatttgatatggcactgtaaaacactgatccaagaaagagatgtagttataaggcttatgaacaaatgtgaagacatttcaaataaattgaccaaacaagttaccatgcttactggaaatggaggtggatggaacatagaacaaccttccattctaaaccaaaggtaatctttgttgaatatatttattcgtattttatctcaattatacaaaatatctgaatttatttctgtatcgtgcctagaaagtgatatggcaactagtggtaggagagaacccccaggttttctgtaatggcacataagtggactatgaactgtttttcattgatttcccccacccccaagtagggtattttattctatcatatcattataaattaaagggggggatggtatgatactatatgaccagtgtcttttttgcctcataacaggtaattgtttatataatcagagaaactgaaaaagtggttttagttactcctatacacaaatttgatatcctaaaaaaagtcagctgcttaattgcatcagcgtaaaacctcctttcctagcccattttctttttaatcataaataaaatgaaatgatatcccatac

SEQ ID NO: 112245 - DNA, 1039 bp, Homo sapiens
ttgcaatgttacacaactttcaaaatgagttacatctgttcaaagtatttctgataggttaagattagcagtaggatctcattaaaattaattgccttagttgctgattttatttacttctgatatttttctaagttaatgatcaaagcatatttgctgatcattggttaataatttaaaatcaaggtatggaaaaaaaaacaagatgattactggcctttaatagtaagctacaatcttttctgtgcccttctagggtgctatgggatggtgtagggaaacgtgatgcagttcccacaaagaagctcttttctctgttgcatagaaagaactatatcagcaaatttcatctcctaaaagtgtagttggagctgctgcttcttgttctccagcattggatatggggagttcttcactctacaagacttacccagttgagtctactttatcataatttggatttttaaaaatcaagtgctttattgcatcactttaaaaatttctctctcaaaaccacattcacaaagtcctgttacttgtaaatagtttgatcaggtaataaactatcctttccattagactgaggattttttaaatgaaatacttaatagatgagaaaaatagttgttgttgttgtttttttaagtgcttgttggatcttatccaaagtacaacttctaaaacctatatggatagtctctttaaagtttatttaagtgcacttttaggggttagaatttgttgtcttgatttttgttcttcagccaaggtaagagttgcataagcaatttttacttggtgtactggccaggcattgtgggtacttagtatgtagacatttaaagttgtctccttgctttagtaaaggatttattagcacagaggaaaatattagactatcctgatgaataacctatcatgcttgcatttttctctaaacagaacaagttcttcatgacgaagtttactttgctacaaactgttgcaaatttatgtgaattgtaggagaagaaagtttgccttttagaaatacaaatat

SEQ ID NO: 112246 - DNA, 1015 bp, Homo sapiens
tgtacttcaaaaccattactttcataatctttattttaaaatgtcaaaatttaaattgtttaaaatataatacagtgaggaaaaagaaaataaatccttagtatttctcctgttttattcttactatagatgtagccatctctaaagctttagttaattaatctataatttatcagccttaaaagatttctcacatgttcagaatacaatatatttaatcaagtgtgtcttgccttttgagctaaatctgccaaggttcttctgatcttgttcatcctgaacttgacagcatggttcctaccctgttcttacacaggagctctgagaccctttgtcagtgatgtgaacgcaaattaacactgcagatgtggtttcactaactcaaaagtagtaggatgtaaatgtttagtttgaacatttctgtcactacagactaatattgtggtagtatttgcagcagccatgtcatacttacgggacataaacttttggtcggacagcatccgtaacctgttttctatgaactgctttaaacaagtctctctagccctgtatttctgtattttaaactcaaatttatcacatcacatgtacccctgttgtttctattttacgcctttctcacctttgaaaataattttggaactagtttctctggcagatttaaacccaattgaattttcagactgtggagaaatcatagtaactctggagggaattttttttttcccctaacaaaacaataacttcaaaatagcctgttgcctcattttctttcattatctcagaaaatctttaaatcacttttttccttagtgagagataaaaaatcttcagttcagagatattttaatactctgttgagaagaaagcacttaacttattcagaagacctgagcaaatccccatgttcttaacagtaaattggtggttcagatatatatttggtcatgaaaattcttagaaaactgtgaagcgtcaaaatagatgggaaatatgattatatagcatctaa

SEQ ID NO: 112247 - DNA, 1004 bp, Homo sapiens
tctatgataacatgttccatttgttactacttttatagtagtagcatagaaattatattgattgggaaagcaaagaccttttttaaaattcagcaaaagaattgtaaagacagaattagaaaattataaagacagaattagaaaagaattataaaaggcagaattagaaatactgctttttctcctacctatacttttagttgtattaaatgggaaatgttttataagttgcataccccacagttaaaacatagattctgatttaagatggacatcattcaactacctgttcttcactcagttctaattatgtcttgatttcagagtttgatccttcaacaatttattatactatagctatgtccagacccttccctgtgtgcaaacaggatatatgcaagaggagattaaggggacaggataaaagctggagaatgggaggcatggccttgtcctatgttttcacattaatgtaaggtgttttagtgaatatgagaataggctttggagtgagatcgacatcctgaattaaaatcttagtcttaacactttgtagctatgcaacctcaggcaaattaagttttttttttttttttatctgttaaagtgatgatagtaactactttatgggatttttaaagggttaaatgaggtgatgtttgaaaaatgatatctgtgcctatgtataatagatgttcaataagtgataactgttaatagtttttaaccatttgaactattgttttcattctgttgttgttgttgttgtaattgagacagggtctggctctgtcacccaggctgaagtgcaatggcatgatctcagctcactataacttctgcctcccaggctcaggtgatccttccacctcagtctcctgagtagctgggactacaagcatacgtcaccatgcctggctaattttttttgtatttttggtagagatagcgttttgtcaatgttgcccaggctggtcgcgaactcctgagctcaagcaatctgc

SEQ ID NO: 112248 - DNA, 1041 bp, Homo sapiens
gaaagtatttattaaacctacctggccaaagtagcaaattatgtttgtgtttttttgtcctaatacttttaagttctttaatgtgctaaaaatcaaatcaacacaattcaattttctattatagatactagcttagtattaatattatcatagttaatattctaatcatttatggaattaatttggaggtactatattatgaccaaatatggaaatgcttgattcttactgccagaagaaatagaatagagaataaagtttgagaagatctgaaaaatcatttatgtcttgggttcattttttttaagtaggtgtacatagcatctaacagttaaaaggtaagattagacctaggcattttagtttttatgtgcattgtaataactaatagaaaactgatagaaatatagatgtgtaatatttggtaactctctctttaccagtttgtcactcaagccctatcagaaggttggtttgaattggctggcattggtacataaacatggacttaatggcattttggcagatgaaatggtaagtgtactttatttctaagatttgttgttgaaagtgtcattaaaaggtattcttgctgtcatttaaaacatgaaacttttttttgctactgtagttaactactgccacctcagtaccttatattttatctcatctttgtttttgatagagttagttctaccctcctcactcctccccaagatgaagatagatttattgtctttctgattatcagattagtaaatacatgttgcaaacataaaaatacaaattaaaaaatcgaaatcaaagtcacctgtaattctaccacttaaacaagaactagtttggtgtcttcttttctagatactaccttctgcagatgttgtgtatgtacatgtgtacgtacatacatatatgtgctttttctacagctgcctttaaaattgtaacttagatccctgtccttgtcagtaaacaaatccacatatatatcagcaacatcatttcagctattttatttttattagcggtctctccgggtct

SEQ ID NO: 112249 - DNA, 1580 bp, Homo sapiens
tcttctgttggatatgaatatttaggttatttcttttcttttcttttttctttctttcctttttctttttaagcaggtgcttgctctgtcacccaggctggagtgcagcggcgcactctcagctcactgcagcctcgacctcttgagcttaggcagtccacccacctcagccctcccgagtatctgggatcacagacatgcgccaccatgcctggctaattttgtatttttgtagagatggagttttgccatgttgcccgggcttgtctcaaactcctgggctcaagtgatccacccacctcagcgtccccaagttctgggattacaggcatgcaccatggcacccaacctatttaggttatttccagtgtttggctattaagataaaactatgaacattcttacccaagtccttttgccaacataagcgctcatatctcatgattatattcttaagggtagaattgctgggatagattaggcatatgtttcctccatttagtcatgggacattgcccttaaaccattcagtggatattaaacattcactgtgtctaagcaataaccaaaattatatcctttccatgcaatgcaaaaagtcttccatattaatgtgtattgtatatgaactagcaatgaagatctatccactgctcagtaaagtaagttatagcatcatttggagattataatcaattctgtcatttgagaactaagaacatagtagaaattcctttagagttgcattctgggaaatcaaaagtgaatacagcacagaattactgctttttcttctgtatttttatgtatttattttttgtttgttttaaaatgttatatattgtcttttaaactttttagggcctaggaaaaactattcaagccattgcatttctggcatacctctatcaggagggtaataatggtcctcatttgatcgttgttccagcttcaactataggtttgtaatactggagacaactgtatttaactttatcatgttttatataggtagaagagagtgtgtgtaagggtgtgtgtcggaggggtgttgtggtttcttagtttgtagagatgaatattaattttatggtctctttatacttttctcctttgtttatatatgtgtgtttgattatattggcagtcttttaaaaagaactcaaatgtaagtcagttttaaaattttagaccaaggacgatttatgttggtttcataatacttttagttacttttaaaagtgactaagagaaaatgagtacttttaaatgtagaattaaacagatacgtaattaattcctacacacataactgttccattctttctcaattcgttggatgtagaagttagaataagagaatatttgtacatgtgaatgtaacaaagaaaacccccttctctttaaattggaggttaataatcaactgtaaatataatatttggtcatctgcccttcattttgatgcctcacaaaacctcaagatcattttacataggtttcataaggagtaatattgtaaagggtctgtgataaaaacaatcgccatggtatttatattttaatttttaatttttatt

SEQ ID NO: 112250 - DNA, 1763 bp, Homo sapiens
cccaggctagagtgcagtggcgcgatctcagcttactgcaacctcttgcctcccgggttcacgccattctcctgcctcagcctcctgaatagctgggactacaggcgcccaccaccacacccggctaattttttatatttttagtagagacagggtttcaccgtgttagccaggatggtctcgatcttctgacctcgtgatccgcccgcctcggcctccaaaagtgctgggattacaggtgtgagccaccgctcccagccttttaacattttctttcaattatgtattgcagctttcatagcttggttacagtgtacatcaataattattaaatacaagtacgtcagtatttatttgagtatcacccgtgtctagtgctgtgctttaagtactggctgttagaaatgtgtaaataaaaaatgattttataagacattaaatttcactagactccaagctcttaaaggtataaccttagagatgttttttcttttggtgacagatataactgtgcgatcagcagttctgatgaccgtagtctgtttcgacggctgaaacttaattacgcaatttttgatgagggccatatgctgaagaatatgggctccattcgctaccagcaccttatgacaattaatgtaagagaatgtttgtaaagttttccaaattactgtaaaatttagattacgtaatttaatatatgtagtatttattagcagaatctgtattatgtagtttaatatatgtagtattctgtgttagcaagttttttctgtaaaagggaagatagtaaatatttcacactttatggactagatggcctctgtcacgtattctttgattttgttttttaacaaccctttaaaaaattattaggtcataagccataatttacctgttctatatgttaaactatttataaataatctttcatcatctcataaaggtgatacgaggacacaagttacctacttataaaagaagaccaatggttttcgtattcattgctgttgataatagcggacgtcaattatttaaattactatatcatttatcacagaatgttaaattattaataatggttttaatttatctctcctcccttcacctttcactggggaggatagacatgaaaggagtggctctttaagaaaaagctaatataaattttaccttcattcacaggcaaataaccgtttgctgctcacaggcacacctgtacagaacaatctgttagaactcatgtcgctgttgaattttgttatgccacacatgtttagtagtagcaccagtgaaatacgaagaatgttttcctctaagacagtaagcataaatgcatattttctcccaaatatgttatttgtgttttatctgggccattcttctgttaggtctcttttgttgttttcatagtgcatatgctctatgaagtaactttaagtaggtgataactctatatttggattggtttggaaaccagccaaaatataatgggaaagaaaatagcaatttccctaatcaatggccagaagtcttggttaatatcctaattttctgaaggatgacgattttaaattgatgaagagctcagatatatagtatgtgcggaaagtttgatcattacatcatctgtatcaaaattggctacgtaaattagtaacatttctttatgggtaaactataaaactagacaaagctagaatatccagaaaatgcctatgctgagaaatatattctgaaataaaagttcataaaaccaaagt

SEQ ID NO: 112251 - DNA, 1177 bp, Homo sapiens
tgaataattcctaaaaggatatgtttttattttgctcagaaatcagcagatgagcaaagcatatatgaaaaggagagaatagcacatgcaaaacaaattataaagccatttattctcagaagagtaaaagaagaggtaatgcatatctacatgttttttatttttattgtttttaaaacttaggtttttctctttactagaatgattatcttaaactgttttttctgtctcaggttctcaagcagttaccccccaagaaagatcgaattgagttgtgtgcaatgtcggagaagcaggagcaactctatttgggtcttttcaacagattgaaaaaatctatcaataacttgggtataatctgatttttactcttttatgtgaaaaagaatcttgtactggggatgcattttgtttagtcatataatgggatttgtgcattttaaaaaattatctggaatttgaggaaataattttaaaacttagttgatatatttcaacagttatccgcttggttttattttttactgtgttctctttgagtcacagaaaaaaacacagaaatgtgcaatgtcatgatgcagttgaggaaaatggccaatcatcctttattacatcgccaatattacacagctgaaaaactcaaggaaatgtctcagcttatgctaaaggtaaggatttcatattatgttaacactaagctttaataagaggttaagttgttaggctataagattggtgaacccaatgggcatactaaacctttaactacatatttaagaaaaacttttttttttcagaccaggtctggttctgttgccaaggcaggcagtctgggctcactgcaacttctgcctcctaggcttaagccatcctcctgcgttggcctgctgaatagctgggactacaggcacgcaccaccatgcccggctaatttttttgtacggatggggttttgccatgttgcccaggctggtcttgaactcctgagctcaagcgattcgcccgccttggcctcccaaagtgctggaattacaggcatcagtcactgcactgaaacacgaaaaacacattttagactaagttcaaaatgatctgggggacataaaaacaaagaaggactgataacctacattataagtcagcaaactatggccttacggcagtgactatttttata

SEQ ID NO: 112252 - DNA, 1880 bp, Homo sapiens
cccatttctttttaaatttttttttattattttaaacttatggagaatttcaaacatttataaaagtagaattgcataatgaaactgcccatatgttacttcacccctttgaaagttaccatttgataataacaccacccttgtttcatctataccccagacttctccccagggttattttgaaccaagttctagatgttatttcatctgtaaatattttagtatgttatctctcaaacagtaaggacttctccccctttattatacctaaaagattaatactaattttccttgataagtctgttacactaaaaggttctatgatttagatattttatcaggtataaacagttttattaaacttttctcatcatattattaattatttttattttgaagtatactgtgttttgttttgttttaaggaacctacacattgtgaggctaaccctgacctgatctttgaagatatggaagttatgacagacttcgaactacatgtactttgtaaacagtaccgacacattaataactttcagttagacatggacttgattttagattctggaaaatttcgagttttaggatgcatcttgtctgaattgaaacagaaggtattaaaaaagaatggcgtttcttttgtattttctcaattactttaacttcttaaagcaattctggcacactgacttgcttgaattagcctatgtctgttctgcattcttccagaacttagtgttttgaacattttcttgacgtattttcttgattacctcctttcctctgttgaacctcagacaaaaacaatagaaagttagtagactgtatctgtattgatgttttaaaaaaatcttaattgtcattatttcataggtgacaatctgtatgtgtgcttcaaaattagtttttaaagacactatttgttagttatttaagtaatgctgccgtttatgtgtgaaatagcctaaatttgtaaaatcacagtccagataatacatacataagcagttgtccacattttccgacgtttttcttatgaaaaggaagtaatttaactgttcttaaaatcaaaactgagagctagcttttagccctgaagttaaggcagtttattcatatataggctgcaataagacatacgtcttcggtattactgatttgtattaaagaagcagtttatcacagagaattttctgcaaatttatcaacatgatataagtaacacttctaactgtttaaacctgtcaaggctttgagtagtaaaacgattttttctatttctaattcatgtatgtattttcacagggtgatagagttgtgttatttagccaatttaccatgatgctggatatcttagaggttctattaaaacatcatcagcataggtacctcagattagatggaaagactcagatttctgaaaggttggtataattcatgttagttacaaaaaaataactcatttattattattgttaggattttaattgtctaacaaacaattgatagtattttgttgtttttatgtttgattacttcaaatcattaccttaaaataagagtaatttcaatggtcaggcatggtggctcacgcctgtaatcccaacactttgggaggctgatgcgggcggattggttgggctcaggagttcaagactaccctggacaacatgacaaaaccctgtctctactaaaaacaccaatagcaacaacaacaacaacaaaaatagccaggtgtggtggtgcacgcctgtggtcccaactagggaggctgaggtgggaggattgtttgagccccggggggcggaggttgcagtgagccaagatcgcaccactgcactgtagcctgggtgacagagcgggaccctatctcaaaaaat

SEQ ID NO: 112253 - DNA, 1003 bp, Homo sapiens
atagccagaggagaaataactgcaatactaagagatgtacatacatcttcaggtttctttttcatgtgataatgattgttttccattttaattacattatacaactttttagtgagatttaacctaatttgtttatcttacaggattcatctaattgatgagtttaataccgatatggatatctttgtgtttctgctatcaacaaaagctggtggattaggaataaatctgacttcagcaaatgttgttatacttcacgatattgactgtaatccttataatgacaaacaagcagaagatagatgccatagagtaggccagactaagtaagtgtttttagttggaatgtatttttaattcagtgccactttaatttgtgtagaccattagaatatagtgttggatgtcctgccttagtttttgttttttcggcaaagcatggctactgatgtattttataccagcagtgttgaacatcaactgcactacgtaacccttccattttctagtaattatccacccacattccaaatagttctgcagttcatgaagtattaacaattgacggccgggcgccgtggctcacgcctgtaatcccagcactttgggagactgaggcgggcggatcatgagttcaggagatcgagaccatcctggttaacagggtgaaaccccgtctctattaaaaatacaaaaaattagccgggcatggtggcgggtgcctgtagtcccagctactagggaggctgaggcaggagaacggcgtgaacctgggaggcagagcttgcagtgagccgagatcaccaccactgcactccagcctgggcgacagagcaagactccatctcaaaacaaacaaacaaaaaaattgtctacccctttgaaaaagatgagtaattaaaaaaacttgcttgttagatcagttaagtcccagacaaacttggtaatatacaaacttgctgggctgtcctgttaccctttaggaagtaaattgagttgtaaa

SEQ ID NO: 112254 - DNA, 1842 bp, Homo sapiens
tgtttttcccagtgtgtattttatttgctagaataaggatgtaatggcgtctcttatttactcgtttagctgtaatcatttgtcttcagctgtgtcccgggtttcatttaggtaattttgacactggactgatgataatacatgtatgcccttctttccatctctcacagtgaggtccttttcctctataaacaaaaatgtatatttgtaattgactatgtattgctttttgttaccaatctgtttgtcccctcttacatgaaactatgaaaggtaaagaccatgattcctctcaaatatgcttatcagatttttgtgttcctagagcttgccttagttgttaccagagtaccagcagcaggagcagcatctcctaagaaattggcaatttgaaatgcaaattcccaagccccattctatacctacttagtcaaaaactctggcgatggcacctaataatacttggtttaacaggctattgaagtgattctgataaagctaaaatcagagaaccactgctttaaaataaagattgtgtttgggttttttttcattaacttcccttaatgtattaattgtattaatacattttttaccttttggaactttaaaaatatatatatattaccacaatcatgactacatactttttgaatttttttattacagaaatagtcatacaaaaatgaaagcagtggctgggcgtgtggttcatgcttataatgccagcacttggggagacaggcgggaggatcgtttgagcccaggagttcaaaaccagcctgggcaacatagcaagactccatctctattaaaatatatatatatttttttaattgttgaaagtatagtatgaatgaaaaatacagcgatttaacagttgtgacatttgcagtgtttgttttttctacttcttttttcccattgatccataataaagtcaattgtaaacatggcaatttattttcaatatcacagcatattcctcaaagttggtacaataccattgtagcatctaagaaaataaacagtaattttcagacattatcatatattattcatatccagatttctctcatttgtccccttaatgtcttttatagctttccttaaaacactagggtccaaagttcacacacagcattttattgtattctgtctttagtatcttcaagtttaaaagaatctccttattcttttccttcttttctcttctccctgcattcttcctaacatagtatcagtttatatagtaatttatgaagtgtcaatttggattttatgggctattttcaagtctgtggatgagcttggaagcaaggatgtcagtgaactgacatccctaagagttgatgtactattttgtgttcctgtggatatatgtgttttgttttgttttttgtttttttaacagagaaaagaagagtggatgaaagtactcataattttagattatagctgaggtgtatatttgtgagagaggggaggaggagagaagtggttagttttgctacatttcagccacatctaatttataaaattattcatagttacagatctatcacagatcagcaaatatttgaattgccacctgtgctgttgtcactaactagtaaattaatcaactcatctcaaaatattctcagtgctaaattgaattaatcagggatggctagattatctgccactgtgacacaaagagatttagaaaatctcaaataattcctgtaagtgcttatactggggcctcatttaattaaaatatagggcaaacattggataaaccaggtaatttaaagtggctaatttaatcatcagctggtatgctgtgctcagaatgtt

SEQ ID NO: 112255 - DNA, 2219 bp, Homo sapiens
gattggttttcgttggtttaggtttgggtttgttatccttgttttccctactccatttcttacataaatgttttttatttagcaaatgtgagaagttaagtaccatgaattagatacgatccagtgtattaccgtgtatttttatatagctttataaaattggaaaaataaccttagattgctatgttggcaatatgaacaagaacatagaggaaatagccctaatctaagtagagcttaggaaagtttttaacaggggtgagtgacactgaagcaaactagcccttgaaagatgagtaagaattcaccaaagaaaaaaaataattgagacaatttttttttaagtaaaatatttttataaagcttttaatgctactttctgacctacaggtgatgaagggagtatgccagcagatatagccacattactaaaaacatcaatgggcctgtgaaataagaactgtgaactctcaattgatgaggaaatatcaacttggtgcactcaaggacatttacattatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaactctttattaaatctttctttaaatttctgcctgtcagtctatattgctgtttttattatacatcagtttctttgtataacttgtgagttccatgtgttttgtttttattatgtaaatatcattataaataaacttatttataaatcaaagatttgttaatttttggaaatcatgcttttcaaagcatcctaacttgctaagatgctaggtagtacgaccctctggatttggaaggcaaataaaactcttacagtgattatttagatattaaagactgagaactcacggcttaaccccagtcttgatggtatattgaacagactgaatatattttaccattacagggctaaaaggagtcttcatgtgttaatactacctccttgtacatcactatacccaaatcagttattcaaattgttaggaattttaccttttaaaatctcataatggatatctcatgttttctgtattaatgtattttcaatgataggctgtttctttttttgttgttattgttgttgttgttatatccatacttttatctctaatgaaatgtagttgggttcttcctgtaatgcgctattatgtcttgggcttaataaaaatatttgtgatcataagttgtattt

SEQ ID NO: 112256 - DNA, 1088 bp, Homo sapiens
gaaattggtgtgatgtttcttgggctgggcggtctgaggacctgaggtcataggtggatctttctcacggagcaaagagcaggaggacaggggattgatctcccaagggaggtcccccaatccgagtcacggcaccaaatttcatacgcgtccgtgtgaagagaccaccaaacaggctttgtgtgagcaacgtggctgtttatttcacctgggtgcaggtgggctgagtccgaaaagagagtcagccgagttttatgagttctatataattttgaataatagtcttttgtcagatacatgttttacaagtattttctccaagtctgtggcttgtcttctccttctcttgatctctggggtatctacatttttctcatcacaacaactttattcatgtcagtaaattcatctttacaagtttctctggctgcatatctagagccttttgagccgtgtcagattcccacagtcagctcttttctcgataactctttatattcagtttgaatttcattccaggattatcagtttttgttcctttgctgcactttcatctttgttggggagttccctcttttgattcatttttgtaaaatgtcaaagggatttatcactgggccacaagcaggcaatagcaatacaactacacactttgctatctatgcaggaataacagatgtgcagtgacctctggcagtctttgatagaagtgactggtcattggtcatgatgtacataggttatttacacagcgatatgtgaactggagagctactagcaaagtttgtgttttatgcaattacaggtaattgtggtagctgaagtccaaaacattttgggggaggggaagaatggtgttgctaaaccattatgactgcaattcgtgcatgttagaacctgtgcaaagcaaggtctgcctgtattacatactatttttctgtaattgtaaatgatgagaagctattctgaaagaaaaagatactgaagaaagatttgtttttattttcctttttaaaaatcagaatatggctaaagtgaaaatcttagtggagctggggagggagcatgtggattatctggcaggctga

SEQ ID NO: 112257 - DNA, 1038 bp, Homo sapiens
acaactttccaaaaactcctgtgtgcactcctggcaaattctgttcttctaacgtgcatttccagagcttcaggtgcaccaatgtttgtgtatatgcagagtcaaataaaactcttatatctgtgctactgacttctccttgagcccagattgtctttgtaagtttggtgaattatttcagtctaatgaaatgtaaattaataaacagtgtaattagtatttaagtttcattttaaagtacaatcaaccaaaataacataaagaagataagatttgattacacttctttttttttccagatatattttaaaaaacacatttcctgatccatcctagatagccactcctttacttgatggattcagaaatttctagcctcccttttcagaggaggttttttcaccctgagaatttgttgctatgaaagtttaacaaatgacttttagagaggttcgtatatttctcaaaagcattttcagatatgcactaccaaaattattttgtgttggaaccacgacatcagaatgtcctcaggccttctcattcttcttccccatcctgttctttagatgaggaaatggaaacacagatacattaaataaccaaagtaacactaatggtgagttcaaggattgtcatggtgaccaatatccaaaggcatcttttgcttttaattctttttttattggaaatggaatttttagtaataaatactgtaaaattgtgtgtatttggtagatttttaaggtgtatatgacaagaatatattcactatccatcttaagtgcatcaatattctgcctttgaaattttcacctgaccacaagatggcagcaatgtagcccactaccaacagtctaagaaatgaaatacagaacagtgcatttttcattatatattagccaagtcctgcttgttaattagatagtctatagctatcagcaatgtttctgcaacgtgttctgcctttgtatgatttaatcatgaacttggattgctgtgtcctttgaaattgtttttttggaattggtggtatgt

SEQ ID NO: 112258 - DNA, 1049 bp, Homo sapiens
gaataaaataaaaacatctttaaacaaataaggccccaaaagccccaaacttttatttcctatgaccagtaagctcttagaggactgttccacaaaagcaaggaaagaaaacaggagaatgaacccaggaaaacataaaaaaaaaaaaaaaatcctgggtaataataaagatctcaggatgacaactgtgaccaagtatctaggacaaccataccagagcgaagcagtgtgactcacaagatagacatatccatgccatctgtcataatcatatctgctgtcatcaagccttcattttaacttttggaatactagaggatgtgcccccaaataaacaatggagtaaacaaagaaagaaggcagcatccaggaacaggactccagctccatagaatggcatcactggaataacagcaaagggaattccaatgatgacagctgtgcagaaaacctggagaactccacaaagaatggaagtctcctagagagcgctccaagaaatattggaaataacagatgaactgacactacgttgaccttgtggaaaatcgtattggcaggctattggatactgtggaaagtcagcagtaaaagtgaaaagaagcaaaagaaagcaattactaattttaaggaagaaaagtgagaaagaaaatataaaagcatactacagtgcacagttctgtgcattatttgcatagcctactaatcacaggataattaaccaaaaaattttcacatcacaatattgggagcttggtgaaaaggaagcagaaaggatgactatgtaagagaaaaattgttatttcaggttgagatcccttatccaacatgcttgggaacagaattgtgttgaattccagactttttcagattttggaatgtttgcatatacataatgagatatataggggatggggcctaaatctaaaaaccaaattcatttatgtttcatttacaccttatacacatagccaaaggtaattttatacagtattttcaataattttgcacatttgctaaagtttgtgttaagtacttacatgtggaat

SEQ ID NO: 112259 - DNA, 1042 bp, Homo sapiens
gacagtttttgtcaggagcatttgttttctgactggagactaaaatttttaaataatagagggttttttttcttttgtctcatttgttaatcattatttttggtaataaatcattggtcttcctaaaagttttctcaatggtgccaatttaaaatgctcccgtgtagaagctttctaaaatggattgcttttgtaaaactgtataaatttattaaaaattaagaaactgtatactgacagtggatgaattgtatgtaaattatacctcaataaaggtgttaaaatcgaaagaaaattcttgaacgatttagagttcctctgtaaactatatttttgtgtgtgtgatattcaaaggttgattattcgtctttctgaccttgaatagtcttcagaattcttcactcattttcatccctactttgacttccacctcaaggcttcagctaaaaatttatggaggtgactccttattcaatatttttagtcctaaaccacaggctcattttttcagcctccttttggatatatctctgattactcttttggcccctgaacattcttccacaaatcctcaaatgcagtcatcacaccttttctcaaaccagctctcctttttttacccaacaaataattacgggcctcaactgtgactcagccccaagtagtggctgtatatagtagtattgaatagaagaggtaaattccttgcatgcatggcacgtatggtcaactggagaaggcagacattgaggagggtattgcaagttgaaaaaagtattttgaacagaaaagagaaagagacgaaagagaagaggagaaggaggaagaaaaggaggaagtagcagtatatagcatattgagaacggcaaactctgtctatgctgttcctctcctggttaaatagactgccttccacatggcaacgtctatctactgtctctaagatgattctacatccacaaatttttcgtatttttcttggtctctcttctttgccatctggaccatttcaatgatctcttaatatgcttccctgcagtag

SEQ ID NO: 112260 - DNA, 1117 bp, Homo sapiens
agacggggacgcgggagggcgcccggaggtggcgagggccggcagggacgggcactgccgctcccacccacccggctgccggcgtcgcccggcaccaccgtggtgtggtgtctgagtgcccagtcctgcgccagtctcttggagggtaggaagcgggactcaaaggaaaaggcgcgttagtttttctttgctcccaggctactgagaagcatttatttctcccccagatatttacagttttgtgtaacctgtttggggaaaacttctgcgcgtccagaaataaagctcgtttaagaaacacatttgtcatgaacacgagatttgttaacacttgagtacttgttggggcttttgtaagactgtgccttcggtgcgttttacaataagtggaaaaaggaagggcgtgtggacagggcagagcttggaaggaaaattcgtggcggcgctgggcagggcagatttagggtgtgatcgccagatcctatcccaagtccgccttcctgacggggaggacgtctgaacccgcctgccacggaaacggcccgttcggtagccttatttggccaacaaggctaggcgcgaatccctcctggaaaactgtcctgtcggctgctttcatcctgtgcctgtggctttagttcttcagctctacctacattctctctccattgcggggaaagagaatctcaagatatttctctttaatttcaggcctttttttttgtcactctgtgtagttcatcttgagttctcctttctcccctctcacccactaatgaagctgagatacaagtgtgggaaataccaagcttccttccctagtactagagcaaagacattgtttagactttccctaaaagaaaatccataactctacagaaattccaaccttttcgacgtgtttgaaagagtatgctgctatttcctgcctgcttggtatttgaggaagggcttgggcactaataaccagatggaggagtcttggaaaggccaataaaaatattgccattgcttggggcagagactgttttaaggcagatgaattccaaatgaagctagcagaagaagcatctagaaatgaacggacagtgactagaaatgaaatgacactggtttt

SEQ ID NO: 112261 - DNA, 1659 bp, Homo sapiens
agtattccattaaaacaaaagaaaacttcattcctctgtctcctgccgttataacaaccaataggaaactcgaagtttttttttttttttttgctttttaaaaattatatgaaagtactactaggagagtcatcacacgcacacttaacagcagaacagacaaaagaaagcaccgaagcactggttcttttctaaactgccaattccatttgaatgcattaacccagcacttttgctgtatttagtcataatcttattcactgagtggcaaatgcttactctctgcctggtgaggtgtgtgtataaaacaaaaagcaggttgtgactaacatcactgtactagagtattgcctatcgttgactatctgaaggaaaagtagatatcactttaagtgtggaaaataccatgtccccataggaggaaatacaagttgtagttcatgattggagagaatagttttgtgcattgaaaaacagcttctcattgtaaagaatttagtatttggaaagcatgaatgggagcctactgatttgcagtctctttcacatgttagagtaacttagaatttaagtaagtgcagttgaaagactcttgtcaattgcagacaaaagaatacatgaagtggagggaaggagaaaattattctgaattcaacctgaaataaaatcttgctacattagtgaagtattgtaaagtactttgagttaaactttgcatgcaagaagccacaaaattggattgaagcaagttgtgaaacatactaagtgtctagaaatgtattctgatatggaatttttagaccatggaaattgccatgagtgtagaaaatttatattagctcacagattgcttttcttaaactgaaattaatgaagaacttaattaagacttatcttctatatcctctcacccccctcaaacaaaatactaaacataatttatgttctagggtttcaagtaaacatttttgctaatcatctgattttctttcacagcatatttcattttctgtcattggactttgagccattagaaccatgagcaactacagtgtgtcactggttggcccagctccttggggtttccggctgcagggcggtaaggatttcaacatgcctctgacaatctctagtgtaagtaaactttacaaattttattatagatgttcattcagtgcttagtcctcgggctgagttgtttaattctctgttgacctgtactctacttattatcattgctcctgggatttgatcttggcaaatttgattatctataataaaggatgaggggagtagatttagcaaggataactgacttcaatttaacttcttttcgttttcccccatgttatcaataataaaatggaaaaagcatttaactaggaacagactgtacatttttgaactgtccctaatttggggaattctctgaatcttcgttctttcatatataattttcaaaggttgtgctatgggattttaataatctctttcagttccaaaagctgtttgttaaaaactgttgatcaaaattgaataaaatgattgtttcggaattatttcctcagctcactttctggtggaggtgatagccaacagtaagatggccaaaagctacttacccttgaagaggaaatgaagggcttggagctccaacta

SEQ ID NO: 112262 - DNA, 1353 bp, Homo sapiens
cctttgtttcttggctgtggatttttttaaagttatctttaatttatcatcaatttctgccttgatttcagttaattagattttataaggaagtatatatatgtaatccagcctgcaagttttaacacctttcatggttagatgaaattttaaatgtaaagcatccatgtgaaaatgtgtcatgtgatttattcctgtttgagtgagttggtattttatttcttctactgatgatctattatgggaacaggagcaatctttgagtattattggtttttacgttttgttagcattttatattttaaatattctactttaattatctaaagaaagttattagtttaaatgcttacttttttgctgaaaaaaagttcagaaacaaattgacacctaaatgagccaaacttaattatcactttgttgtgtggtaatagaaatgcaaatagagtatgtttgcgaattttgtggtaccgtgtctttaaaaaagtttcatgtgcttcagtttcctggcagacagtttgaggtactagctccatgttgtgatgctgatacaacagaacactgtgtacatacatatgtgccctcccctggcacagaagaaatgctttccttgtgtagacagagtgctaattaaaggattttgaacatactgattaaaagagactatggtaacaaagctgctgagttatttctgttctcttacaaaagtctctgccatctactgtgacctttttgggccttgtgcagtggggcatgcaattcattctggactggagaggattggaaggggaggggaaggagagaagggaatgttggctcaatcgggctgctaggctcttggcctttcattgtagttatttttaaccccttgtgtggtttaaatatgcctagtaacattgcctaataaaggtttgcgtttaataactaatttatattgtggtaagattgttaatgttataaatttttaacttactctcatcttaattagttctttggttatactttttctgccttaattatgtaaaattactgggatattactggtcatcaggttctttaattaatagtatcaagaaacaattaaaacctgaaagcatgcttaaaacatgtaatttaatgattcacttactttaataatgcacatgaaattcttagcaaggtctggcagtctctcaattatcttttataataatattataaactttaaaaagaaaactatttagagacttgaaacattaaatatttaacccccgtagttgtagggaacatacagttatggttttgttttgtttttttaaacttattgtccactgaaattaagaaaggaaaaaaaatcagaagtttgtacttagc

SEQ ID NO: 112263 - DNA, 1045 bp, Homo sapiens
aatttcacccttatgagactcagtgtgtttttattatcaacctttattagctaatggaagttaactgaaatcaggtaggtttatagagtgttctgtagcatagtgagtcaggcattgtgaaggtatactaatgtgtggcacaaggtagttactcattttagcctagtgtgagcagcagagtgtatgtgttggtaactatagtaacaaaaagagtaaggatgccagggatatttatatttttttgtagtaaagatgaggaaaggaggaatttctctttagtgtgttgctgtaaatgttaaatatgatgagaagagttttgaattagagaagaatttgcaacacttgttatttggattctgtgaattgttaaacatttttttccccaaggtccagagattgatttaacaatggccactgtacttcatgataattgtcctggctaaattttaattgaagaaaagagaaagtagttacggtaatgacattaacaatttaatgctgtttaccattgattggatcagggatttaagtgttgtgattcagttccattgagatctaattaacagcccagtatttttcaaatgatttctgggatattaacttttggaagtggtagaattaagagatttagtaaggctgtataacactagccagagcagactatgttctgaaagtatgtttgttctgaaagtatttttcttctgagaaaacgttaccggaggacagatgtcctttagaaaacaaatgttttgtcccttaactaggaccccttagaaatgttctggagaaagaaattatatctagctagctagctatcgtgttacacatataatttccatgattttggtcattcctttgaagtatctttatgctactcacttgcaaatatcctacaaatggttgttttgatctttttagggtagacgtttctgttttgtttaaatgtacctctgtctattctggaagattctggttatttggtgtccagttctctgagtgattctttgctattttagcagacaaaagtatttccaaaattcatcaa

SEQ ID NO: 112264 - DNA, 1096 bp, Homo sapiens
taaaataaaataaaatttcctcagcctcttccagccttcctgcttcccatatgtaatctttccagcacttttgtcttcatttggttgctctaatatgctccaacttcccccacaaatacatgttgttctgcagctttcttttttttctttaatatatatcatgggtatgtgtccaggtcagtacgtatagacatttatcatattgatgtaacatatttatgcatcagaatttctactgatattgtaattattttttatatccagaaatttttaaatgaatgtttttgtgggtttttttttgcctaatatatatttttatgtggctataaataaaaaatcaaatatgaactgtggggggtataatcttattgagtgtaataatttgtatgcaaattttagttaaaattaataaacaatttcaaaataatgtaaacatttttgtcaacaatgactaaaatattataaactctttatgaatgttttctatatacttgtttctgtataaaataatatctaatgattttagattgcattataaatattttaacccttgatatctgctgcaaatgtgctttctattcagttcttctcaaaattaaaataaaaataagcttattaaagacttataagtaaaataactagaattatattccatacactatgtattatttattcatattactgaaaattactgattatatccttccatataacagtggaaaaagaattggtttggtgactcgaaggacttgatggtcaaattaattgattttggatatttcatgtattctcattttaaaacttttctttagtttcttatttattatcctgtttaatgtaggctggtattaaaatgagtcagcatttctgataattgtgtaaatgttaaatgatagcagaagccaatttaggattaaacaaaaattgttgtggctcctctgctaatcacataatccaaatgtgaattgagagattattcaagaagtgatgattcaagaagttaaataatacttttaaatgacaatttttataaattgcaatgataagtaattcaataaattaatttgggtttacccagaagagcataggagtgctt

SEQ ID NO: 112265 - DNA, 1037 bp, Homo sapiens
tctgttacggctttggtctcattacttactattggtctgttcaggttttggatttcttcctggttcagtcttggtaagttatatgtgtctaggaatttgtcccttcttctagattttccaatttattggcatacagttgctcatagtagccactaatgatcctttggatttctgcagtatcagtagtaatttagtctcctttttaatttctgattttatttttaaatgtgcatactttttaagaaagaatttctaaagaaaagatacatatgccaaaatagaagtataatattattcatcactttatgtataacaacaaaaaaattaggaagtaacttaaaagactaaatagtagcctgttgactaaatacctttgatttgcagtgtggcagttcatcagatgtttattgtgttttgtgtttacgtctgtgtatgatagccctaaatagaaatataagatacagttagtttgaggagcattgtattatggagagttgggtacacatgtgaaaagtggaatagtataaaacagtagatgagagaaagagccttgcctcttctttaatatcttttcttagaattgaaggtaatgccttatgggaatagggccttattaaatgttaatgattaacattttgaagattattaaggtttttaaaaagcgaatccctgtttttataagctatacttaccttagcatgtgaaatcatgattttgcactatttggaataagcattctgttttaaaagttcttaaattttcttgagctttttgttttgaaatatctttagcttgtgggttttgaaaggcctgtgatttttcctcctgtcgtagaagtatgctggcctggtgtttaccaaccacacttagagaaactctgttctcacatttcattaaatcgtaagttcctataatttttttggttatagacgcctttgaggatttgtgaaaagtcgtggtcccactcaatggaatatacatgcatgcttgcacagaatttgcatacaatttcagaagatttgtctcatcattgaggg

SEQ ID NO: 112266 - DNA, 1054 bp, Homo sapiens
agtaaataagccagagttcaatctcagatttctctcttaatgtaatgatttgtctgcacacatctttttaagtacagaaattttaaagtatttttattgctcagtaattataaatacttcttctctaaaagttgttttgcttttccaaatacaacacagtaagaattttcgccattaaatttatttcataggagacagagaaaggggcagttatgaagacatttgtttgatattccagtcatttcaaatgccgtggaaacttctagcaaggagtcaaccctgttaagagtattaacagggatcacatattttaaaattctttgaaaatttttgctttattagtaccttacaaaatattccagtatcagtattacctcattcgtttccttagcagctccagtgtgtgcattctctgaatactaattaaagtagctttaatatgatcttcatctgtgaaacagttttttagttgaattacaatgcatggttaagtttgagtattgagaacagacttcataaattcatagcattttagagtttgaagcaactccagctattaaccagcagagccctttatctttatttatgattcaaactttcattttgatttgtgtaaaagattgcctactgtgacagctctgtgacaactctgtcacagtagtgacacaggaattggagtagtgtggtggaggagggaaggaagaacagattggtattaaactgtggtcttaacctttccaccctgttgaccttgctctgctgctttctccatctattttgtggactaattacaatgttcttttaggtatctcatctgtcagtatcttatgctgagattgggaaattctggatttagtggtaaattggtttatagcaaataccataactattaaagaaaccagcatgttttccattttctgtaaccttttcttatactttctttaagttgtttattttcctgaatttctttctttctttagagcctcaaaatccctccacttgattctagggtgccaaaatgtcctctctcaactgtacatatgtagagcttgaa

SEQ ID NO: 112267 - DNA, 1061 bp, Homo sapiens
tgcttccagtttttgcccattcagtatgatattggctgtgagtttgtcataagtagctcttattattttgagatacgtcccatcagtgcctaatttattgagagtttttagcatcaagggctgttgaattttgtcaaaagccttttctgcatctgttgagataatcttgtggtttttgtctttggttctgtttatatgctggattacgtttattgatttgcgtatgttgaaccagccttgcatcaacttgggcaagtttattgttgttaagatggtattgagacctacgtcttgcttggctgtaagtaaaattcatgctgttctttattttcttgatattgtgctgtctctttgtaatggtgaagtggaaattattatagccatctctcaaatgagcagaccaaggcatagataaaaaaggctagcatttaattgtggtagaatgggcaataaaatagtagtcaacctattcttgctgaatttccattttcctgtctacatatgagtgttcaactatattaaagtctgtcttgaggtatcctaaggtggtgttacagcagcccagtagagtacattctgagttttctgcctatacttgtacttcaaccaaagaagctttgcttttatttgttttatatactgaaccttgaattatattcaagtatgactaaggattataatactaacattgttgggggataaaaatgtcggctttctggtttttcttgttgcttttttttttattctagctgaaataataaatcagttccctattccatttttctgtaaaatgaactgtcatgatctcttttgtgtgtgtgttgcagggaggggggttagtaaaaaatttaatcataactaagttatgtaagtagatgatcttaaatgtttttaataaaaccatgtgttgggttacctttaaaagtagttatgataatttttttttgtctaaagcatttcagttatagcagtcataaatttaagttgagtaggtttttatgctcattatttttggtaaactaaggaaaatataggataaggattttgattagcctagtaag

SEQ ID NO: 112268 - DNA, 1871 bp, Homo sapiens
ttctttttttcctcagagcatctgctgcacccaagcctgagccggttcctgttcaaaaggtgtgtttttaagctagcacccagagtatcacttgattgtccttgctgagctactgtaattcccattactgtctcagaccatactgacattcatttaatttatagtctcagtacaattttccttgtagttcttttccttcagagatgagtagggaaatggagatcagcacataccatttgtaattatacatgttataaaacattatttccaaagccatatgttacaataacttatgtcagatttcttacatttctattcacttttgatgagcccatctttatccaaatccttatattttctaaagagaataaataagtggttactgaaaattaatatcacaataagtctttaataacattttattaataagtgcttaattacatttcagagtattcttaggttattggcaagtatccctcttcttgcatatatgtcttcaaaataatttcaaaccattattcatatatatctgttttatgcttttgggggctttctccctaattttatctgtgcctatttattgaactacttattatacagattgagcatccctaattagaaaatccaaaatgctccaaaatcccaaactttctgaacactgacatgctcacatgaccattgcagcatttcagattttggattcttggattagggatgctcctgcattctacaaagattcaaaaatctgagaatatctgaaatctgaatgcttctggtcccaagctgtctaaataagggatactcaacctgtattgattcgtgtgggcactaagctacttatttttctcaattagttttcttcttcctataagatgaattgaggctgcgcgcggtgggtcacgcctgtaatcccatctttttgggaggccgaggcaggcggatcacctgaggtcagaagtttgagaccagcctggccaacatggtgatacttcatctctattgaaaatacaaaaattagctgggcatggtgtcacgcatctgtagtcccagctagccaggaggctgaggtgggagaatcacttgaacccgggaagtggaggttacagtgagctgagatcacaccactgcactccagcctcagtgacagagcaagactcctgtctcaaaaaaaaaaaaaaaaacaagatgaattgagattaccttttttcttaaaattaaacagtagaaccaccattgtatgatttttcaaaaatttgattttttcttttgatatggtagggtggaatagggatttattcttgatctgaagtctaacgctctacctctgagctatcccgcctcctgggatttattcttgaatgttgtagaagcttagtctgattttgtttaactttaaatatgctttggaataaggattggcaaataaaaattctggtaattttaggaggaattgacctttcttactagttgttttttctttggctgctgacgatggggaaatattgaagatttttttttcttcatgtaactattaaatatttattttggaaaaggaaaagaattttattctatctctgaatcatatcttaaaacattcagagagagaaatggaggtggattacaagaaagaaaggattttgttttatttgcttttttaaagtttttttttttttttcaaattctttaagattattaattagagtttgcacattcctgagttaggtgaaaattatcttattccctgtgttttttgtttttttaaacttaaagagttagaaatgtgctgctccttctgcgtgaaacaaatgattccactctggagagaaatgaaacatgtttgaaaaatgggactatgggctttgaaagatgga

SEQ ID NO: 112269 - DNA, 1787 bp, Homo sapiens
cgatcttggctcactgcaacctccacatcccaggttcaagcgattctcctgcgtcagcctccccagtagctgggactacaggcacgtgccaccattcccagctaattttttgtatttttagcagagacggagtttcactgtgttagccaggatggtctcaatctcctgacctcatgatccgcccacctcagcctcccaaagtgctgggattacaggcgtgagccaccgtgccccgcctattttagatagatcttttaaaaacttgagaccgaatatacttgcaaagcaaactgtttatataaaaggaatattgaagattaatcatataaattataaataatttagtagaagatattttatccttttaatataactttacaatttttaattttttttttctccttaaccctagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacattgtaagtgaacttctaggtatcctaatggatgaatgtttttttgccccagagagtggcattgagactgattggtagttgtcagaaaacaaccccgagacagtttgcttttaaattatgctgtgcataacatgggtaatataaataagaccccaggccgggcacagtggctcacgcctgtaatcccagcgctttgggaggccgaggcaggcagatcatgaggtcatgagttcgagaccagactagccaacatggtgaaaccccgcctttactaaaaatacaaaaattatctgggcatcgtggaagccacctgtaatcccagctacttgggagcctgaggcaggagaatcatttgaaccggggaggcagagattgcagtgagctgagatcacgccactgtactccagcctgggtgatggaggggctctgtctcaaaaataaataaataaataaataaataaaacaccagcccaggagagtaacattgaaaagtatagatgtaatagtagttgtactaactatagtttatggccaataacaggctactatggaattcgttttagtggctccatggaagttgaacatttgatattgattggtgcaggtaattgcttaagtgattttgaagttaaacaaaacaaactaatattggatattgcttattatatttcagtgaaagaatctgaagccgataatacaaagaaggcaaagtaagttctctatctttttgacaattgaatgttttcctttcacgaatggtctcaatttagtttttcaaattgtcaagtataatggtatggcatttcgtctttgcagctagaagctaagcatttaactttggtgccttttgtgtgacctaaatgtacaacttgcagattttaaaagtagtagatattgtctggattttaaggcttgttttccctagtattgaaataagaagtgggcagaagggtatatttcggggtgctttgctaacaatacatatgtctgtgaatgagctcgtgtgttgtcttgcagtcactttattttgaacataaaaatgtatgtttccaagagggatctgtggattaattgctatatttctaaaaatgctctacccttaaaatttttgccacttaataaaacagctatgtgaaattaagcttttataaggcatgttttctgcatgatggaattagtctagaacctttttccttctatttctt

SEQ ID NO: 112270 - DNA, 1048 bp, Homo sapiens
ccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaaatagaaaattaagggactagatctatttgtggatttgtatctgtttttgttgtgattagggtagtaatcttggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgta

SEQ ID NO: 112271 - DNA, 1033 bp, Homo sapiens
ctgcaaaagaatcatatttttgtagaccccagtttagacctcagttgcacaggttctcttttattcatcttctcatcactttctttgccttggtcacttctcatcttttctccttagatcttcaacccagatcacaaacacagcatttagaagtcttcaaagtaaaagatcagttaagggaggactgaaagtcatgtggaagtcaaaaggaacatgcatttactttatttttttgccttaaattaaggatgtttatttgttgacttcatcacaggcagcctaagagtaatgagcaagcaaatgtatttagaaatcaaatataatcagagatatgtgaatgaagcaatgaaatgagaagcttcaaaatgggaaattaggatttactgagtaaatgtaatgaacacttaaaacaggaaagcagtacttaaaatattatgattttgcatgttatagtcttccatatatagcatttggaatcttaagtattagccatttaatttcacttaataaattttgttagaacacatctgttttcttcacatccttaaaagtttacttctagttctctcctggggagattctgttgctgagtagcctttggaaatgtgtaggctaatgtacagacattaaaaggaaggaggatgctaaatatcttgtaatgcactgaagaatcccacagactgaagaatcatccagcccaatatgccaattgtgtgctactgagaatgactgcattgagtgtaaatattcccttttccaagttttgttttgttttgttttgttttttgagacagagtctcgctttgtcacccaggctagagtgcagtggcgccatcatggctcactgcacctcgacctcccaggctcaagtgatcctcccgcctcagcctcccaagtagctggaactacaggcacacaccaccacacctggctaattttttgtaaaggcaggattttgccatgttgcccaggctggtctcgaactcttggcaatctgcctgcctcagcctcccgaagtcctaggatcgtcggt

SEQ ID NO: 112272 - DNA, 1105 bp, Homo sapiens
ccaattcttgttcttacagtttatgtagcataggggaagaaggacacagtactagaaagagcatttgagcagcaggatggaactgcctggcctcagtttggaaacctgagttctcattgacttctacagattaacagctttaaataaagtcacataacctctttgacaccctcagttttctgatctgcaaaatgaagaaagactaaatcatttcctatttctcccaacatgaacaaagtttatgattatgtaaaaaaaagtaccccttttaacaggaaaatgggactgtacttaaatgttgctaatctcagactcagccttcatctcttctcactctttatgctctccctgggtgatctctcatccaggttcctttcattacttagttatcgataatttacagatctttctctccaactgagtgatctatttgccatctcctggtggcacctcaaatccagtatgtctgaaaataaccatttcctatctctgggaattgcacatccactcagtcaccaaagctagaatgtagacttttagaccccacgccccacattctcacagtaactaacatctaatggttttactttttattatttctcaaatttcttctctgtgtcatcagagccattgctttgattcatgacctcttcattacaaatgacttctaatttccctgtctcctttcccctccttcagtctgtcccccatacctccatactacagcaagtgatctttcttttttttcttttttttttttccacggtggctcacgcctgtaatcccagcactttgggaggccgaggccggcggatcacgaggtcaggagatctagaccatcctgggtaacacagtgaaaccctgtctctactaaaaacacaaaaaattatccgggcatggtggcgggcgcctgtagtcccagctacttgggagactgaggcaggagaatggcatgaacccggtaggtggagcttgcagtgagccaagatcacgccactgcactccagcctgggcgacagagcgagactccatctcaaaaaaaaaaagagagacaggatctcactctgttgcccagtctcccaggctgaagtgcagtagcacaatc

SEQ ID NO: 112273 - DNA, 1007 bp, Homo sapiens
tgtagtcaacgacccttgaacatttttaggaagaggccgatttggagagggagcaacatatgcaaaaactgagagaatttggcttcgggtaggaaagacaagtagttcagtatgtttaagactgtctagtggcccagagagaaggttggctgcattaatgggggttttgaatgtaagagtgtggacttgatgctgaaaggaagctattaaaacatttataagccggaagtggcaaaatcagacttgcattattaaaagattattatagcattaatgtgtttaaaagatcatcatgacttcattgtagagattaaggttggagacctggagaccatttaagaagttattcaggtaatccaatctggagatagataatgaatattgccctgggcagtggcagtgttttggagagaattccctgggcagggtgactgcagggtatttacactttaacctaactgggctgctggttttaaccattgccctctctgggaacttgactccctatagagtacctatgtatcctctgttaaaacacccgtggaggattgtattcagtttatagcatattagaatgctaccttcatactttctttaattgtgtgtacacacaactcccagttgagccctgtttactctcatgtccctggtgttgacaagaaattagtggatattattaaacgtgtccatggaggcaggcattctactgaggaaaataaaaacatatattgatattagttgatatgatattatggcgatatactcaaggcagtagtattttatcatttaatattagactttttttttttttttgagacagagtctctctgtgttgcccaggctggagtgcagtggcgctatttaggctcactgcaagctccacctcccaggttcacgccattctcctgcctcagccccccaagtagctgggactacaggcgcccgccaccatgcccggctaatgtttttgtatttttagtagagacggggtttcaccgtgttagcca

SEQ ID NO: 112274 - DNA, 1033 bp, Homo sapiens
tgtatctgttagggatgggatagaaaggattcttgccttggataatagggagcttcaagtgactggcaactgctaagatctgtttcaagtaacattttctttgcatctaaactccgtttttgaaatttagatcatttggctaagattctagttaatgtgtttttcttttttttttaatcatacccgcttctggtgtgtgctacatttagcaataaagaaaagcttgtttacttcattgtagactgagctttggagagatctgatatgttgtttcggtgtttttttgttttttttttgtgagaaagactcaaatatatttgtgagatttgattagatcaaagactgaatgatgtgcatctcagttataagtggatataaattctatcttttatttgaagtctaagggagataggggtgagaaaggaaattactgtttctacaaccatcccaaatttcattgtaggctttgcactacagtaataaatcgagataactaaatttgcctagctaagatggatagatttattggttccattttaaaatttttatatgaataagtaaactgctaccagttgcgtatatttcatctcttctaataatgttttattgccatctgctcccctgcattttgacatcattaaactaaacagccctcttgccgtaaagccctgactggagctgtccattgtcaaaactggggtgtgaaacatgtaaatatgcccatctccttacataacaagtagatttttgtttctgattctcaggaaaaaataaaagtaacaaccattaattgcctgttttctttttcttctaattgttccttcattgaaatttatttgcgtgttggaagctttccagtgctgatgcaaggcttcatctgtgaaagctgttctttctccccattttcttctctttctgagattaaaatattaaactttttataaggcagacatctacatttgttcatatatgcttttcataaagaattgttctattaattgatgcatatggtttaaaccaaagtttggcaaat

SEQ ID NO: 112275 - DNA, 1031 bp, Homo sapiens
taactcaccttcaatatttaccttaaccatgtcttctcgtagaagcagaggtatgtatcacctgaggtcaggagttcaagaccagcggaccaacatggagaaaccccgtctctactaaaaatacaaaattagccaggcatggtggtgcatgcctgtaatcccagctacttgggaggtcgaggcacgagaatcgcttaaacccaggaggcggaggatgcagtgagccgagatcatgccattgcactccagcctgggcaacaagagcgaaactctgtcttaaaaaaaaaaaaaaattctatgcatacgtctgtcataattcttttactttgttggaatctttggttttctttcccatttacctacatagtcacagcctagtgtttgattcataacctcactgtaaatgtgagtgagtgaataacaagtgaatagattactgttaaaataataatttttattatttgattgttaggaaaggtttatatgtggcttattctcattctgattcttctgttttaactcctagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcaggttggttgttttttgaaattttcttgaaagtacttaatatcaatgttgggttttttttttttttttgcatttggaagtatgtgtaatgtaattagtgaaaatattcttgccataatcctatagagtactaattattgagtaaatacgaatatctatctatgagaatctattttaatgaaaggtaatacggaggtctgtgaaaataaaagtactaattgcgttcgttatcagttatcaattcctattagaactaaggaaaaagtgattaatgtggcctttcagagaataataaaattttaagactcaaagggaccctgaaagtcatttatc

SEQ ID NO: 112276 - DNA, 1047 bp, Homo sapiens
tattctggataaaaacacctttgtggagacaggagtcactgctgttatttgtatgctattgtaagcaagtaattactgggtgagttaacaaaatgtcataccacatcagttgctgattcatgttgtgtagttatcaaattccatgatatcctgtaatcaccacttccggcacttctaaaaaacttacttaatatggagaaaatgtgaagatcaaagtagaaattacatttcaccacccctacctgccttggttttaaatttaatgccaggccagtatgcaattttaatgcacagtcatcctgccgtgtaaaataaatatgtattatgctaacatgagtagccatcacttattgctccctcatctgttaaattttatattgttctggattatccagtacttgttatcagttaagcattaaagcttcatttactaaggaagttaataggaatggggattagttcatgtcaagatcatgtaacagtaattaacatagcacatttgcctggtgctcaaatgcttaagcagcttgaatcgattgtggtcagttcagaggcctagtcaaagcataattctagttcttggcctcagtgtcactattacttaaccaaagcaagaagactttagatcaagtgacattctcttggacacctgttttaaaaacgagctgtagtttcaggcttgataccttcaatgcagactattataccctagcaagcttggagaagtttaaatttataatttatattgtgagttttctgtcatataatttatattgtttgtaccaatttatattgttttgttttatatttacttttcaatatttcgaatttgccaaaaaccattttttatgtaaaggcaaactaaagcacattttatgttttattttattttatttattttttttttttcagcagagttgattgttttagaaaacctcaggaatctgaatgttagaactgaactggttatctctttatagagcacattcagtttaaaattccgtaatcttatttggatctaaagtttaaaaattttttggtttattt

SEQ ID NO: 112277 - DNA, 1075 bp, Homo sapiens
tttgttttttgctcagtgattttcaaacctctctcataaggagcaccatctcagtttaccaaggaaaaacatgcataatttgttgcctgttttaccatttatttcagtctctgagcacccctttatttataggttttatttatcatccccactaattaagattttacttgaaaataaaaggcctcctggaaatgtattattagcccttgtatttaaggaaacaactaaagacattgaccaagactcataaacaagacagagaccaagatttcactatttactgttgtgaaagattagaaagaacataaatgtgcagcatctatataatgtaattttcagataatagttaaagttaaatgtgtttttagcatattccaaatattgcaccaagaattttgcctgaattttcataacaaccctgtgagacagttgctatgattattccacttcaaggttgagaaaattgaggcatagagaagttacgtatttgtttgaagttgcatatgtagtagataatggaacctgaatttgagtccagatttgtctaactttaatttttattcatgcttttaactaccactacataggaaaatgtttatagtatcatatgaatatggcaaaaatgaaataaggaactcaaaagtatgattccaattttatgtaaagaaactatacaccaagatatatatttaagcctgataacaataaaaatagctactatatattgaacttgattggtatcatgccaagaacttttttttttttttgagatggaatctccctctgttgcccaggctggagtgcagtggtgcgatctcggctcactgcaacctcggctcactgcaacctccacctcccaggttcaagcaattctcctgcctcagcctcccaagtagccaggactacaggcacctgccaccacgcccagctaattttttgtatttttagtacagatgggatttcaccatgttaaccaggatggtcttgatctcctgacctcatgatccacctgcctcggcctcccaaaatgctgggattaacaggcgtaagccaccacacccagcccatgccaaga

SEQ ID NO: 112278 - DNA, 1039 bp, Homo sapiens
agcctttcttttctggcaggaattagtaaacaaaggcattccttattagtcataacaaaattatggtaccctaaagttttaaaaataataataataaactgcctatctcaaacttaagagaatgatatgtactagcttatacaaaatggcatcatgttattaataagaaacaagttaacaaaaagtagggctagaaaataccctcttacaccccacgtaaaaatttttaatcactcatcaagagcctttctccttttgtgactcttgcagaattaggtgctgattctgagtaaacatcaatatggtgacaaagaatttacagtgggagatagttattgaatagcaaggtttatgttattgtcagaattttaaaaatgctgtgactttgcgatactcattgctatgacttctcctgttaataatctgcctggaagtctggtgtctgatgcttaccaacaattaccatgtggtcgcttagggatgataagtgatgttaatgaggtcaaaggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggaggtaaagctgctctatgaatataaattagtgtgatatagctactgaaaagtatgttgcagaggctagaatggttagtctctgcaggcttcatgactagataaggcttcataatggattcctgccaagcaaaccaagcccatcttatcagttcatgaccataaagtatttaatggggaaaaaaatctcttacaaacatttgttaccttgatacaaatgtgtgttaaaaatcggtcatgttggggaggggggagagggaagttggtgcacagtgggtataaaatttcagttatacaagatgaataagttctagagatct

SEQ ID NO: 112279 - DNA, 1460 bp, Homo sapiens
ataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaata

SEQ ID NO: 112280 - DNA, 1063 bp, Homo sapiens
attgcattactaccctccagcctaggtggcagagcaagactccatcacacacacacacacacacacacacacacacaaaaagtagaagttgtcattttaactcatatacagtgaattccatgaccaatagattgtgcagaaaatttgtctactaccttgaaattcccttagataaaaaattggtagtgtaatacttatatatgcagttaggtaaaatattgctttgggtaggtaaataatggaatttcataaatttatcctttctttttttttttgagatgagggtatgctctattgcccagtttggagtgcagtggcgcaatcactgctcactgcagccttgaactcctgggctcaagcaatcatccttccacctcagcctcccaaagcactgggattacaggcatgagccaccatgcccagcaaatttatcttctattgaatggttgaatttttaattaaatttcttcaagtagttagcatattttaatatttctaatagaaacacgaggagaagctctaccagtggaactcttaggactctcacaccacatgatagttaaatcagtttttaactgattagcttgcctttctgaaatgtgaccagtacttcattgctttttattttcttacaatttaatttagcctgcttagtttatggatgatttcagctgttaaaaaataagaacctaaattgacactaagacttggaaaatgtaacctatgattaggagactttattttccactaaatacactctaaggaaagttatcctatgtgtttaattgaacaatagaaatggcaactgtgcctgataaacgtatctaaatgtttaaaatcatcatgtaaacccatgatgattcttaggttccaatagtttcagtaaatcagcttcacttttcagaatatttcccagttgaattatacagctgtagctggtgaactcttaccagaattacatgctgcaaaatgatatgccctttcagcagataggcttaagaacacagagaacacacactagtggaatcctggtggtcagtcttaggaggaatcagaaagaata

SEQ ID NO: 112281 - DNA, 1032 bp, Homo sapiens
gaaactgtgttcagaaccctctcacatgcatgttcccatgtttcactccttatttatctaaaacataatttaaatgaaatggctctgtcaaaatctgtatttctttctttttttccttactatttttgagacagagtcttgctctgctacccaggctggagtgcagtggcacaatcacagctcgctgcagcctcaacctcctgggctccagccatctttccatttcagcctccaggatagctgggaccacaggtgtacaccaccacacctggttaatttttgtatttttttgtagagacagggattcaccatgttgcccaggatggtctagagcccctgaactcaagtaatccacctgccttagcgtcccaaagtgctgggattacaggcctgagccactgcgcctaaccaaaatctctatttcttgagtttgaaaattgtatgtcagaaggaaggggaaatgttagaaaaacccagctgtattttcccctttcattttcaattttagaaagcagagattttaccaaatggcaatcgcaatagaaaatacacacaattgagataggacagaatcataaatgtatgtgaggtaacggtgtttgttccttttgtcttaataggtgatccatgaggccttcacaatagggaagttgttctacgtacctcaagaaaactttatcacgtgcgtgccaggtgcctgacatgattctagatgctgaggatgtagcagttagccaaagggatataactcttgctctcatgcagtttatattctaatttggatattctaaatatttcatgtagaatgtcacaattaagatatcacataagaaagatactttcagagcttctctatttaataatttcatgtaggaaaagaaggtctccttagtgtatcttatctttcagacctttatatgtaataacatgatttttcctaatttagaattaacagttttctctagcatgtaagaaaaactgacttgtgtttggaaatcaagacctaagttcaaatcaagacataaacacaca

SEQ ID NO: 112282 - DNA, 1054 bp, Homo sapiens
ataggaacagctaaaaaaaagtcagtttccctgccagagtctgtggaaggctataaaagactgtcattacccttgagacacaaggaatgtctttaaggttcaatgctaggactgtaatactacttcagtgcgtgattatgggcaagtctcttgtatgttctgggcttcagttttgtttcctctaaaatggttggaataatgcatcatttagaggattggtgtgaaattttaataagataacacgcttgattgagcagagacagaaattcaacaggatattaactcaattgacatatttatatgctatatactgtgacaaatgaggggaaacagtgttaaatatctgtctccacttagtaacttattttctgggctttagctaggcttataacctccaggaggaaagacattttctagtttctctttatagccaaatgtggccatgtggttaaattttgactgatattagcaaaagtgttctgtactgctttcagttaccttgtttaaaaagagggtgataacctttctttgtctcttgctcttctgctgactgaaatgtgaacatagtagctggagctcaagtagccatcttggatcattaagtatattttatgtattgaagatggcagaacaacttggtccctgcaaaatttgtgaagccatcttatcagtcacttatctataccatgaaactatcctgtaacatgaatggaaaaatatactataattttaaatattctgaattttctcttggcactgttaagggtcaccttgcttgttgttgtgaagcagacagaaacgcttcatgtcttcatacagcttatattctagtggaaaaggttgggagggggcaggaaatagaattattcagcctgtccatttctagagcccacattcttgtgtgagggagaggcttgtatttggtcccgtgctgatggttaattaataatgcatttacccggacctaatataagacatagtgaacctaagcctttcagaatgagacctttgataaattgaattgttcacaaaaggccagtctttgatgccacac

SEQ ID NO: 112283 - DNA, 1004 bp, Homo sapiens
agagacagtttgttatgatttttgttctaggaattgaacgttaaaaaaaaattgcctttaaaacggtgagaaacacataccatcaaagtttttttgacaagaaattcatcagattttaaaaacaattttttaacttttctgaaaattgaagattcttcaagtaacttcatgaaagatgaaactgatcattacaaaatgcaaaacttacattgatgtagttgtgtttcagagaaataaaaatgttgatttgtttttaatattataagctacatttggtctccaaaatacagttagagcaaagaaaaaatagtatgagctgatgattttcctttagttgcagaaatgcatttctggggatggtgatgtggtggtaagctctaataaaaactgtccagtgtgtcatatttctggcttttatgtgttgcatacaaagcaccatcagtcaaatgagcaacacaagactaccatattaggcattataaacagtgacaaagtataagtagtgcaagtagtcatatttctagttttgaaatgcttaaactctagtagataaagaataatagaaaatgagcgataaaaaaggacataatttagattgtcaagagaaaacacagacccctaagaatttaattaagaggacagattatatttactttttcagcccctaatacagcttcttggacatatataagtgttcattacttaaaatgatctggaactttttctagaatttattatttattcagttaaacacttattgaaagctaaagtgtgtattcagcattgtactacccttgagatactgtggcagactgcttcctggtacatttcattgtgatttttttttttttttttttgttagtcactaattcagatacatagacagttgttacctagtacaactagctaacgtgtttggattataaattcattttggaagagcttacatctatataaaggaaggtacagacagtcctttgcacagttctgattagcacaatatc

SEQ ID NO: 112284 - DNA, 1073 bp, Homo sapiens
cattgtttctttagacataatgctcttgcacactcagtagactacagtatagtgtagacagaactttttttttttttttgaggcggagtcttgcactgtcacgcaggctggagtgcagtggcacgatcttggctcactgcaacctcctcctcccatgttcaaatgattctcctgcctcagcctcctgagtagctgggattacagatgcccaccaccacacccagctaattttttgtatttttagtagagatggtgtttccccatgttggccaggttggtcttaaactcctgacctcaggtgatccaccttccttggcctcccaaactgctaggattacaagcatgagccaccgtgcccagcctgtagacataacatttatatctattgggaaaccaaaaaacaaaaaacaaacaaacaaaaaaaactggtgtgatttgctttatagtcactttattgaagtgatttggaaccaaactcacaatatctctgaggtatgcctttatgtacagaaggtgttaatctagattactccatgagtcttgtctagcagtaaaaacttttgttgtcatttgctttagtcagctttatgcatttactatttttgaacagacttactttcaggtagcaaagttacttcctaagtaagagagttcttattatcaactgttttttttttcctgtatttgcaatctctgaacatactcctgctgttttagtagagatgaaaaattattattttattctttcatagtagtatcttgaagagatttttacctttttatctagtgttatcaaatgttccacagaagtgatgtatttcttttgcgaactgaattcattattattatttttttttaccttctttactttttttcatattgtatacctcttttagtgattgtgttcattgtccatgagggcttagcactggtgctccttatgaagtagtgaagattcagtttttaccaaataaagacagcatttggagaatataggagattctcaactaaagtgtcaactaaaaagacattgacaattcctgatgggttgagactcctggattgccatagga

SEQ ID NO: 112285 - DNA, 1064 bp, Homo sapiens
aagtatttgctttttcttattttcttgtcacagatacatatgataagaaatatatatgtatatttatgtgtgtgtgcacatgtatgtgtgtgttttgagacagggttttgctttgtcacccaggctggagtgcagtagtgggatccatgctcacggcagcgttgaacccccgcactcaagcagtcctcccacctcagcttcctgaatagctaggattgcaggcatacttcaccatgtccaactaatttatttttactttttgtatacatggggtctcactatgttgtccaggctggtctcaaacttctggcctcaagcagtccttctgcttcagcctcccaaaccgtagggttagcaggcatgagccactgcagttagcttcatttttatgttcttaaaaacaattaggcaggggacaatgaaattggaatgaggagtaagataaggcagcaagaaatcagagtgacaggaggaagaagatagaggatggtaaataatggaaagcagtgaggagatagatgattttactaaagttggggaacaaggcttatggtttcttctactatgatacttgtagacctgtttagctcactattctcagggccaggggaagcattttaataatagtatcatctaattttgcaattcatgaacaccttagtaacccagtctccagctaataattctgtttcatccttaccaaatagcccttatgaagagggaatctttcatcattctttatgaggggatctgtttcattttttcatagccctaagactggaagacactttttaatgttgatccctaatcatctttctgtcagctgctgctcattggtcctatttctagctcctagataaacatacaatgtgctttctccctaacaaatcctctgtatttggtgataactgtcatattccttatttcctgagctggccctcatatgatgacaaggagacagtagattgtagggcagaggttgatactatttttttctaatatttgtgtggtacgtttgtgttcttacttggaaatctttgttgggagggctaagatgatcctct

SEQ ID NO: 112286 - DNA, 1647 bp, Homo sapiens
gagatgatttatgtaaattgtgaatcgttagatttttaattaaacatgtctcttattttcagagtttatgcgaattccatgtgtggatgctggattgatttcaccactggtgcagctgctaaatagcaaagaccaggaagtgctgcttcaaacgggcagggctctaggaaacatatgttacgatagccgtaagtgttgacatctcaataatacacatacatttttaagaattatgatattcagactaatctgcttttgtgttagcagtgacttttctaggctaaaacactaacatgggccggcatgattcagcactgcttatttagcagaatttatggagattcaggtcgttgtattcttatcaaagaaatcataggaaatgaaatgttttcctctgttatcacaaatgatattttcagaggaaattaagtcagtttctaagaaattggggctgtaagtttagaaaaaatacatatgtgcatcttctcaattaggtttcattgaaatattatctctgaatgggaatgcttatggacacagttttttaaagtttctgcgtctgtccaaatacatttttaattatttgcagttcggtaaaaccaatcataaaaaccattctcttctcaaaagctagattggcccattacatttgcattgactccattcctgtttgtcattatatcattgtcatcctcaccacattctataatatactgttctactaggcaaaaagaaagcaagaactggggtatgggtatattgtaacagcgttaacaatttctacttcccctttctacatataaacaaaatacagaaaagaattttaagtatatttagcttaactaggcttattctgattttccttagagttttatttgctgagccaaaacacgtattttatcattcacctgtaatgcctcctaggaatttagttttatttctataactaggataacttttagtgcttattttccccattgagtgtttaactcggatgagttatattttgttataacacaaaagatatggcccttttataataggcagtccttcaaaaagtgatttatgcatataagccagaaagaaaggacataaatatattcatttatgataaagaagtaggaaaaaagattgaaactatagttataactcatatatagcagtagtcgtaaagctagcctcatttattctccttttcttactttttctgaaataggagctacaatagccataagtattgaaatgtcagtaatgaatctgaggacatagatgtcttaatatgaattttaacttcagttttcagtccccagtatagcctgtaaatctgcttatctgctccttcaatccagttctttttatcatagggtattagctttatttacaaaattctgttgctttatgtttataattttgtgttttcatatttaggatttttattaagcaccatagtttataatatcaactttcaagactgaatcatttattatatatttatatgattaattttagcaacatatattagacctcagctgagtaatagtcaaaagattagtggcatgtacttggagagtactgattattactgtttttattcttacttttctgtgtttgttactggaatttaagggtaccaaaagtattcttttt

SEQ ID NO: 112287 - DNA, 1033 bp, Homo sapiens
tagcatagtgtatttgaaaggaggtgagctccaactgtagaaagaattaccataaaatccgtggaaatctttggagaaaaactaggtcagatttcagttttaccagccttgacagtgcccattttaggaacttttcctaatggaagaaaacggccttatataatcctgacatgaggtaacagactggcataccgctaaatgggacggagtaaagctttgttgctgatgaactttttgaatcccagtctccttcttgcatatagagatgaaagaatcactcactggctgggaacgtttttcatttaaaatgcttggtctcttttcttccagagagctgcaaggcacttcatttatgtatttctctttcgaagtatccgaacagacttctgatataagcaatattttaaaatgcttctgccctttaactttgccaaaataactctttttatgagaaatttgacatctttcagatcagagaagaaaggaaagttgtatttcaatttggaaagaaataatcaaaatatgtgcgattgatgggatacaccagggaatgtggttttaaagcgcagtagtattatatttcagaaatgcatgcctttggcctatttacacttccttttcaaaggttttataaaaaagaggattatgttcttatatagctgtctttgtggcattcctcattttattgatttgtttatataactgtacacattttaaattgctgatatacttaaatggccttatagttttaaaaagctttatgttaaattcccatcctgtatttataattcctggggataaattggtgatttgagactagtgttctgttttgtggatattactgcctgaggtcagaaaataattgttacttgatctactggttaaaagatattagtagaggctagaagaaaatgattacgtgaaattaaatatttgtgcctttttatacaccgaggaagaataatgtacaaatcaaataaaaatgttttaaaattaaacaaatatacctctttatagaaataaaatgtatgct

SEQ ID NO: 112288 - DNA, 1654 bp, Homo sapiens
atttcctagaaagggaataactgatagggaaatattatagaccaaaaaaagtgaaattatgaactcaagtaaacaggttgatattaaaatgagaaaggacatttctgccatagagaataaaagacagaagataaatgaaagtataaaaaaacctttaagtagtaaagagggcactcaaaagtgtatttctgggtatagttctgtcttcccagtaaggtagatgtcaggctcatctgttaataaaagtcaacaccaaaatgatggtaggaagtttgtggttttgggggaaagttcaaaattggggctgtaggacatgtaaatcatgaagatacgattttttaaaatagccaaatagtaatataggtatgctatggtagagatcttgattgtgcatccattaatgtatagtgtgcttaaaatgtctataggctaaggaattattttgactttgatatgtggacaggaaggagcctctgaaagtaacttgaagaaattgatattttcagttttgtagcatcatatagtctaattggaatggacagagatgtgaggcagagatatcaggaagccattacaggaggccgggtgtggtgtggtaaatagtgactgcggcagagagaacgaaattatattgtaaagtgagagacagtactcagatagtttattatcagtttggctggtttttgcgtagcactgcaccaggtttatttaagcaatgtaaagtactctatctcttcagatagtttacactttgagaaactatgatctttccatttttgtacttggtattaaatttaaatccctcttttattaaatggtgtttggaaatccaagattctataaagtttaccttaaaattgtaggacaaagaacacatattactgcttttttccccatgcttgattactttccaaatactatgttataaaaagctaatgtcttagggaagacatgaaatagtaatttcgagtaattgttcttaattttatagatacgaaagtagaggcaacctgtgagagagtattgcacgtggcaaaaatattagatgatttttcttgggttcaataagaagtcatatatggttgccttcccccccaaccccacccccattctctgagtcagaagtctgaatggctttagaactttcctttcctcattaagaggacttaggtagggtgggaaaagtctaattatagaggcctacttgggggtttaaaaacattttttgtctaaatctgttttttccccttacctttaccactctcatttcacctgttaaagtcaaagtttagatatgtgaaacataagatttccagtctgcttattgaaaccctgtcaacacatattatcctctgctctttttaatagggttttgtttacatttttaaaattttcttatttgtaaccaagttgaagtactgagaactttctcaacttttaatcagccttttccttgctacaagtagggtgcattttccttggcggtgaggaaatatgaaaaataaatgctacgtaaaagtgaataattcagggccaggcatagtggctcacgcttgtaatcccatcattttgggagggcgaggcaggtggatcacttgaggtcaggagttcaagagcagtctggtcaacatggtgaaaccccatctctactttt

SEQ ID NO: 112289 - DNA, 1047 bp, Homo sapiens
gtacataatagaaattcactgttggcaaaattatagggggaaatgtaagcattagaatttaattttctttcctagtagacttcataaatacattttaactttatcttgaaaaacaatgtagggtctgcatgtggtggctcacagctgtgatcctaacattttcagaggctaaggtgagaggatcacttgagcccaggagtgcaagattagcctgggcgtcatagcaagatcgcatctctacaaaaaataaatttagctgtgcatgatggagcacttctgtagtcctgctactcaggaggctgaggtaggatgacacgagcctgggagttcaaggctgcagggagacatgattgtgctaccacactccagcctgggtgacagagcaagaccttgtctgaaaacagacaacaactaacacaatgtaggtatgtctattaccatttccctgctccaggaaattaaaatagaacttggcaaaattaaaagcagtatatttaataggaatgggaaaaaaaaagccttcataatcatgcagatcagaatggccagtatttcagacttagaaaaatacgttgctgctcatgatttacatccctgacttctaatctctttgagtgtgaaaacttcctttttaacaccacaaattattgttctctccctttgaggatataggtcacatatttttatagtaatgattgtacttacaaaatgtatgtactgagaagatatgaaataatgagtaaatgccaggaaattctcactctatgtctttgtattctttggtgtatacatactacaattaaatccacacatattgattgaaccaactatgtttaggggacactgcctgtgatggggattataggggaaagaatgagcaagaagtctctatccttgtgaggctttcacaggaggaggtagataataaacaagtaaatactacagaaaagatatttatagattgtgatgactgacatcaagggaataaagaaggtgatgtataataatggagtgtatttgagggtgaagaaagttctctctgtggat

SEQ ID NO: 112290 - DNA, 2550 bp, Homo sapiens
catctaatatgattcagcaacagtaataaagatgtgaccttagtttcagttcttatatttggaaaatgaaaatctttcaaattgtaactaacttcgtagctgtaattcctttgtgagtcatttattttgctgatctttgtgctatatttctgtagctgaatagtacagtgtggtagctactagccaaatttagctactgagcaatttaaatgtggctagtctgagttgagatgtaactgtaagggtataaaacacttggattttgaagatatattgtgaagatgataatacaaaatattttgttaatttattgatttgcatatcagagtgatatatattgaattgaataaaatattactaaaattaattttcacctgttttttaatgtgtctattagtaaatttaaattacacatgtggttcacatttatggctcacacatttctcttggacctcttctagagggtggttatattttatctaaggtgtcagatttagaatgacacgtattcttcttttaatttattttcattcttatgttcaaaagttagaaagtagtctaaagctgtttgtatgttctgacagttaagtaacatctgttttatgcaatgtagatggacacataatggaagttatgtttgaccatcacttgaccactttttgtaatgttgaattatattggtgtgccctagaagagagggaataaggaaaaaagaaacaaatcaagaatgaaaaaagggaacatgcttctggactataggaaatgccattaacaaagaccatagtaccaatattcaggaattacctattatgatttagagttacaccatatggttttctttaataagagctattatcaaagacataataacgttcccatatggttttcttcgataatagctgattttgaaaaccaatgacaaaaagttatatttagtgattttttcaacctgagggacaaaaacttatatcaatagaatatcacttagtttctgtttttttctcttacacagcattgtcatttgtgaaagagggagtgaaagttttcatattgtaaacttctaggacacagggaagttctgtaagctcctatatgatgccaatgagaataatcttggtttgcttaaaaagtgattgtctcttttccccatcccacccccatttccatgtttatttcttttgtttttttctgaaaagacatatttaatgtcctgcctaggtttattttctatttattcacaaaataaagaataacactgttatgttttgtatttgaaattgtaaggtacatttcttttttcttttatttttaatttaactctttgttttacagatgagggcagaagtgcagttgaccaagcaggtggtgcacagattgtaattgaccatttaaggtcactgtgcagtataacagatcccgccaatgagaagctcttgactgtcttttgtggcatgctgatgaactatagcaatgagaatggtaaacaaaactgaaaacttgctttatctctgggggaaaaattaaaaattatctttactatagtgcaaaacaaaaatatttgaaaaatgatgaacaaagaattcgtaagtggcatataaaattaataattagccaacattaaatttcaatgtttcaaaaatgtaaaatggttaatttactaaatgggactaatttttgaagggctgccagttttgatcagtatcaaaaacaaaaactccacagccctatagtatgatttaagcattcttactgtgaacattttaaaaataaacaatattaaaatagttttatcttcgttatatatataccaggagtagctttaaaatatgaacactgtttgcagaagtaaaattattttatctagatgctaggtttacttcgaataattttttaaaactctaataaaatctggctttagaaacaagttcagagcaactgtagagatctcattttagaaatttaattattgtaaacagcagtttcttttctctgtaaaacatttttagaccctagaaacaagtgatgtatcaataattttcagatagcctatatggttaattaaatgcatataaatctgtgatattaaggcttcacaatacgtttgtgtcacaaaatatccatttgtttctttatcatcttatgtgaatcactgtgtggatcagacattcaaattttggtatgttcctggtatgtaacacaaataaggtctttctgtggtttgtttcataatggcattttaagttgtgatattttggcagagacattttatttgcatattagacatgcagtattattctttactttcgtgtgttgtagaaacacgtggcccttttggcatactttttattttttttcacattttatagttgtgggtccaaagaaatattctcaataattcaaaaaaaaaaaaaaagataaaccttggcaataaatggctactgatatttggcccttgttgttagtgacaacagtgaatggtggggactgtggtaagttgaagagcccttgtcctattgaaaggggaaaaccactactcttctctagccagtt

SEQ ID NO: 112291 - DNA, 1095 bp, Homo sapiens
acgggtgaaaaagagcatttcctagatgtgttagatgtttagaaaaatgatttgcttcacatgagtgaagaactatttttaaactttacttactgtggttacaagctagttaataatttatatatttcctaaatagtaaattatttttaccttactctaaggaaaaagaacaaaacaatatgtaaaaggtaaaattgtatctttgcaatttattatcttttttaaagtttttcttctttctcagagatccttgttctgatactgtcttttttaatgaaactaattttccatcatactaccttacatgtattttatttttcctctatttatgaagacatgggagatgtacatttaagttaacatcttttgaagcccagtttgtcactttttactccagtgagttaaatgaagtgtgttgaagacttattgggcagctgaaaagtacttaggcttttttattctttctttattatactaactgttgttctttatttactgttgttctcttttttaaaaattcctgaatttttgctgtttgtccaacagctttctagtcagtttgctgaaaaaggttgctttcataaagttctaccacaagtgttattttaaacaaattgtttcactaaagaatagagcagttagttagtctggtgcctcttgctaattcaacctattaaatttgaccaattagaccaggttagcttttagtgataatcttcctagactatttctatgataatgctgttacttaatgaacaggctgagagcttgattttcagtagaggtgtatcagatacacattttggtctaattccacatgatcaagtattggcatttatattcagctttggccattagagaatgaacttctgaatgtaagaagctgaaattttatcttagaaaaataaaattattatagtctttttgtcagtaattttagcagtctaatacttaaaatttggcattatattattacaggaataatactttctcagcattgttagcttctagattgctactgcgattatgataatgcatttaatatcataataccacatagatgcccacttagttgagggcagtgaaagggcaaaa

SEQ ID NO: 112292 - DNA, 1013 bp, Homo sapiens
gacatatagtggagtttgactcacattcaatgcatgcgctagtgctcacgcttacatacctgaaatttaatgattcatcagctctgcagtatttgacaaagtagtgaaaatgaatacatatataaataaaaatactgctaaagaacaaggatcttcagaggtgaccctctagtaaagagccctatctactggtaagtaacctaaataatttctaacttggaaagctccttggtgcatgattattacaaatactataaccataatgcaactattctgccaatataatatagatataacactattgtgtaagtattttacctttaagtgttgtgaattattgctaaatttcatattcagaaaaaaatttaacatcaaaagtataaatacagattacttagttgagtatattttaattcttatctccttttagatttcataacttcattacaaaatttgaaattgttttattagagtatttgaactctaaacataaacttccatttttccatgtttattttttattcttattttggtaataggcccctttctattatagatgggctcccacaaccaaaccagataattatctgtaattagccagtcatcagttttcagggacactaagcctctgttgactatctcctcatacttcactctaaaagcaggaagaattaacaacaaagaccaccaggcaataatgaactggcatgtgagatagctcaactctgtatgttcttttctgaaaatcacccacctgcttccttatctatagattaagaactataaagagtaataaaaaaaattagcaggccaaccctgccaagggattggaactatgaggaacgtgtttttgtaagaaagttttgtctttagattgcaaagagaaataaaagaatttggggaaaattattagcttgaaaatggcatatcattttaaagagaaaaaaatttgtttagtctttagattgcaaagagaaataacttaaaagaatttggggaaaattattagcttg

SEQ ID NO: 112293 - DNA, 1035 bp, Homo sapiens
attctcagcttacaaagataacaggattaagagattaaagtaaagacaggcataagaaattatgagtattatttgggaactgataaatgtccatgaaatcttcacaatttatgtttttctgccacggtgccagccagtcccaccatttggggtccctgacttcccacaacatatatctgctcaggagatagatggagacagatatggaggcaaatataagctcttcagtgaaataagtgttataatgaaagaatacttaaagatattagaagtataataaaaagtgttgatgtgggggtggagtttcctatgaagatcagttttaaaaatgtaattgggatgtaaattctgtctctaaaataccttatgttatgtttagccatcagaaaggttcaaggttatttttttcttttaacttttattatgaacattttgaaatgtattcagaaatagcatttagtaaaccaccatgtacccatcactcaagaaagctttaaatcaatgaaaacctgaagccctttttaaaaacacgactttatttatttatttatttaatttttatagacagggtctcactctgttgcccagactggagtgcagtggcacagtcatagcttactgtaaccttgaactcctggcctcaagcaatcttcctgccttggcctcccaaagcactgggattacaagtgtaagccaccatgcccagccctattttatagtattttatagcttgccctttaaacatgagcatgatatctagagtaatagtggagtgatactagttgctttcagagctgagtatcaatttgtttagatgctgcaagacatcctgaaaaatttggcaatttcaaatggaaatatgaaataaagcttttttgtatatttaaatgaactgtcaagatagtttactttgaagatttgagtttcaaaaatgtattatctaaatcatgcattttcttagttttttttttttttttttttttttttttttgagacagagtctcgctctattgcccaggctggagtgcagtgttg

SEQ ID NO: 112294 - DNA, 1359 bp, Homo sapiens
aaggacttgtttttagcttttaggattatgtaatcataaaaaatagcaaataaaagatttaaaagttggttttggaactccatttgttaatttttatgcttgttataattatttatttatacatattatttatttatttatttatttatttatttgtttatttatttatttttgagacagagtcttgttctgtcacccaggctggagtgcagtggtgcgacctcagctcaccgcaacttccgcctcctgggttcaagcaattttcctgcctcagcctcctgagtagctaggattacaggcatgctccacaactcctggctaattgttttggaatttcactagacatggggcttgttgctcaggctgctcttgaactcctggcctcaagcgatccacccacttcagcctcccaaagtgctgggattacaggtgtgagccaccatgtccagcctataattgactttaaatagaaattataccatatctctccttattagtacttatagtcctggttttaggttgctttattcatcagtttcggcagggggtgttgtgttttggcattctatacccatttttaccttggctttgaaatcaaatttcattattgtgacagtcaaaaattttttaaatttgtcttccagacagggagagcatttttctgtttgcagaaacagcagtcagaaccactcctaggaatgaattatgtttatttacttatttctaaattttaaacccttttctatattgattgcatagagtctttctaagaaccctgcattatagtccgccagagcactaacagactagcaggcttaaccaaaagagtatgaagtcatttgttgttgtattttctataaaatttcacagtgttacagaagaaggcaaatagcccatcacataaggaatatttgcagttctagctttaatgaaattgtcgtgctgtgtttttttagacgtccttcacactctcaaatctgtacgaattatttcaactgattgtctgttagtgattcattccttggtttgccttctttcctatagcagaagctgctgaacaattgggaaagaatgttaagttagtggagcgtttggtggaatggtgtgaagccaaagatcatgctggtgtgatgggggagtcaaacagactgctgtctgcccttatacgacacagtaaatcaaaagtaagttccagaggaaactgttcactagaaaacttcagagtgtctttttcagaaacccagcattgtaggtcctaacaactgggataatatttacctgaaagtattgtgaagattcagtgagatcatgtatataatgtgcttagctgatacatgggatataggaaacactcggtaa

SEQ ID NO: 112295 - DNA, 1057 bp, Homo sapiens
ttgggccacgttcaaaatcatcctgggctgcaggttggacacgcttggtttagagttttggcaaaccataattgtattaactaatttacagacatgatcctggcatctgaatttggaactctcagataaattcctgttacatgtagtagtaaggctcgtggaaaccttgattaatctagtatcttcagtatcaactaacagaattacataaccaaaccattcatggacacaaaaatatgtccacaggaagatacatcccagcttcttagaaacatctgaatttaggagccagaactacttaaatgctataatatttaataaatttaaagattttgaggcttttctgtgaattttgttcatagatccccctttccctcatctaacctcccacttctcgcccatccccgaaaagaagagttcaaatacccatcaccacgcaggttctttgaatgatgagaactgtggcatggtacccttttaggaaaaggtggatgggggtgtgtgtagcagaaaacaacttgaaattatataggattgtaactttatagttacatattacaactttaggattacaattcaatacctttacatatctttcctacaattgagagtatactgctgctaagcagccaaggagccttgattctcacactttaatgagcagaactataaagtgtgttaattgcatgagttctatgtcagagctgttattttctaacttaaccagtgttacagtagacatgactgcttttgagcagcagttcaagtttgtttcatcaaattataatcccaagaaatcttctacaaagaaagagttgcataggtagattagttatgcaaatagtaattatttttttctttgcctttgagattcacagcacacattaatactaaagaaacctctttaattttatttgaatccactgattgccaaactgtttgaccatggatcctttctgcaggtggcatctgttattacactggacgtactttggaaaaatgctgttctagaataagtttttaaaataattaaacaccaggttcaaatgtattacat

SEQ ID NO: 112296 - DNA, 1114 bp, Homo sapiens
tgccactgtactcaaacctgggcagcagagcaagtccccatctttaaaattttttcctttaatttaaaaaaaagtaaagtttttatgatttttttaaattataatacatttctaagaaagacattgctaggctactgctatgtctttttccagaattgtttctagttttataagcttagtcttgtcaaaataaacattttggtatatgttttggatagacttagaacaacctaacagaatcatatctgttatttttttgtcttccagaatgtctacacaaggaagtacaggatttggcttttctagatgtcgtatccaaacttcgcagtcatgagaacaaaagtgttgcccagcaggcctctctcacagagcagagacttactgtggaaagctgagaactgcccgatacacggcatcatcccatctctaatttcccctctgtcctccatccagcggcttcttccgcttcattctctaccataccacttgtgcatgcatgtgatgttctaataccaattgaagaaccgctgtaggtacctccctaataagatttctaaacctatagttagtgtgatcatgactttgtcaaaggcaagtctccacccataaccgttctcttgtattcctgttgcttgagctacattaagtagaatgtgcatgttgtagtcctatgatgatgtaaacttggtactacataatgacttgctccacacatgcagtaaactacataatgatgtactggtaaactagaaacaaagaatgcagcaggatctgtctagcttattaaagatgaaactgaattggaaaaatagctccattttttggtgcttgggaagcacagtgaccaaaaaagttgtatggctgcttattcattagtctttcctactgatgtcaaatccatggtacctagagttaaataaaattccaatgctcttactctttaacttctggtttctcctttttcctttttagactattgaaactgccacaaacttggcaagactttctgaggtttctgattccatatttaattgactattatcaatagcctgatattgaaaaacatttgtagttttcagtgtgaaactaaggggttgaagaatcactattacaa

SEQ ID NO: 112297 - DNA, 1011 bp, Homo sapiens
aagaaataagcttgtctagactaaagaaaggaaagcaggttataaaagccatagtagccagtccagttcattctgcagatggccccataccaatcgctgttagagtttgccacctccactttcccactgagaactgcagcaattttaaaggatatgagaaagccaagactcaagagatgagaagacccccttggcgaaatatagtgtactcttcactgccactgccaccaccaaatgggtttttagagctttgaaacacaatctttgtaaattaatcaaaacctccctgtgacccacctgccttctccccatacccaaatttgaccactactggcctaaaaggcaagatgggcttcgatatagaaggactgcaagacagtagaaagggctgccacggaggtgacagtagctccttcctctccaacatgtgatgctacacatctctgtggataatctaagttggacttttgactctaaaacagctataatccaagaaagttaaattctaatggaggtaaagaatcttgactgattgttccctttgatgtccaaataagggaactattgtgagtacgtatgctacacttactataagaatgatactgtttgttgtctttctcctgggctggatagtggactatattttattacaggctttgaaagacatctgtaatgttgcatatctgttcatattaataacttaataaatagtatatgaagctataatggcatcatttggtttgtttgtatattttgtctctatttccagctcctagaataaggcttgctattgatgttcaacaaatatttgttgactgaatgaatgaatcctgcatccatgaagtttccagactgcctgaactaattccagaaagatagactgactgactgatagaaagtttgagatttgatagtttgtctgactttagggaaaaaattttaacaaaagcatcctaaaatcgtaaatgtgagagaagttaccatctaggccagctgccagccatcaatttg

SEQ ID NO: 112298 - DNA, 2738 bp, Homo sapiens
tttctttttggggtaatgaaatgttctgtgattagatagtggtgatagttgcatagctttgtgaatatactaaaagcccctgaattatacacatttcaaggatgctttttaccacatatgaattacatcttaaatttcaaaaatcaatgatttaaaaaaatgggacacagtggccagggaaacaagttacaagtgtcactgtttcactcacattttcttcctttctcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaagggagggtaggggacccagatgtacttgaatgtgcagaaaatacattcttgtcctcatcttccgtaattggagggctgggagaggcagctttgctcttcaccacaccttggacggaccaccttctttctgttccatggcctgaaggagtgcatctcctcaaagactcagcccctcacctgggagggcagtggtttgtgggcatccctccatgtacattttaggaaacacttgcaactctcatctgaagaagaaaacaactcatctttgggttcagattttgtgatggtattcagcaagtcacttgggcgagcacacttggtctatcctggaaagtctccttataagagaagttgtgtatttcatgtgcaccgagcaagggcattggaagacgtcatgaggctgtattttagcaggactgatcgtttttctaagtagacctgagctttgtttatcagtgaaattcaaggagaaaatgaggttaatgaagaggtatcagttaaatatccccttcttctcaccctgccaaaattagcagttggatttttggaaactctggaatattctgggtcattttgttttgtatgtttgttgtttttcgtcttccaaaggtgaaagctatgatacagttccacttaaattttagtgttttcttactcagctcaagcattaatttttgattaagtcttaatctgcatgacctgtgaatctgaatccatcatctccctttcctgccagcttttctacaaacattgaaatatgttatttggtcagcacttatttcctaggttcacagccttgggaggttgtggcatgtcctcccagtctggctgggaagagaccagctgtaccatccaaatgcttccctggtcttgatgatctcttccagagtcgatctgagtggccttttctgcaccctccccttctttctctttgaatggaattaaacccaatttggaaacaacattgacccagtcaaaagcttctaatggtttctttttcttcctccagttttagtttgcttttattaaaaaaagaaaatagtgcatggccatagctccttcagttctcttattgcagactaaccatcaggatggtatcaaagcacaaatactttggaggggaatgcgttgaactggggcaagtactctgtaacacaaagtgggaaaccacttcctggtgctgccgctcctgcccccactttaggtgggagggacgagttttgccctctagattttaatccagctggtgtccaccggatgttgccctcctggggagcagatatcagtctgtggaactctgggaaaaccacaggcacatttttcggtgcggacagatttgccagcacataactgggcagccagctagaatactttgtggaaattaagcgaggttttccatttcagccccatggtgcatggtggtggccgatgaatgtgtcagtctgctcagagaaaggacaaaaaggaaattattttcaaaactgtgttcactgtttgggtgtgtgtatggctctgcatgtgtgtgtttttgtctctgtataggtagaggtattcacatcttactccgactgtaaggttgtcttacttcatctctgcccccaccacagttgccattttgtaatgtccttccaacatggagaagacacgagctctctccagttggcatcatttgtcttttttgttgattgcctcattctccagtgaactccatctggccaattgattcagaatcaggcaagatccctgccctttggcacatccactgaaaggccaaacagcaagtccgagtgagttttaaatattaattaatcaccctttattttttacacttgagagtgattgtaataaaggctgtcattaataaacttggttctaccttacatggtgtgtctttcttcattacttctttcttgaaattgtgaaattttcgaatccagtggttctcaaactttagcaggtgtcagaatcactgggaggacttgttaaaacacatgaatgcatttgctccgtgcccataatttctaacttagtaggtctggggtggggctggagaatttgtattctgataagatcgtaggtgatgctgtttgcggcttgtttggggactacactttgagaagcattgttctgatccagttttctaggaggggaaacagaaaggtaagatt

SEQ ID NO: 112299 - DNA, 1431 bp, Homo sapiens
ccaggctagagtgcagtggcatgatcttggctcactgaaagctccgcctcttgggttcatgccattctcctgcctcagcctcccgagtagctgggactacaggtgcccgccactacgcccggctaatttttttgtatttttaatagagacggggtttcaccgtgttagctaggatggtctcgatctcctgacctcgtgatccgcccatctcggcctcccaaagtgctgggattacaggagtgatccaccgtgcctggcctgatttgtgttttattaaagctctgagtttagatgctactatcatgaaatactttaggaaaccttgtctttttctaagatggagacattaattagatagtggttgcctactggcattccatcgtttacatgggctcaaaaatactgcattgtggcaactgagtcaaacatgcatagttagaagtagatctcagtggtgacgttaaggttttgggaagtttcacagagatgtcatacccctttctctccctaaactaccttgccaaagtgctagtgaaggaagggagcacccacttttcctcctggccagtcttaagagctggactcttcatgttgttggtgtgatactttccaaagagcacatagttgaaacaaattaaagaagacctaagtaaatataaagatatcctgtgttcacaattgcaaaacttcatattattaaggtaacaacactcatcaagttgatctacagattcagtgtaatccctatcaaaattgtaaccacctttttagcaaaaatggacaagctgatcctaaaattcatatggaaaagcaagggacccataatagccaaaacaaatttgcaaaagtaaaacaaagttggagaattcacactacccagttcaaaacttagtacaaagctatatagtaatcaacatagtgtgtacttgagtaagattagccatatagagaagtggaataaaattgaaaaatcaagaaataaaaccaggccaggtgtggtagctcatggatgtaatcccagcactttgagagaccaaggcaggaggatggcttgagcccaggagttcaagaccagcctgagcaacatagcaagtccttgtctctacaaaaagtaaaaataaaaaaattagccaaatgtaatggcacatgcctgtggtcctagctactcagcaggctgaagtgggaggattgcttgagcccagaaggttgaagctgcagtgagtcgtgattatgcaactgcactctaacctgggtgacagagcaagaccttgtctcaaaaaaataagaaaaaaatatatatgattaaaaagaagaaataaggccgggtgcagtggctcatgcctgtaattccagaactttgggaggctgagtcaggtggatcacttgagctcaggagtttcaaaacagcctgggcaacatgacaaaaccctg

SEQ ID NO: 112300 - DNA, 1536 bp, Homo sapiens
atcatggctgtcctttcctatttgcatttgaggaacattgttttgctccgggtttaaagttttctttggttattaaatatggattctttcttatcccttgcccccttttttggtaatccttgatatttcacagctcataataatctacttatcaacagaataatttgccacaaagttcctaaaatgtgcctatccaaatattattattgcacatgcagttaaaagcaaaagcttagaaactcctaagtcctagtggcttctaacaagtgaagaatctgtgcagtggaatccgggccactctctcctatccctgagcattggagtccaggccactccctcccgtctctgagcatgcctgtgaaatggctctttcagtgccagcaaagcagcagatgtcccgtttcactcagaatgcaagggaccaaaagacacaggtctagtgccaaaatctgataagggaccctgggctcacaggaccttgacctatttccccaatagcaaaatggaaataatactagctactgtctaactcacagggatattatgacactaatgagacatacatgtttttatattaggctaaggtgttagggtcctacaaacttgcaggtctttatatacctgcactgaaaagtcgggtaggctgagcttggacttggacagcggtgtctgtggcattcatgtatatggcaggaccggagggcaagcagaagcccagtgaacggtagccttcttggggttggatagttgtctgcctgtgatgaagggaggcagcagccatgttgacactctttatgagggaggccatccccttccttaggcactcaggactgagcagggttatgtggttttgttcagtggcagcaacatttcgtcctggagtaagctgccccttaagtgggaaattaagccctgattcatgtcctcagccgacttcactgttttattaggtcctaatgggtgcaggctccctaataatccctttcctggcattattcctgactagtttgcatgacacattgatggagctttgtggacacacctcgaaatgcatgacccaagccctggaaggaccatgttgtcttgggatgctgtgtgctttaaacggaaatactacagtttcatgtgattttctttttgcatcatggaatgtaatgtttagaagtagctgttggtccggaaggtcttcaaatggttgagacttgatatttatttaactcagagaagtagagaaagtgcatcccagggaagtgaggaaggggcttgtgtagtagcctttgactccggccccatttaagaaccactgaatttaaccgcttgttttaatatattttaattggaagactgactttttaaagttgaaaatgtaaaacacatgcacttgtttttaaacaaactcagagtagaaacaaatatgatgaaaagttaacctctaaaatttttggtggtaatggatatatcaactatatatccattgattgtggtgacatttttgtgatgtatacagatgtcaaaatttatcaaattgtatacttt

SEQ ID NO: 112301 - DNA, 1134 bp, Homo sapiens
tgccagatctacagacatctaatgtctgcagatacccactccctgcctagcctccctaatcacataagactgggacatcttcgaaggcaaggataccccttgttcttactcatccttgtttctgcaaagcccacctacctcagggcctgactcattgtgggtcattcagtagatgtttgctgaatgaataaacattgtttgtcttttgttcttttaatgagtaactgctgtttcctttgcacccctccccaatacatttttctcttggctggcagctccttgtctgcttgctgaagatagaaccgcagaccacctgagcaccccctgcctcctcagctgctcactgttcttctgcatgtggccttcaggacctctgcccagcagttgtggcccatgtcaccctctctgctgttgtcaccagaaatttacccgcactgtaccctctggtccttcacagctcatttctcataatctattttaacaacaaagtttgagaaggttaagaatacaggatggtaggaggtggaaaaaacagtgggcgtgagcagtaagtcgatatgactaagctgagactcttctgagtcttctagatggaaggggaatttctccagagttacgggcagttaccacgttgcctcatggtcttgagcccctcttttaaaacccctgttgtctacattaagcggaagtctccccttggctgcattttgatgtcacttaaaatgttgctggggcccatgcttcctagaggaaggcaagcacagctagcattcccaggaaagccctcaactcaggggtttcattttgtttttatgatgggaaataactttcatttcgcggtcactgcccaccccactacttcctctttgaccccttcatctaagatgaacacatctgttattttaccctgtatagcaggtgcaaaagagaattaaaatggtgtctgaatccataaaaggaatatattgcatagagaatcaaggccacagtaacaagtgacaggcgatcttaaaatattggaataatctatctttcaagttacagaagcttactagagataggggcaggtcattgttacaagcatctggcagtacattaatcatgagaaattaattaggccttaatgtgggtcta

SEQ ID NO: 112302 - DNA, 1328 bp, Homo sapiens
gctttgcaataggcatttgtctaacttctgcgtgaattgggtcttacagaagatgacctcccccctctctgggggtcagggggtgtgtgtgttttttatacatctgtctttttttgtttgtttgtttttactgaagacctcttatatttgcagacactgaaaccaaaggtaacaccacgtcttctccttacagggtctaatgacagtttcttgggctcttcttttcttttttttttttttttctctacatatagttttcccaaaaatatgaacacgtttagatgttggaaagaaagcagtttccctccctccttccctccatccccccctccctcccttcctcgcttcctcccttcctcccttttgtttctctcttttctctttctctctctttctctttctttctcactctttctttctctttctctttctctctctctttctttcctctcttaagtattaatcacatacctgataatcagatgccctctgaaggttttctttgggaggggaaaggacaaatgcaataatctttacatgttggaaaactgaccccacatccccgtgccttgttgtgtgttcttttctgctcccagggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttgtaagtattccactctctactctcagattgagagccaaaactttaccttccatcaggaggtcaccctatctacaggcaagacagtgagctgtaccaaaggcactggccaaagtagggcccaggtcattattttcttttgagagagctctctagccctgattcccagttgtgcctccttaataagtacaacaccacccccaccaccccaccatgccatccatggaggttttgtgcatatatatcacagacttggattccattccctaagatatctttaggactaaggtaggtatatatatatattttcttctaagtgattccttcccaccgttttaatgcacatagtaagtggggagctgtgcaggctgttggtttggagaaaccaggcaaaagcacagtgactgtggcctgtccagattaaatctgttaagcagtaggttttgctaaatatggagaaacagtaaaaggtaaagcttctttgtccttagctggtacaaagttctcctttgtaatttttagatgtggtgcggttggcgtgatcactgtctgagtgaatgtttgtagaggagaggtttcaccaggggg

SEQ ID NO: 112303 - DNA, 1045 bp, Homo sapiens
agctcagttcgaaccagaacaaacacagaccagagagtgtgcagtttgcaagatttaatagagtgaaaacagagctcccatacaacgggaggggacccaaaggggttgcccactccctgcttgaatgcctgagtttatatctcgatcattgtccctccccctgtgctctcaggcgatatatgatttgacaatttctttacctcctgctttagcctaatttgtattttagtgagcctatttactacctgattggttgggtgtgagctgagtagttacaagccccatgtttaaaagtgggtgcggtcacctttcccagctaggcttaggaattcttattcggcctgggaaatccagctagtcctgtctctcagtattagaaatgcctctttatgatggaactgacatttctctctgtcaattctgctactgctacctcttctttctggtgccaagttagctgtgtcttcttctcccataattaagcttaaagtcttttaagaatgtcttcatgtatccccaaagtcttctctctcttccggtggctgagaaggtccataacctgaaagcttcaggtactaacatctgtggttaaaggcattgtcagaggagaggctggtttcctaacaaccctgggcctttagcactgttgcttggattttttattttaagtttatttttgtagagaaagggtctcgctatactgcccaggctggtctcaaactcctggcctcaagcgatcctcccacttcagcctcccaaagtgttgggattacaggtgtgagccactccacccagcctgttgcttggattttgtccgacttctctggcaagttttttctcagcatcatttgtataggtggagaatttggtttgagtatttctgttttccttcaaccttttcccccggagtaaatattcatagttcactgcttggaaacccaagaaacaaaattggatcaaacctttggtctatgcagacttgtgaagggtgtggttgccttctttgatgtcacctcagaagttaatgaatacaacctcaatccta

SEQ ID NO: 112304 - DNA, 2977 bp, Homo sapiens
cacatgggtaagagtgcctgcctggctggtttctggtgagggtgaagtagtccaggtagcccagtgcctggctggagtcactgctgagaagtgtagttcttttggtgctgcttttattcaggccttcagcagatctcacccggatcaccccagagcctgctagctgcttccacagcacgtgactgccacctgagcgggcttctaaattcagaaatggcctggagcttcctctgctccaaatgccctcagatacaaacccagcctcgcccaaccagcctcttcatctcttctcaccgcttgtcacatagaggccccactgggccagatcctgtcgctttgtctgcactcttactgatgggaccttctgcccctccccatgcacccccataacacccactgcttgtgcctctgctccatgcactctgttcttaaccgtctcccctctagactcagctcctgagggtgtcactggatgttttgctagaaataacccttgactgacataatacctggcaactcacaggtgatcctcatgaaagtatttgctcaataaatgaacgagtctcatatttttgaggtcccagaatagagggtcacctgccgctagtccagacttcaccttttttcacttgagtttaggggcaccatgatcagagcctgttttagctcaggctgctgtaacaaaatactatagactgggtggcttaaataacaaacatttctctctcacagttcgccaggctgggaagtccaagatcaaggtggtgacagattcagttcctggcgagggccctcggtttgcagccgcctttttgctgtgtgctggcatggcagagtgagagagggagggccctggtctcttccttttctttttttttttttttttttgagatggagtctctctgtgtcacccaagctggagtgcagtggcacgatctcggctcactgcaacctccgcctcctggattcaagcagttctcctgctcagccttccgagtagctgggactacaaggcgcacgcctggctgatttttgtatttttagtagagacggggtttcactgtgttggccaggctggtctcaaactcctgacctcatgatctgcccgcctcagtctcccaaagtgctgggattacaggtgtgagccactgtgcccagcctcttccttttcttataaagacactaatcccatcatgggggtcccaccctcatgacatcttccaaacctaattacctcccaaaggccccacctcaaaatactaccacacgggggcttagggtatcagaatgtgaatttgggggagtcacgaacatttagtccataccagaacctctattaaatctttcagcttaaactttacacctaggctggaatgtttctaggtatgtctcccgtcttctgaatgtaaatgaaaatatctgggaatggctgagaacatgggtgatttctgaaaggctgcgcttttgcatgtggctgtttccacgctgatggggcagtggctctcaccagagtgtgtagagatggtagtttccctgcctgtgagcagtgccacctgatggaacttggtaccgctggcctccccagcagctacttgattgcaggattgtatggagacctaaaagatgactacccctccttctcctcttctcctcaaaggcaggtcatggccactttttaatctgcaaaaaaaggattacttgagtttcactaatgaccttttttgacaagaaaaaatgggaaggagccatgcacctttgaagcagctagtcgtcttttatccttgtatctctttgccaggcatgaactaagctgctcttgctcccttacatctccctggactgttcagggcctgacaggctttcttctcattcctagtcgtcactctggcctctgcagcagttccttagatagatggatgtttggagttttacagagtggcggagcatctttgacaagtttttataggggcaggttcctctgtggccctgtggtctctatttgttcttactgtgcatactgtttagaaccacatttctaactctccaggatcacccctcgctgagtagctgtattttctttgaaatgtcattcctcgttaccctttctcactagggaaatccttctctatctcttactctaggaaaactgttgtcagtaggatctggtttatggaggggttggtgaatcaagagctagtctcataaatctcaaaggggtccatctggcccagctttgggtacacatttcataggcctgtctctctctctttcttatccagcagttggaaggaatgtgcttgtatatgcaaaagcagaagagtcccagaccttggggtttattaatgctatttttgtatttcttttctgtgtgggttgcgagaagaagcttgccaggtggcacacagaggctcctctgtgctggtgatgaaaaaaaaaaacacagacactcctgaagtttattggtgtggaacccttctggagttttgtttgccttttcgtttctgcatgtgcatagaaacctctttcaagaagaaatagttactcagaacatattcctttattgcagaagcatggggaagaagctgcttaaattccagagacagctgaatgaataaggcactaatgaggagagggaaggttagctggtttgtccttttttttttttttttttttgagacggaggctctctctgtctcccgggctgtagtgcagtttcgcagtctcagctcactggcgtgggcaaggtccgcctcccgggttcatgccattctcctgcctcagcctcccgagtagctgggactactcccaccaccacacctggctaattttttgtatttttagtagagacaggatttcaccacgttagccaggatggtctcgatctcctgacctcttgatccacccgcctcggcctcccagagtgctgggattacaggcatgagccactgcgcctggccggttggctggtttttcacat

SEQ ID NO: 112305 - DNA, 1058 bp, Homo sapiens
ctccctctattccttctgctaaggcagactgtccttttgccccaccatgccacctgggaaaattctgattcagtaggtccaggatagacactgcgatgctctattttaacaggcctactagattgttgtgactgcagtcaagtttagttatcattgataaaagccagtgacatgctgttgagcaggccaaggacagagcccaatgacatgtcactagaaatttcctttggggttgacactcattcacttatgtgtgcccttgggtgtcatcagtcaaggagtttctcatccatctacttgtcattacatcagactatatttctgcatcttgtctttgtagatagatggtatctttcactttttcactggttaactggcctaggcacttaactgaacctagcactttcttattgaacccatgctgggtcctgaagcacatcattttctcatccaggtacttgggaacctttatcagcaaagcaaggactaaggcataatacatcactcctcaattcgagaaacgttttcctcacttggcttccaggatatcacactctcctggtttccatacctcacaggtggtgccttctcacatgtgtttgctagttccacctcatttccctgacctctaaattttggagtgcccaaggctcagtctgagctttgactcgtcttaagaaatctcatctagacttggggctttacatgccatctgtcactgatgacttccaaatgaatatttttgcttccaacctcatctgaattctagacttgcatagccagcatccacactgaaatgcctggtaggcttctgaaacttaacacattcaaaacaacacaagtgattctcatgccctcccaacctgctcttcccaattgcggtaaagaaacaactccactcttctacttgctcattcctgacactctgctttcttttctcctcataccatattcagcccatcagcaaatactgtcagctctactttgaaactatattgaaaatccgatttcttccaccacctccgctgttataccctgttctaagtggccaccacatc

SEQ ID NO: 112306 - DNA, 1330 bp, Homo sapiens
aggcagcctcaaattttaggagagtttcaggctccaatccatggaccagagaattgggtttgttttgtggtctcttgaggaggatgtgaagtgtgttgatctccttggtaactgcagagactgctctctcaaagccctttgggttaatttctgagttcggccaggcctctgctggagtaagttttcaaggtgaaccccagcctggtagacagtgtggtgaacactgcacctgctgagctgacaccatcagcccatgaatcagtacatcccctagacccagatgtggcgacatttacttgtaagaggcctggagggtaaatccccaaactggatcatagctggaaggatgagatttccactggaagaaacacattttcttagcagataggactttcagcatattcatgtgaagtacagaagcattgaaagcaaaaatgattaccccatacttaatatcagtctgagttttaaacctagggctaatattgcagttcaacattagacataataatttaaagaattcattttgtctgagttttaaatcaactgtaaaaatgcaaaggatgagtgtctccaagggaagctgatttatgtgcaattgttcagagatcataggatctgctgtttggaaggaacattaacaattatgtgacatgaatcacctccacaacacccttgacaacatccagtgacagtcaactcattcattcagataacatttattgagcacatagcatgggcagggcttgtgctgaattctagggaaatgtggatgaagtgacctagtttcagtcttcatggagtttatccagttgtaggaagggtgtgtgcatatacctaaaataatacactgcaataaatgctacttaggggtgtatatatgtttaatggttcccacagcaaagtgctcagcatttctgtctctttaggttgcccttcctgttggaaagaccttcattccaccgaattagaatcatgtcccactagttttcactcattgattctggatctaccctgttggatcccacagaataagtctttccacatgttagcccgggaggtatgtcagggtgagggcctggttccttctgagtttccaggctaaacatctgcttctctctaggtggtcctcacaggatgtgggctggagccccttgtccattttgttggtgctcatctggccccgctctggtgtcttttctgcaccatggagaggaagctttaggggctgtagagagtgtggctggattgcgtcctttctcccctcatcaatctagcttgggatccactgtagatcacggtgtctgcagctcactgagagtcccaagta

SEQ ID NO: 112307 - DNA, 1040 bp, Homo sapiens
tttttttccttgcctttcctcttgtttttcctttcctttcctttctaacagactcactgtctcactcaggctagaatgcagtgacgtgatcatacctcaatgtaaccttgaactcctgggctcaagcgatcctcccactcagcctcccaagtagctgtgaccacagacacataccaccatgcccggctaatctttttaattttattttcatatttattttttatattcactgtgttgcccaggctggtctcaaactcctggactcaagcaatcctcccacattggcctcccaaagtgctgggactacagactgagccattgcacctggacctaaaggcccataattttaaccttgtaccctgctgcttcctgccactgagtccatagagtctctgccttttcatctgctgtctccatcttgctgcggctgcctcttcctttttcagctgatgtcattctcaccaaattagtagcctcccaatttgtcttgctacctgcagtctcatctctcttcaattcattctttgtactgtgctggaaagatgtttctgaaatgcaaatctgataacttgttttgcttaaaatccttggttggcttcccatggcttgctggtcccttggtacccataacacatacagctatgctgatcaggccttaacccttctagcccagaggttctcaaacttcaacacatgtcacaattacctgcagggcttgttaagaagacagaacttgctgggccctgcccccagagtttctgatgtagtaggtctcgagctgcctcagaatttgcatttctgacaagttccctggtgctaccactggtgcgggaccatagcctgcctagtgccttgtctggctctctctgctccagccctggaaccacttgcaggttcctgaagggagatgctgtttcaggctttgatccttttggataagctgttgcctctacaggagatagtctttctatcgccgtctctttaaaatacagttcaagtgtcacttcctaggaagcttcctctgacccctgcagtgatct

SEQ ID NO: 112308 - DNA, 1852 bp, Homo sapiens
atagatcttctcatcctgcatttggagtggtcgggattctggagtcagatgcctgggtttgaattggggttttcccagtcactaggtaggtagcaactctagtccaggctacttaatgtctcgtaagctcagtttccacagttggaaagtgacgatatggtgtttacttcagtggttgtcctgaaactttattgaaatgacacaagttcgtaactgtgccagttccattgtaaggatgcaataaatgttagctcttgtttttattaatgacgaggatataatgtttaaactcaatgcccacttcgggcagttttttaccctgtagaagcagttgtaatcattttcaaatcaggcttgctacacccttccagctggaaagaaaagtctctaatttcattgattttcgagggcacatgctttagttgaatgagtagtaaccaaatggagatatgtagtaggcggttagaagtgttagcatctttgggatcatgtggtcaaccacattataaatgaatgcttggatgtaagggcagacctgcatctgtgtgtgtgttttcagtgggtggatggggccatgtggtatcacagcgtgccacacagggatttacggtggtcaagaagcatttgtggtacagagcttggagtttggagtaaggcttccttgttttgcatcctggctctaccactgtcaatctgtgtgaccttgggtgagtcacttaactgtttcctcacctgttaaatgtgaataataacagtacctctccccttttgtgaagactgaatgagataaatgaaaagctgtttgcagtatggtcatactaaaatgggagcagtcagtaccctccccccatttccagcagagtggtgggcaggtctagctagcccttgtacatacaccttgcagaatagtttatagtagtgagcatagctggtaaatgtacaataaaaaaagttcctgtttttcatttctacctgattgaatgagacacctatttaatgcaaatttcaataatgctctgatactaactctgttcaagttagtaagagagctttgtagagttattgtgacacctgggttaagtatggctgactttgggttaagtatgaggtctaatcatcccagtctgtcctctagattttttgctgttttgttcaatataattatgtaaacaggtattctctatgtaaacatttgtgaaagttaaaataccaaagcagattaaatatagaactagactggatgcctacatcagtgttttagtgacagcaaaaaaaaaaaaaaaaatcatctgttacatttaattattttggctagtttcagttctgttggtttgatagtattctttttagttgatatataaatttgcttggggttttataccagtcttctatttctgcatatttaaggaatattttaataaataataacttatgtcaaccttgaggatctatgacttttttcttttaaagagagttcatatattagtccataaccattgaatagatcgttcagagtgtatgaagaagagcataatcctgtgcacagctggcttttctgatttgcagggtatttagtgtacatttctctatccagctcatatgccggacagaggaacactttacccttctggtctctctgcctgttgggcaattgggttattctgggtatgtggaggagcttttttgattcttgttgtgagggatgctttcaacagaaaagagaggaagaatatttgtctttcattgctcaatacccagatatttcatattcatcagaaatagctacttctgaattcttttttcctctttaaattagacacaacattatcccgtctactgttatttctttttt

SEQ ID NO: 112309 - DNA, 1046 bp, Homo sapiens
tcaggtagtctcaaggtatgcattatttgggggaaaattagaaaattccctaaagacatttaaaaattctaaagtaggctgggtgcagtggctcacacctgtaatcccagcactttgggaggccaaggcaggtagatcacttgaggtcaggagttcaagaccaacctggccaacatggtgaaaccctgtctctgctaaaaatacaaaaaaaaattagcctggcgtggtgtcgggagcctgtaatcccagctacttgggaggctgaggcaggagaatcgcttcaaccagggaggcggaggttgtggtgagccgagatcacgccactgcactctagtctgggcgacagagggagacttcatctcaaaaaaaaaaaaaattctaaagtagcagaattgttatgtatgtatttatggatgggtgtatatatatgtatattaagaaatgctagtcaaagtgcagatatgatttacacattatctaatggaagctttctaacccccgaccccataggcacatccacgatgcgagaacacaggctcatgcagagttgaaacgctgttgccaaactaaatcaagactgataattggccagttagctcaaagagtcaatgaaaatgatgagggtgtgtgtaaaatgacacatactttacacattttattttaaatgaaaatacgattttgaagtagtatattgtctagcattttggttttttccctgctcgtgctgtgtgcatggagactctgatatttttcccccagtggtatgtcacttgctgtaatattttgagtactaggaatgttttgagataggcccaaggtctttttcttgtctaagtgtcctctgactgaagtatcttccttgtgtaaacttcagccataatttgtcagccacaacttccatttacatttttttaaggtggacctagaactcagcaatacttgcaaagtaatctaagtcgggaggtttttccagaatttttccagtgttatgcagttgtctccgtcacacctcattcaacagcaaacttttgtcatggtttgccttc

SEQ ID NO: 112310 - DNA, 2597 bp, Homo sapiens
ctaattttttgccatgaatgtgttcggcactaggaaaggtgatacatactagaactgaggaacttaactgggggttcatatgctttctaagagaccgtgggagagtttctgggcatctctgcacccctaaaatcctagcaaaattgtgtatgtgtgcacgcttttgtgtttttttctttttctttttcttttttttttttttttgagacagagtctcgctctgtcgcccaggctggagtgtagtggcatgatctcggctgtcagctcactgcagcctctacctccagggttcaagggattctcctgcctcagcctcctgagtagctgggattacaggcacccaccaccacgccagcgaatttttatattttagtagagacggggtttcaccgtgttggccaggctggtctcaaacccctggactcaagtgatccgtctacctcggcttcccaaagtgctgggattacaggcgtgagccaccacacctggcttctttgtgcatttttcctgagtaaggatgtgtagctttcattagatgctcaaaggagatccttaatccacagaaggttcagagccactgataggaaatatttaacactgacagaaaatagttctgaactttgcgattaaataatttattgtgagtgggaggagctaaaagagtgatgccacttaggagaagcacaaaggaatctgagctcgaggatgaattgttaatctatgttaatgaattcagtctgtacagggttcaaacaaaatatattatggatgagcctctaataaaatggacttcctctgctctgccagtccgacagttaatgatggctggcaattttctgccggctgattttggctcagtgctttggagcaggcacaggcccagttctcgccacttggaaggaaagggaaagtgatagtttgttactttgctctcataagcaatttatgacaacagtttaataaaagcttaagaagtgtcctcttcctgggcggggagaggagccgaggagcctcagtgggagcaccgcgtgggatgttaagcccctcagcatctcctggggccgcctgacgctgccacacaagagaagagcgagggggagccagcgaggtgtttcttttagcccaggcaaggctactgttatgcttgccaatttgacttttccccagcaaactcaagctgtcctgtgagtttccacatcagccgtgtgcctggggagctgctccgagcttgggctctggtgctgtctgctgcatggacctcattagcgctcacccagcagattgctttcatatcgctgcttcacccttttcagttttgaattaccacataaacatcagatattgggggttttgtgaaaggatccttagtctctaatatttagttaaggaaaaaagccctcttagggaatcagatagatttgcttagaggatttcctcaggaaaatacattgcagtatgggtcagttctaattttcctcaattcctgaggccatttagttttcacttctctctctctctctccccacctcaaccctgtgagtccaggtttaggggattttacagccagccttcacacaactttctgctctacatttgtggccttaaaactttatgatttataggaaagtatatttcatgtcatgaactgggatataaatatgtatgtatatatgtataagcaaaaaggtttcacaaggcaatatttgcccttatataccatagtctgatattttctattctgtcggggaatactgctggtcttcactcattaaatcattttcatggctcaccaatggtttgcaccctgcagttggaaaacacctctcagggatactcagggatccgtcctttctatcactgtgttgagggatggctcagggcaccgtgtagtggctgaacctctttatgtggtacagcagaaccaactttatgtattttcagtaacacttctgatattctggagggagtagagcatagtgatttaagagcgaatgttctagttagaatatgcttgcttggtcctgggtctctgacctaccacctgctctggtgttgggcaagtttcttaacctctctgaatcagtttgcccttctttaaaatagatataatttgaatacttatagcgaaacattgtgaagattgagatgtatattattaatacattattaatatatcctaatgcacatctattaagacacaatacagaattaatattaatagcaaacatttgttcaatgttactatgtgtctgtggtaaatttaacaaatgtttgctattaacattattaatactgtatcttaatatttatgtgtatctccagttggattacattttccttctgccctttgaaataacttatgttgagcctattaagaatatgtgggttgggtgtgctggctcacgcctgtaatcccagcactttgggaggttgaggtgggcatatcgcttgaggccaggagttctagaccagcctaggcaacatggtgaaaccctgcctctacaaaaaatacaaagaaattagccaggtgtggtggcacacgccagtagtcacagctacttgagaggctgaggtgggaggatcacctgagcccagga

SEQ ID NO: 112311 - DNA, 1010 bp, Homo sapiens
taggaaaacttctggtgttctcaggctatttcttctattaccatccaaggcctaacacttctagctccaagcagagtatctttctgtgggatttttatactcatgtcacttcctctccccaacccccaccttgaacatgtattatacatggaattctttggtaaatagaatgcaaatttgttttcaaagcttgtttggcacatactctctcctttagaaagcaaagggtgtcctttcagaaggttcttataatatttgtggatctggccttcaggtctaagctgaagcttttgttttcatttggactttatgcatgtattaacagtttatattttctgtggtaatggaatattttaggggttgtttcttcattatatttagattcttatattaaaaagcgtgcaaaggcatttaaccaaatttaatctagaaataaagataatatggtaatttcaaatagctttttgttcaagatgagattttaaaagttattattccacagtgaattttaatgatgattgtgtacaatggcatttatggatgtgcagcaattgaatgagtatgattagcgcgttagattatggatttgtaatgtgaaatgagaactttttaataagctttctccataatggttcacgctgtgaacaaacaaagtatgagacactgagcttcactaaatcattgcagggctttggaatcagtaggttcatgttttcaaatagtttcctatttttaaaaacaccgctaaaaagttaagaggcagctacataactagatatcttatattttgaggagttggaagaacatgtttctttttataataaaaggaaaatgttattgttgaagtatatttattgttcaagtataaaatggaattgaagttatgctttgagaaaaacttgattgcaagaccttattaggatttaacacctcatcaagactgctttttacattttttttttaatttattttttttttagatagagtctcgctctgtcacccaggatgga

SEQ ID NO: 112312 - DNA, 1056 bp, Homo sapiens
ctgtgacagtttcgtagacctttttgtttttgatgatcttgacagttttgaggaatagtgtttaggtattttgtggaatgttcctcagatttgtctgttgtttttctcatgattagactaggggaagacccacagaggttaagtgccatttttgttgtatcaggggtacatcctgtcaacatgacttatcactgatgtgatcatgtcaacataatcttgatcacgtggccgatgcaatccgctgccagatttctccactgtaaagtgactcggcccacctcctttggaaggaggccactacgtacagcccttgcataaggaatggggaattttgcccttcccagttgtgggcagaatatttacataaattatttggaattctcagttgtatttctaagtgtgtgattttaaaaactacttggatgttaaaatggttactgttgtattcattattgagtgaatacttacaaatgtggtctgatgaacattttattctacctaagggaaaaaaacagcttcccaaattgcagccaccctgcctagttcagagactgtagaatttgtattcctccccgagtgtgttcttagtagcacgccagaagtgccagatgctaccctctctttttctgtgtcatgatttaataccatttgtgcattttcttctgcttcagttgatttagtgtcatttttggagaccacagacctatttgtattttatatgttactatacagtgtgtattctgtttagaaaaataaaaacgctagtatgataaaatgtactattttattatctttatttttaaagtgttactatcaaagacatcctttggtgtctcataattggctttgactttgttgctctcaataagagtatatgattccagattttctgtttagtcaatgtttaaactacttcatgtttaacatttatgcacattataatacaatgtggtaataagggtcatttggcttcttggctctttcaaaatattggtataatttttaacaaatttattttgaaataatcatttcactttttgatgagtataaacttgg

SEQ ID NO: 112313 - DNA, 1010 bp, Homo sapiens
tttattcaataaatactgaatatctaccattttccaggatttgtgccaggtcctagggatatgacaatggaaaaagatctgctaatattgtatttttagtagagacaaggtttctccatgttgggtcaggctggtcttgaactcccgacctcaggtgatccgcccaccttggcctcccaaagtgctgggattataggcgtgagcctggatgactgtcctttttgcagtgatgtataggcccaggccctttccacgttatggctctgctagccccattgtgttccgttttatgtgaaagggtaaagaagagagcatggagtggatatatttgtttcttaaagccttgcctcagaagtgacacctaccacttctctcacagtccattggtaaagacaagtcacaaagccactcaaactgcaagggcagctgagacatgtggtctagctgggtgaccagaaagacaaaatggagttttggtagacagctaccaaactcggccacatacctcattatactagctgcaaactgtgttatcgttagttgcctgcatattaattagttccttctgcttagaacacttttatctagaatatttgcaacatttgccactcacttcatttaaatctcagctcatctgaaacttcttccaagtgtaagaccactcagtctggaaaagctccccatcttcctacactgccttttttactttagagcccctgtcacacattatattatatatatagtttagtttattgtgctcccctgcacaggaatgtaagtgtcatgatggcacagcatttgttttgctcattgttctatctacagaatctagaagagtgcctggcacttgtcttcaaggattatccacatcctgaaggcagagctttgttgttcacatttcagtgaatatttgctgagcggagcctcatgctagacaggccttggaggcacgtcctaaacaaggaaaacacgccccctgcctccctcaattgaagatattagtctcttca

SEQ ID NO: 112314 - DNA, 1052 bp, Homo sapiens
gcctttggtattattctcgaggttgtcagcatacatccccactgccatctttttctaatgcaaaggtcttttcattaatggatattttttcctgtgagacttgtttaggggagagatgcatccctcatttccccacccccacccgccataaggtttttacaagccaagctagagattgctttccagccactttcagaaaaatgctggggctccactttgtgtttagcacaatcagcacacataattcttgttctgcttgggctctgttcaatgtcacttgctcctcctgaccctagaaagagttgagaattataagcacggattataaggactcataatctcagttgccagagtaagggaaataacgttttcaccggttccctgaaatagacctggcggacagctgttgcctcccctcccctttcctctcatttcccctggagatgtactctgcctgtttcttctcctcgctaaaactaaggaactttcccttgtgttttcttttggcttctagattgttcacttggctttttatctaagcttgtattaaattgcttcatgatctgtgcctgcagaggctttggcataacatggctcacagagaagtgttgtttgttgtggttggaccactttgttgcagcagcatctgttcttgtctgaatggggcatgcaggtgaagcatgtactctaggccactgaaaaaggagggaacacaggcacctggactgaccattggcagctgtgatctacttatgtgactctcagacagcctctcagctgcttgtgataaaggctacaaaattccaggcagctttttggtccccataacaagtatatataactcctactttaagcagtccaaatttaatacagagcaatgggatgagatgtatgtaggtggtgtcacatccacaagaatatctttaatcattattcttttcagcaattcagtttcaagaggaataagtgaatttaggaaatttgtatatgggaaaacattgtcaatcagtaaatgcgtggtctactgtgtatattttctcctcagttcttta

SEQ ID NO: 112315 - DNA, 1030 bp, Homo sapiens
ccgccccgccaccaccgccaacaactaactgaactcgtttctacttctctgacccactgccctggccaaagtcctccctgcctttccaggcccctttcaggtttcctctctctccttttgtgtctagccctcattgctcaccatcatcttctctgacctcctgtggtacttgaggacatactggaggcagacccatctgcgattacatcccaaccgtgctgtgttgctttgaacaaggcagccacatctccgaaccactgaaaaaaggcataataatgatagctggatcctgggatttctggattctgtaaaaccaattgtgtaaaagttctttgtaaatggttagatgtgcctggtttcttcagtaatcagttatttttgaaattatttttaatttgtcccatagtaaggaatatattttaatgttgtgatgggcacatacattttaattaagagttccacaggaacattttcttctttttttgtgtgtgttaaaaacagtgtttattttgacccatttaattgattttgactatccactgtaggaggctacccacaatttggaaggaaccatcgggcctagatgacaataaaccctttgagggcagggaatgtattttgcacttctgcgtcctcataggcccaacaggttacgagaagatccagtctgttgatggattttgtgctgggagtaggcaggatggagagacttattcaaatttcaaattatttattgagtgcccctttgcaagaattggccagttaaaccctggggggcagctttgtagctgcactactcgggagcctgcaccctcttgaagacatcatgccagcgtctcctgcacttggccgtgtaggctgcagcacagctgtttctgctacaatcagctccagtatttgtattcctcctcttgaggccgaggcttgttcgttggccccagggaatgtgttgtgttggggtttgaatctcctgtcctgcgtgcggtgcccctgccaagggctgtgcacccacctgtcccagatgggtctt

SEQ ID NO: 112316 - DNA, 1017 bp, Homo sapiens
aacctccacctctcaggcaccctgagaggccctgttctcaggccttctcagggtactggtaggtgaggccccagcacgcgttgctcagagccagtttggctcaggtctgtaggaggtgcgatgtggacataagtggggtggagtatgaaagaggagagatggcaaaatgggagagcgtttacctggtcaagggcttaggtcacattaggttctcaaaggcaaatatggcttcatgtggatactttcttgagtccatctctctctgtttctgttcctccctctgcctaacctatcctggctctaagctggctcagacactgcgtttgtgtcttttcacgtggcatttttcttttttccctccaccttgctaagtgctgaaatttgcagtcagcatttatatatgccctatagacaaggcacatttctctagttttacctttcttgtcatttgtgatcttttaaattttcagtcaatggaaagtaattgttaatatgaattgcagtttggaaactttgtgccagatgatgaaactgaatgaatctgtggtctttacgtaggcagtgccttacgtatggtttggtttttggcccatgtactagatgtttgcctttctgtgggctgtcacagatctggcatgtacctttatttttttgggagtttctacatgtgttgctgcaatctctcagctaagagtatttttcagtcctcttgctatttgttttttaccacttatagggtgaaaggaagtaaaattagataggattttgatgtttgatttaaaaatcaacatttccatgaattcaaaacttcaagaagatgaaaggataacattgattcttctgtttaaagaaaattgatttcctttggctgaaaaagttttgttctctctctcttggtgttcattattttagatgttccctttggactctgtgcacatccccatcatagaacctactatatttactatgatagtaaattgacctctctgccaacaccactggaccatgtaagttcct

SEQ ID NO: 112317 - DNA, 2108 bp, Homo sapiens
gagaaaccttgatagggcccttggatgaagcactgcagcttatgctaagaagatcaaggccctgttagactggaaacattcattgtaagacctagtgccataaggtaaagaggtctctaggagaatgctcaagatctctgagggataactgttaaatatcctgtaagaattaggcttaaattatacacacgtgagaaaggtaagtgctctcagtgcagggggtaaaataaacctttagtgaaactctatgacgaggaaccctgcccatcaactgttggtaagtttagaaaaaatgaagagatgcaattcaaggtcagtaagtaggtgaaatatgatgtgcgcataaacctttaaaggtttgagaggttggctgtttttggtaacgggttaacttgaggattaatgagtcaggatatatggaaagttaaaattcccttctctgcaccattcaattcagttcaacaaatactttcccaggccaaatgggatcattagccttgtaggaaactcttggcctttttaaaatgatgacattgtggccagttttgtaaatacagttgatgcgtgaatctgtagaccaaggatcagattaattttgtaatgccctcagggaaggcagttgatgaactggtttctctgcatcataagagcagtgttaatgatccacttgtaccatgagattctaacattcctgagttacctaaatgcttcagtgttccctgccatgtaattttaagctgtatgtacatttttgggataatttttatccatattttgtttaaaaaatgaactaaaccaaactaaaattcagaacattttgtacttctgcttcttattaagattgtttagtccttggtgggtgatgtgagaagatcagtacttaacagtttgagaattcttgctctcataaatcaaaatagtattcgatgacagttttcaaacagtttcaagtgatgatttagattctcttgtagttgttatctactttagaatagtgttactatgatttaaaagttggtatttcggctgggccatggtggctcaagcctgtaatcctaaaactttgggaggccaagatgggaggatcacttgagcgcaggagttcgagaccagcctgggcaacatagactctatctgtacaaaatacaaaatttaaaaagttgttatttcatgagtttgcatttttaaatgcaatggacaatagatagaactgtttataagatatatttgcttgtatgtttttctcttcatattacgaggtcaaaccacagaggaaaaataaaatttggaggccctaagcctatttacccaatgtctcctagaagagcccccttcagaaacttctagcaattgttagtgttgcttgggttaatagccatggtcaaagcatgaacagaacaaaataaaaattttctaaatataaaggaaatatggtaataactgagaagccaagcattaataactgggaagccaagcattctctcaatatcctctttctccataagaaacgtgtagcattttccttggagaagggtctatgttacttttgttcagcccttgatgaaaacaacatatggttagttttatgaggacttagagacagatggtgacctacaggctaattatgcagtgggcaagattctttaaacaaatcactgtgattgtgacatggccctttctcatgagttagacaatctggactgttcattgtcacactaggtaaacatgttccaggtgaatgaggaagaggtgctacgtgagggaaatgtatttacaacatcttttcatctccatatttactttaatgggtataagagaaaaggaagtcaagaaggtaaaaggggagcacactaaaacctcagctagtgctaggattgtgttattttggacagctaacttttcagatagctgaggggttcccccattaagcataaacgtttttcttttaatcactttgaatgaactctttctgaagtcttccttgccctctgaaaacagaatgtctgagacgtagtaggctttatagtgtttatgatcttacttttcctgctttcccaaacgtaagcttcatgaaggtagcggtctcagtctgttctgtgctgtgaccc

SEQ ID NO: 112318 - DNA, 1114 bp, Homo sapiens
tacaaatacaaaaattagctgggcgtggtggtgtgtgcctgtaatcccaggggtagctgagacaggagaatctcttgaacccaggagacggaggttgcagtgagccgagattgtgccactgcactccagcctgggcgacagagcaagactctgtctcaaaaaaataaaataaatactaataaatacttaatgaaagaaggagaaaagtctagggaagttattatttggggaagagctaagaggaattcatctgtgaatagacaaactgaatatcattccacgattactttcactttaaatgtaagtatttaagggtaccgtgaatgaattccttcacagatgtgttggctctgcagggataaaggtgatggggtttccagttcatgttgcaagttcatgtctcaaggggaggttctgtgagacttgggctgtgtcctgaccacacagctttgcataattgattaattctgcataactgcttgcattcctttcctaaaataactttcactttctaattagctctccagaattaataagtgccaaaaaataggatgtgtgttgaatcttgtgatctaatgtgatgctgccaactcacacagatttaaggtataattaataatgctgaatctctgagggaattcttaattcctgaattggtagacagatctctaaaaagtagctaatacttattgtgtttaccatgtgccgggcactgtgctgaggactttacccagtttacctccttgatctgttttcattatcacaaacaccctaaggattagtattatgggtatctccatttctagagaggtaaagtcactcacacagccaattgacacagccagtgaatagcagaactggatttgggctgaaagagtcaggctctggagccagtgctcctaaaggccatgtgacattgcttctcttttctttctctggggtgttccagttttcctcagggcttcgtcattgctgctttctacttgctgacacttttgtcaaatgtgataaacagcaaaaattgatacagtacaggtccaaaataaacggaccctgataggtaccacaggtaaagttgttggcaaatgacatcacttatgtaatggtaggtcct

SEQ ID NO: 112319 - DNA, 1040 bp, Homo sapiens
ggtcagctggacaacttgcctcgctgggatagagcagtcagagtcagatgatgtttctatgaactgttttgttggggtcagatggactcaactgtgcagtccacatcatctgcccccatctgcactgacctgatatggtgggtggccacatcctaaaatagtttctcagagactttgtgtgtgaaacatacatataaatgtgttcatgtttataatgttggtgtgcaagagtttattttgcttaaagaagataatggaaattttggtttcaactaacatatctattttctctccactaatgagtatggaaggttttctcctagatgaaaacatggagagaatcactaataagaagagaaagctgttgagtactgttaaaatatcacaaaacagttactattatagtcatatatatgatacgttcattcttttagaggataatttaaacattattttgggtatatagggttttaaaaaatctattcagcatctaatatgaatgtgtgaaaaatttcacataaattttcatatagtaattgggaccaaattatttgctgtcttttgtctctttcacattgtttatgaagatctggcttgaataaaggagtcaggagctttcgccttccatagctaagcccaactgtcctaatgctgcataagacagctgggattagagaaactcttgaaaagcaggattggtaatgggaagtgatagctgtgtgtgaaagccttaatgctgaagtgcattcttgtaacgcaattttcttgtctgccttgttatcttacaattttagtgggaaaaataataacaatgttatttcaaagaaatggttaaaaaatagtcaaacttaatagaaagcagagccctgtcctttggttaaacactcatttactcagctctctctctctttttaaaaaacagaaccatgaatccttcctgtacagttgcatgggttgatattaactctctctcagcttattcactgtccacctaaaagaatagtacagggctccagaaatgtaccttgctctggtttata

SEQ ID NO: 112320 - DNA, 1048 bp, Homo sapiens
agtcagtctaatgaaatttgatttcatgcagagggtctcttagacaaaaattacatctataagcaaattactggctgcgcaggttactttgaaatatttctggtgtttttttaaaaaaatcagttaagctgatcagagacaaagggaagaaattacccttttctttttaatgtgcagcaaaatgtgtactaatggtgcaatcacagaatattaggttgttaatacaatcaataaaaagttaatccgttttggatttcattgtattatgtttttcttgtttgtggaataacgtaattgtgacagagtaattaataccctgcagagggattagccgtcaagattgagataaaagaacaaggagacaagagcagagttgcctagaagacaggggcgtttagaaagtgctgaggcatagagtttccttaaggtgattttttacctttcctgactctaattatacatttttgcatctagtagtgatacagctgggttggtaaaacatattattaatagaagtgagggagttctgaggtggatcagatttttccctttaagcttggtttccagccaagccaccggtcctcaattggtattttgctgtgtgttcagaatggctttttcacttctgtaatttacttatttcttattatttgttattcaaagatcttttggtcatttattctgcacaaatcctagaaaatgaaagccaaataaggagggattcccccaaatgagtactagtttttatatcagtgcatggtgggcctctcagtgccaacagattgttcccgttaatttttttttcccctttatattgactctggggtttctaatggtcagcctgtgctttcagattggagttattaactttgaccaaaacaggagtggtttgagaagaggcagtagagaggagaaagtggagatctagccagaatcttttgttttccacagaaattagagagggaaaagactataggaatcagactctgtcagccttgtcctttgtagcccctacccaggcagcaaagaggaaactgtcttcttcctg

SEQ ID NO: 112321 - DNA, 1448 bp, Homo sapiens
aatgttaaatcccttcttagtggtatttgttgtggatagaaggaattagattgaatgtggaactttgagcactctgaggataaattgtgccttctcattcaagacacattcaattctcttggtcactccatcttttctgaagttccttttaccatgctttgcagtggcgataggcctattgcatgaagagataaaatgtcttttaggctttttcctcttaaaaacttgggataagaacaagttagcctgaggcaatcacagagtctttataaagagacttttagcaaggaaatgatttttcaaatacagtacaggattttgggcatgactttgaactggaaagtctacatatataagtagaagatggtgtgtaatatctttgcaaatacttttgtgtattcattcctcatttgtaaatgttttcttacctgctgactcaagcactgacagtgtatttgtttgctcattcaactatggactgtgaacatgcttgggaaacagagttgagtattgtacgcaatctctgacctcagtaatacttaggcatatatgcttattcagtaactggacattttaaaataaaaagaaatgagtattttcactgcttgcatataatgggaatgattgaataactttcccataagatggcattagttcaagtgtccttattttagtaagagtatttcaggccaggtgtggtggcacacacctgtagtcccagctactcaggaggcagaggcaggaggatcctttgagcccaggagctagactccagcctgggtaacaaagaaagaccgcatctctttgaaaaaataatttggaagctctccgtaaaaatctcacctcttattttcctcaaaacaagctctggtgcattagggtatatagtagggtcccctggcctttggaatggggggttatttgagactggaaggtgggagtgggagagggagggggagccagggacaagcatggcaaagttccagattctctgtatttgtgtgaaaaatcacaaaaccctacattgactgtgtagtggatgtcagatgggaagagggagtggggaagcaatgaataatagcaatcacaggtgcaggagccacgtctcctcctgggcactttacatgcgttctctcacttattcttctttctcaccctgtgaggcttggtccagttgctattcccaaatcacccatgaggaacctgatgctgtgaagatcagcagcatggccaaggccgtgtagtgaagtgatgagcaggagttagtcccggtctttctgttgtctgagcttaccagctcttgccttcacacagtgctctctcctctcttatcaagttgaacgtgggtcaggaccatgaagttaattttcttcctccttttaatcatcaaaatggaatttctgttttgcctgttagagattattgatataagaaaggctgggcgttaa

SEQ ID NO: 112322 - DNA, 2067 bp, Homo sapiens
tgataaaacagggtttgagaagattgactccagtttcaaaagacgttctactgtgagtaaaatgccatctgacagcataacatgttacagagaaatcttttgtgaaaggaagagtcaatcaatgctgcaaacttcattgttgtcttattttaagaaattgccacagccaccccaaccttcagcgccaccaccgtcatcagtcagcagccatcaacattgaggcaaggccccccaccagcaaaaagattacgatgtgctaaaggcttaaatgattttcagcatttttggctataaagtatttttaaattaaggtatgtacattttttagacatgatggcattgcacacttactagatgcagtatagtataaatataacttttatgtgtactgagaaaaaaattgtgtgactcgctttattgcaatatttgccttagtactgtggtctagaatggaacctgcatatctccaagatatatctgtagtgtgattattttggaaaaccatttagtagttacccaagataagttaaaacatgtccacaaaaaagacttgtatgtgaatgttcatagcaacattattcacagtggccaaaaactggaaacaacccaagaatccatcacctagtgaatggttaaacaaattgtggtatatccataaaatggaatactactcagcaacaaaagggaacaaatttacagatacatacaacagcatgcatgaattccagaaaaattgtgcagtcaaaggaataaaactcagaagaccacatacaatgttcattcatatgaagttctggaacaggcaaaactagtctgtaggtacagaaagcaaatcagtggttttctggagtttgacatgggggtactaacaagggaactttttggggtggtgggaatgctgtatattttgattgtggggatggttacatggttggatgcatttgtcaaaacacacttaatggtaatgcaaaatgaatatattttattttatgtaaattatacctcaaagttgaatttttttaaaaagtttcttttaaaaagtaaagacatttgtggtgcttcttgtaaattttactgctgattatgaccttgtttctttagatttgactttccaagtttgaaaagaccagtttaaaaatgacttttgctgggcatggtggcatgtgcacgtagtcttacctactcaggaggctgacgcaggagggtcccttgagcccaggagttggaggctacagtgagctatgattatgccactgcactccagcttgggtgaaactgtgagaccctgtctctaaaaacaaaaataaaaaaaaattaaaatggctttttagattataatctatatgaaattgggggttatttcgcacttttatattatttgtccattttgcttctttctaaatagcctctggattgtgtgttattttcagaaagctcttggagattttttgaagtgtatgttttaacaggattttcctgttgctctttggcaaactttgtccttttattgtttaaggagtataaataacaacagaacagaattactttctggtgcattttcctcttctcctgagtcttttatgttcaataactctgaagttcctgttattcctgcctttgaacgtagaaaatgagactctctctcaaatacctgaaactaaggcacataaaaaatttaggaggggccaggcacggtggctcatgcctgtaatcccagtactttgggagattgaggctgaggtggatggatcgcttgagcttggcagttcaagaccagcctgggcaacatggtgaaaccccatctctacaaaaacaaaaattagctgggtatagtggcacgcacctgtagtgccagctacttgggaggctgaggtgggagaattgcttgagcccgggaggtggaggttgcagtgagcacagaccgcgccactgcactgcagcctgggtgacagaagtgaaaagaaacactgtctcaaaaaaaaaacaggagggaggagccaagatggccgaataggaacagctccggtctacagctcccagcgtgagcgacgcagaagacgggtgatt

SEQ ID NO: 112323 - DNA, 3044 bp, Homo sapiens
tagttctttgtttcaacaacaacaacaacaaaaaagagaaaagagataacacataagcaataacttaccattattgttttttaaaccttcacaaactgacttctttcatggaaatactgaaatatttattttgtatttaatttattatataatttaaaatgtagagcgagtgaattcagtttgggatctactgagtcacagtgcctggtagcagttggatgttgtaagagtgaagtctgagtgggagaaaagggttgaggaatctcagctgagtgtccctgagcaagctgcataacatctccaagccttggttttcacatctgacaaatggcatgagacctgctctttagggttgtattagagattaaatagtcacataaggagtactgagactgtagtatgtgctcagtaaatattctcttttctctctccctctttttgggtatgaaggtagttgtagttgtaaaattttcttccacacttaggaacagatatttctctaaatgtaagccccctgggcttattctagtttgttcgtacatcttaaaaatggaaacctcagactaaatatagtattcaagtataaatcccactactgcctagataatggtaaagacattacttcatagtctttgcgtgccttgttcccattaatacatatcatgtcatgttagctgttttataagacagttcattgctgattcatctcaccaattcagttccagaacagcaccgtgtcaaggatgcagtggctctgtcattttgatgacgagatgttagaacagttttcagtgtaagaatctgcttagcattacaaagcattcatttctgtggaaagaagtcttcacaaagcccgggaattgactaaaataaccaccccttttttaggggtttggtgtaaagaatagaacatatttgaagcctgggtgattggtgatggggaaagttacatgaactgagttttggcttcatttcccggagtgatgataatgagtttactgggtgctgcagtactacgagatcacagagtgccaagacctcagtgcagtgctgcgtgattgaaatgactgatactctcttttttttttcatgctagttcagcctgttttcatacactccagaggttcagtaagcatcaaacagggaaaaggaaatggcagtccaatagagcggtcgttcaaaatgaccaaagtaattccagaaattcaagaaagtagttgtttctcaagtgtccattaggatcgggctgtcttagagtctgcataactcggaagtgattagaggggttttgtggcttttctgttctctgatgactggagctggtttcagccttcagagtaagtagccagagagtaagataagaaatgctgaggagctgaagtgggcaccaattttattttccattgtgaaggagatgagcatctgtaacccacagcaagatcaaccaccacattaaatttatattgtttgagacagttctgatccacttgagtgtgtgtgttccactaacactctgagatggttgcataggccacaactgttctgtccagttcctgcctgataggtaagctctctgggtaactttattcccatgaattgagatagcagaagacaaacaccacagtggcattggtgtatccaaggcactgattttgtttttcttccatgcgctagtttgagctggccaactaatcatggtattagcctcaaaatgtattgacaacagatttgttttgatagcaaaattgcttttatacttgagaaatctgatcttttataaaaggcccagggtaaatgtcctttagcaacatcatgaacatgtgtgatatcagtgatatggtggggagatgttcctcagcaaaggatgtctgtatttgttcctaggattgacaaagctgtaaagcaaagtgcctggtaggggggagtctaaaggaactagtaggtaaaatgattagagagcttactgtagtacagatggcgatatgcagtctacaaatgacatctccttgccaccactgttactatgggttctaatgaaaagaacctgagacttttgagaatttttgagttcaaaggtatagaagaaggaaagaagctgtgaaaagcaggcataacattgagggacagagaatttggctaggtaggtctagactgtaaatacagtaaacttcccacactacagtggtaaagtaaaattttccccactttacagcatacagccaccttctcgccatattccaaactttttcattgctattatacctggtattatttcacttcactttattgcattgctgtatgtcatatgtgttaggagcctgtttggaagaagagcagcattgtagaattatggagacagccatctcttgcacccgtgtttgagcatcttcatttaaaggggttaccagtcccttgcataaatgtctatttaatcagcttgctttcctaatcttctgcatgagcaattctgtcgcagggcaaaagcgttgattgtaggggaagaagagagggaaaggagaaaaatgtagttttggaaacagaacacttcaaatgagggtaggccaggttctgtagcttcctcagggatttagagtagggttgatatgagagctgtgagtacctaggcatctgtggagaagagggagtggaagagaggtaagtgaggctttgtcaaaaagaaattttgaaatgagtaaagtgtttctggttttgccaaaaaaggagaggaaattctcaataaccttcttataccacaggcttcctccttatcagaccaatagtgatcgtatcagacatgctgcagattaaaaagacatttgtgggtcaacctttaatttttaccattaatcacaggaatgctttgttttattgtgcttcactttattgctcttcacatatattatgtttttggtttttgggtttttgcttcctaacaaatggaaggtttgtggcaacccttcatggagcaagagtatcagtgccatttttccaatcgcatgtgctcacttcatgtctctgtgtcacattttggtaattctcacgac

SEQ ID NO: 112324 - DNA, 2400 bp, Homo sapiens
gtcacaggaacaaacctagttcccagggagcctaggaaatatagtctatacctggggagcggggtcagggggaatcacatgcctgactagagctaggggagttcagtactaaaaagagtagcggggaggatgccggggcactgactaccacattagtcctcgttcctccctgaacagccttagggtgggtgagcagccctaagtgagttgttagctaacagagatgtataatgaaggggcaccacagagcattttatattcctactgtagccctaaatgaataggcagctctttgtacatacgcttgaatatgcttcttggaaccagttcattcactcgacagatacgtgctgagcgccagttctttgcctgggtgctgtgtggtctagtaattgaaggtacctgtaagatggccagggccagccctgctcatcatgaagggcctacttatgtagataattttgaacctcaaataggagggaagttggagttgatttacctgtcattaagttgttaaagaaagatttttcctactggtagcaactgaatggagctctactatggtttgaatgtgtcccccaaagagcatatattggaaacttagtccccagtgtaaccgtgatgggaggtggagcctaatgggaggtgtttaggtcatcagggctccccctcatgaggggattagtgctgattataaaagggcttgaggctgagttcgatctcttgctgcccctcatcttttgcattccactatgggatgatgcaacaagaaggccctttgcaaatgccagctcctcggtattgtgtttcctagccttcgtaactgtgagaaatgagtttatttctttacaaattacccagtctgtggtattctgtcatagtgacacagaatggactaagatgagctcagagggagagaaggctgtctaggcccggggcctttgctgtacagcagctgggctaatgcctctgcgaattatattagcctgtttgtgttaaatgaggagccctcctgcttgaaagaggcaaggcattctgcttatgaagccagagaaatcagtcaggcagcctctgacttacctttgccctccccttctgctcagaatccttcaactcactgtccgtcaggctcagccctgtctcccctggtctctcccagacctgcctttctgggtgtggggtcttcttgcctccctaggtaagggacagataatgccttgaccacccagggaagaggagtttgggacattacccctgaactgagaggtggtgctgatgagagtaattaagcacccagagacattgtccttcaatacattgcaaaggaaagcttgctcagagtagacctgcacctggacacgagaggctggagactgtattcaggacagtgctcgtggggagcttccttcactgctccactcttgtgtcctgtgttacaggggctgctggctgttgccactgtttttcagagaatgggctgcctgtacacacctgacttgggtgatcatgtctacccaggaggaccagcaaaaagggacaagcagtgatgccatctggttttacctccagcattccgagcactgccctggccctctcccccagccagtggtcggggttgggtgcgccccactctggctgcacaatagagtaacgcaggagctttaaaaactcccaacacccagagctcacccccagcaaatccgacctaaatagtcaggcatggggcttggacagcagtatgtgtatatattttaaggtttcttagttgaatttaaatgttacagtggggattgaaaatcttggtctagtggtggtagctgttgggttttttttcttttcattttttttgcatccattcctgttactaccctctagaccactgtgatttcttagtctaatcctgacttgctacctgaaaccctctaaatgtaagtctcgtgcaagagagtgagaggtaaagtttggtttttatgataagagataccttgctcagtaagcagaaataagtgccatgtgttagtaactacagttttgttttgttttgtttcctgtgggagcgacagaaaagagtttacagggtgtggtggggaaaagaagaaacgaacatctctctgagggcgagtataaggttgtggacttagtgggaaaagtcctcaacttcaagtcagagagaactgtcgaggagagagactgatgaagaagacacagtgaggtttttagtggttaaaaacacagcactgcgtttacatagtctatttcccccctaacagtggcaacatgttgtggattttctttttttttctttttcctggagagaagcatgctgcctctgaacagtggagaggaggaaaatcatcagcatcctcattggggtcaggtgacctgggcctcgttcttccg

SEQ ID NO: 112325 - DNA, 1033 bp, Homo sapiens
tatgaagagattgtgcttatcagaaattgtagcattactgtaaattttttctttcatatggagtgatttacttggtatttcagtatattaatttgctaggaaaatgtcaagttagtacttctctcaaaagggcattgtgcatctgaatcacccgtggaattaaaaaaaaaaaaaaaaaggttttgccctcaacccagatgtgttgtgacttaatctccagttctgggcctgggcacccatctaaaatggtgaagaggacagaaatgattcttgacttcttggtgtgtacgtctgtgaggaagccagatgataaacactgcagggggaaaaaaccataattgtaaattgtgataagtgctacggtgaaaaaataaaacacggggtaagagactggcagaaagaatgtagttttgatgggcgggaaggccgctctgaggaagtgagaccgcagctgaaaactcagggatggagaggttagccctgtggggggagggaggaaggagcatttcaggctgaggggacagagtaagggaggcctgatgtggagagggcttggtgggtttgaagagctgagatgattgggacttgtggccagagataggggagcggggggagccccgcggggagcgggagaggatggtgctcctggcagagatggcaggtggcctgctgtttctattctgtgctccttagtgtcttggttatgaaatgacttgccaaaatgtccctttaaaagaaaaggggtccttgccagttacagcagtgtcactgtttaggtctgctaagcaaattctagggtgtctgatggctttgtgttgggagttgtaaatggatttcatttgagaacatgacaagaactgaaagattagtttaagcaaaagaatttaattgaaggatacatcattgttcttgtaaatcctttgatatttggctgttgtcttccagccttttcattccctgcatcctgtctgctgcttgcaggactgggctgtaagccttcattcacctacaacccttttgtattgcttggaac

SEQ ID NO: 112326 - DNA, 3594 bp, Homo sapiens
gggaaactgggcctgcaatctgagaaggccataaccactttggagctgttggcctattttagaaggggtgtcagctactgtgccttgcaggacatgtgctacctttggcatgacggaaatgcatgaatgtgggagccaaggatacatgcatcccctacactgatcagcctgagttctggcttgtgtagagcagtaagcagtgctttgtgggagggcttggctgtcccctttgacattagcctccaaagactaggagcttatcacagactttgctaacatcctctgatacctttttggaataattaaatcattcttggctaggttctgctgtttgtcctgcctctcactagctgggtgtccttgggcgaattacttaatctctctgtgcctagctttctttatgtataaaatgaagaggccagactagatgataccatagatgtgagatgatctctgatgtccaaatctgattaaataatttttaggtatacatgtattttggtatttgctttttttgaatagtgagtcccacaaatattacttctgtgtaagtgacacctacaccctttcttttgttcataaattctttcttaaagatttctgtgagctctaatcccagtattttgggaggccaaggcaggtgattgtttgagctcaggagttcaagactagactgggcaacatggtgaaacccagtctctacaaaaaataaaaagaattagccaggcatggtggtgcacacttgtagtcccagctactcgggaggtcgaggtgggaggatggcttgagcccagtaggtcaaggctgcagagcaagactctgtttccaaaaaaaaaaaaatttacgtggagcttctcaatatctagtattcaagaatttggaaattggagtgtatcgttattttatggagagaaggacccattaattccctctctcgtaaatgatcttgtcccatttgttgttggaacaatactggttgcaactgttgtttgagaggcaaagtatgaaaagcatggtgtcgaattatagaaacatattattacagtggcactagaggctcttcatactaagaggaggagattgaggcccaaaaatgtttcagggtgagtctgaggctgtgcgctatgctccccttgagagtggaggctgtgctttgttcatcttgccatccagcgcctcttgggctggttttgttttattttgttttgttttgtttttaaacagctcttgtcagagtgacactaggtaaagatctctctttaacttccccttgacctgttcgatgctgaaatgccgtcacccatatttctaagcattatttcaaggtagcacaaactccaggagccgtgggtttccttttcagcatggtctgtgtaaacatgggctgtttctcagaggctgggctgaggccccagaagttttcttcataaggggtcacctcttacctctgcccctacaattccttttctatgaggttttaatctccaagagggaagcagaggtatggttctgaggagtgatgtggattctggggaatgcaagggaagcaagggccaagtgggttgagctaacgtggggactgagaaaccatagtgagggaaaaggacaagcagaaggaagggccttgtagaaccacctagtgcttggataagattcttctgcagagccctgggaaattggaaacactctccggggtggtgtgtgcactggcagttgaatcttagcatcttcgttgtttccttttgatttcacttgttctgcttcttctcttgctgtagttgccacgtgccctgacatttcgcagaactttgttgccatccatccagatttggccatttctcctttaattccacctgttgcccctcattgtaagtgtgacacacttatcttctttggtttattctaaggcattaactaaacatgtctgaaattccgacgagtctaagaatcaatatgtgtgtgtgtatacaaaaagtaattctgcctcagcctcctgagtagctgggattacaggcatacattaccacgccctgctaattttggtatttttagtagagacagggtttcgccacgttggccaggctggtcttgaactcctgacctcaagtgatctgcctgccttggcctcccaaagtgctagaattacaggcatgagccaccatgcgcccggccatcaacgtctgtgtttaatgccaggttttttcttttccctaaaagcattgttcggaaatctctgcatttgagaatctagaaataatgatagtcaaacacgggacatttttagtgaagagaagctgagtgattgagaacaaaatgattggaaagaaggggcgatgacaaccttaaaggtgggaacaatttgctaagagagagggaaaagtactgtattgtcattgtccctgaggtttccaggcttgtgtgaattttgaacaggggcagcctgtccagttgtaggaaggttgtggcattaggctctcttggtcccaaggcacaaaaactctgtagcaggggttttcatagcaggttacacgtggcaaggcagatgggaatcttgagaatatctgaggatatgaactgtggctgggccacacaggtatgggctgtcacgtggttcccgatccaaggcagcactggggggttggtgactctttcctccttgaaatttctgctacggtgactgtgatgatcctagctagttggcatcatctctgttgaagtagacacttgaattaaatatgttgccctatgttgttggccaatagggcatagtgtatatatcagggaggatggcagcagctgttggctgcgatggcatttagcttgggcctgacattcatgaagggcctcagatttattacttcatgttgtctccacatgaacttgtacgtttagtcacagagacaaactggcaggattgaaagaagatggcattcgtcatccagatttaaatatgtttctcattaatagacattctgcctgtagtgcactatgaattaatacattttataaatcttgtaactgccttatgaagagcataattagttataagtgtttggatgttagaaatgttaatttgttcaatataggcgttaaaatgttttgtcattttcttatttttaatgttattgggaactttaaaaaacaagagtggctcaagcccctcttgacctcttggaaggccctgctgagctgggtttgcatcggctgttctgggtcatatgttcactttgggtccagttggctgggcctagggtttcacaaggtgtggaaacctttgtcccccatatgtaaaatagcctggctccatttctgtcagaaatgcagcccactctacccgccacagcccaggcaaggggatggagctgggtcagtgggtgtgacaggctgatgacggaattgaagagggggagcctgtgagtctgacttacgggactaaagaataaggccccaggcagaattcttgatttagacataagactccaaagttttaggcagttcatttcagttttctgcatctacacttataaactacagatgaataacaccaaatgacttttgaaaactctgaagactgtaaaactcatttgtgctttg

SEQ ID NO: 112327 - DNA, 1064 bp, Homo sapiens
tgcagttcccttgggggaggtctattttaaattagataggtttgatgtccagtctgaaaagcatttattcaccagttctgataacaggtcaagtagtttaacctcttacacataagactaagggaattaaaacctttcctttccaccaccactaccctcccctcccctaaaaaaggaaaggaattttaaaaaggaaaaatgtagaaagaagtaaaatggtgtttatccttttttgttaaaatgtcacaatttagaccatttacaaatctgtttcttattacaaaatgatgagtctcttttgtctttgctcagtctccttcctcttagtccaccaatattataattttgttaaattctgcttatcacactccttcctgcagacacgttttcttctgtcccaccactcattttcagagctcctaaaagttcagaagcccctcttttctatactttgcactttctctcatggaatctcttccatgcccatgacctgctgagtctcaaagtttaactccagagctgactgacctcatttttaagcctcagactgactgtcctacctgacatgtcctcttgaatgttttaaaagtcatgtcagacccatcggttcaaaactgaactcatgttctctcatgaatgctggtttctatgactttttttctaagcacaactcaatatctcatttgcttgaagccctccagagaaccctcagacattgctgatgggaatgaaaatggcgcaaccactgtggaaagtgttttggtggacccccaaaaaagttaaagaattaccatatgactcatcagttttacccctaggtatacatttccaaaagaattgaaaacaggtgttcaaataaaatgtgtgcatgaggctggatgcagtggtttatgcctgtaatcccagcactttggggatctgaggcgggtggatcacttgaggccaggagttcgagaccagtctgggcaacaggctaatttgtctctatgaaaaatacagaaattagccaggcatagtagtgggcacctgtaatcccagctacttgtgaggctgaggcacgagaa

SEQ ID NO: 112328 - DNA, 1517 bp, Homo sapiens
gttgagaattaatgaataagttaatgtttgtggctctaccccattaactactaattaatgtaagttactgctcttatagttctccaagtactatcgtcatactgattctctgaactagggacagggacattgagaagactttttcttatgtactgtggggaagcagtgttttgtaaaatttttgctcttgcttttacaacagagtatcactccgtatctaaaattttacacctcctctacaaaacaaacaaacaaaaaacacagaaaaacccaacctagattaaatcaagtaacttcttatggagctcttagtaatgaaatgttacttatgttaatacgtatttttttttcctctgggaaaccattactttcattcttgactttatctcctcatcattatgctgcacttagtctgtacttggcaataatgttctaaaagctctcataacagttccatgaaggcatagtgtggtagaggcagtcctagcgttgtggtttgtttttttttttaaaggtttgtatttcaattctgtgtttctaaaggtaagatttggatcttctgcccctgaacttttgtctgtaaaacagggatggtaataacttctatttgggtttttgtaaggctttggaataacatatatgtcaaataccaggcctgaataccagcaaatgtggctgattgtgactaatgcaatgattttattactttttttcaatatgattcaatttggtaatataattagaaccaatttcatagtttcatataaagcaaaagaaggtatttatagggtcctaacatcaatcatatttccacctgacataggcttaccttaaataactaatatccaaacttactctgggaggacacctcttctgtaaatggataaaattgaacttttcaaagtacgtgaatacagaggaaacatggaattgtatatatgtatgtgtgcatgtgttgttttcaaataaagtaactcactgtaatgaattacagtgaattttaaatttcccaattttgtattaatgttgaaagccaccaaaggagtaagggatgggttgtatctcaaaaaggccaccggcctgagctaaaactgtttcctatactcttctaaaggcaatgtttatttaatcccaagagtcctttgttctcatgattacaaagttaaaatttaattatttgcattgtagacttgaaaggattagctacactcgtgattgatatgtaaagagagttttataatctctggaactatggcttttgaggaacaaaataatttaagctataattttgaagtgggacagaggatattattacaggtttattcataggattctcatcttttgattggactctaattaaataccttcttgtcagcagggagggtgtgtggaggaattatgattctcctgctttaatcgttgttgatttcttagtgatactttgaagtggcatccaactgtcttctccagctttcagaccctttgatgaaacaatagaaacttgttaagtacatgac

SEQ ID NO: 112329 - DNA, 1475 bp, Homo sapiens
aagatattctggttatgtgtaatacacagtacaactcaaagactgtgaaatagttcatagacaaattatccattctttgccactttagagtaattatgcttattgtttctgtttcaggataatatgtgtgtgtttataagcattttttcctttttatttaattgcagtaacatatacataaataactatgatggctagttttgaactcatttaaaaacaagtaaatttatgctttgataagctaaggtacattcaaagcattcccatttccaaagcaaagtgttttcagttaaagattatagatgttgccttttgccagggatgcttgtgagaatgtcatttagagaaatcttaaagtaatttatccataatattaacttagcatgccttctctctgcaatgtacaatgtatcataggacaatgtatgatacagctcagttttgatatatcagcaagttgagtagtaatttttgtttgtttgttttagttgttttaaaagctggtgttgcagattcctatgcttagaaggaccaggcagaaaataagccattaagggtgctgggaatgcaatagggagtgatggggagtgtggtaaaggggtcagcaatgcttctgccatgcctatcagggagctggtttccattagctgttggttgacccaggaatctgtacctgtgttgccagatctaaccattttccaggagaggctggaacttcatatttaaaaaatgagaatttgtcaactttaataatttggaagaaaattcaaattaaaccaataccaggcagtgtggtgtaccccacattacagaggaaagtaggggacttgggaggtacatgagtcaatctatagatgctcctgttgtcatgttaaacttgtgcttgctttcagttgctgttaacattttgggtccactgtatctagacatgtccttcaaaagttgcatgtaagttaatttttttttctgtatttaaaaaatggccccacaaacactagtctagatgttgaaaaaaacccttataccttattatggagacttctgatgagtccttttgtacagtgaacaatcacttgctgtatttacgtttgtacttttgtgtttaaaatggggaatggtgttagatattgcatactgcttgagttaaggaggtcgttaaccaggaatgctttggattactcagattattattgcactggtgtttgttgtaatggaatttgacctgtcaggggagctgtagatgtttggatgagtgttcagtccttaatactgttatctaaattctaggcatgttgcctgtaacttccagtttcaaaaaatctatgtcaatctgttcttttataacctagtgctgttgtttttttccctcttgttttatatttaatcattctctttggctcacaacagcagtccagtccaaagatttactttttctattttcaaccccatcattatttttgtgtaaaaagtatgtt

SEQ ID NO: 112330 - DNA, 2946 bp, Homo sapiens
tactctcattttgaatgacagcatatatgatgatcccttctaaagcccagtgatatgtagtcattcaggtaaaaggttttattgtcaggctcccagagtgggagagcctggttccagggtcggggggtcagaggggagctgttgctgaattttgattctggctgaagataatttatcttcttgaaactctggcagcatatacagatgtgcctgttgttaacattttaagaggtaagaacactctctgtgcacctgggattttggaatatgatagtgggaggcaccaagactgttacagaaatggaaaatgaacacagggtggcagagggtaggtacttctgccagtcagaggcagacagactttcaactggaaggggtcaaggacactattgcattgtgtttggccaaacaaacaaaatgcattctaggggagagctggttttagtcgtgtgtttagcgggggctcagtgagaggcacacagatgatctgtgcatccatttctctactgatgtaaagactcaaagaaggtagtgtgcacggtgccaggggaatcttgttgaattactaacagtgaaaaactaaaaagtggcctaagatcttggtttctaaggcctattatggccgagtccccagagacaaagtttcctcctgtctgacttggagcagatgctcgtctgcctcaggaaaggctctgaagaatccaggagaacatgctttgcaaggcactttcaaattgctgggtcccttcaggggaaaaggggtttttatgacaccactagtctgaagataatttttatcagatcctatagcctgaggtcttaaaacagaacaacactaaagagcccctctcaggcctggcttcctagcagcagttggatgggaccttgaagtggtggctcccttcatgttggccctgcagggtcaggcatctaagactcgtggaggcccaggcagtctggagggataccagatgacatagcaaatgccaaaaaaaaaagatcgagtgctatgtttgcctgtgtgtgggtgtgtttgtttcacaggtacaggtgcacccacccggagtcagggatggaacatgtgcagtgaaggctatatgcttcccagatattggggtgaacttgatgagagtctggtggtggactcagggacctggaattgtcttcctcactttcttgccacttctcagtgtgaatgttgtctgtagggggtgctctccttgcttgccgtgggtctcagagctaccagagcattagaatgtaggagatgcgcaggccttgtggacgttttgccagtcgagcgattcagcaaagtaattgcaaggtttctctaattgttaaatatctacaacaggctgaatttggattggctgaaaagaaaggtgaaatgaggtcatcagaattacatgatttttttcaagttctggcatcttgtgttctttgccaagcagaaatattccagtagaactgtgataatgcctttcatctatctgctgagccttccagatggcagtttctcagccagtgagcaaaagaaagggtgttgagatttatgagtaagttgattcccttcgtttgtacttcccagtgaactctcattcgctatttgtgctaagcaccagtggcaagttatcctcacatctttagctctgcagggcccttaagccagtaggccttacttcaaggggaggagggcttcaaattcagagtaataaatagctgtctaaatagagcccttcacatactttctcagagaactttttgtgatctaagtggacttaagtttcttgaggacaggggcactcctttctcctgggtagcaccaatgcacaggaagcttggcgttggattccgtgggcccctccctttctagttatgtgcacagtctcccgggttgagagaatccctccctttgctaagtcatcttcattcaatccagggatgtttagggaatatgcgtgcctcggatgacaatacaagatggattaaggtgattcttgtgctttgagagctctcagtccaatggaggaaaaacatataaataaatacacacataaacgagaagtggtgtataagtctaaagatcaggtaatgagggaatgttttagaggaggtggtgctgctgtatgtattggaggcgggtagggatttgctgagcagaacatgtgccatgttgttttctccatcaggcctcatggctggaacagctgcagtgcttttcgtttggtgcctcctctgctttgcctttgtcctgttcttgttcactttgagcacccttgcagcctaccctgggcataaccctccaggaactctgatgctgtttagtagatactcagaggttaccacttaatccttgttggttagttttgttccccaactcgagcgtgaattcaggacagggcccatctctgaccacaccaaatgcagtcagtgcatatgttaagatttagggaaagcgtttgggttggttagtcgagtattttcatagattattattacctggttatgtaagtatgacaagacagtttaacaatgacacaaatataagcagaggatctgattaaaaatacttttttttgaaagggaagcataagtttgtggtcagcagcaaataacccatttgatcttcattcatttattcttccatttattcactcactaacagtctgtacctttgtgaatagcaacagtctttttcttcattggtgttttttgaatgctgggtttttactgccctggggattttctttaaacctgatagttgttttgataaatcatctggataccagctttgagctaattcttttctattaagtacctcttagagtggctgaccataaaccatttgagaaatcactacattttattaatgacttttgagatttagcagcaacttaaattaataatactggagtgtgctttggataaaagaccaggagactgctt

SEQ ID NO: 112331 - DNA, 1037 bp, Homo sapiens
ttacaggcgtcagccatcgtgcccggccgtgattgatcacttttaagtacatgagaattcttggcatgacatacaaaagaggatgggcagagttccttttcctgtctgtgatatatttcatgacgatccagtctttgcgggcagtggttcagggtagtgcagccattgtaacctaaaccattcctgtgtgtttatttatcagattttctcaaagggtgagtgctgatcattttaaattctgtttaaaaataaaattgttcatcgaagtgatgaaataaataggggtcagatatgattttagagatttcgaatcctgaagagggtttgagatttgaataccatctctgtacactcaaggcaaacttcctgtatcactcaggactcataacttcatctgcaattttattattgggtgacataactgaacaggtcgctgcaaacactgagaattattgagttgtttaggtgagtctctcttgtttaaactgttgaaaggttcattgatttgtgggtgagggaaaactgttgtagcgtagttttagtgtttgcatttcattttaacattaccttgcaagggatttttcatgctgtactaaggagattacaaggccaccctaaggcattttagggttatataaggaactggctttgctgttttatgtactggcccttttattttctggctaagccagaatcttggtaaccctctcacctatcacctttgggtattaccttttcagctctccctttgccctcatgagtccaaccagtgccctggtctgagcctccatcctcccaactgccctggcttcctgctgtctgccttccgtgttcctgcctacggttcatgctttgccctggacctcagtggtccttcatgtctgtctgatcacgacacctcatgctatgagtgacctccacagcttctgctgcttttggtgcagcatcaaatcctcccggtctgtgctttctccttcagggcccacctgcagccttattcccttctcctcttccttctcttccactccagtcctcct

SEQ ID NO: 112332 - DNA, 1120 bp, Homo sapiens
gcgagtagggtaaaatcaaacaagaccagatacaggtggagcttccagatgagctgaacatgtggaggttcctgtagggtggtgctctagaaagggcatggaagcgccatgtcccttgccccatacctttacctgtgaatctcttcatctgtatccattgtaattttttaaaataataaactagtaaatgtaaaataaccaaaacaaagaaaccaaatgccggtgtattacatataagttgatacctagccagttaaatgcgttcagatgtgtcttgtttaggaggtaatcacccgggcctcccccacaaagtatggttcaaagggtcatggtgggtggctcctcagagcatctcagctcccttagacctgatgaaggcttcacaggcatttcatatctgtgcctctggccagtatatctccagggaactgagtgccaagggagaccaaggcatctttactgacattgttgtaccttaagtgaggcaacatgtaaaactgtgacacatgggagtgcttgatttttgagcgtgcggagcaacagggtccagtgttatggtggcaggggcaggagaactcatggcatcaggagcgtagacagccccactgggcacgaattataacccaggcagaggcaaggcgcaagggtggtcagacatctggccctgaaataagaagagacaggtgggaaagtccaggccaagaccgtggagcagagttaagaaggagcaggaagagccgatctcagaaacaggctggctctgttgaaattggactgaggcagataatttctttctttctttttcttttcacctttcagcactgttggacatgaaggaaagataatttctaagtttactttttgatatttatagataaaatgctttcaagcagttaaccagcctattggagagtgacacttagatcatcttgaagttggtttgggcgatttagagaaacatttataattaagttatgcagttaatgaaagccaagtggggacatttgttcagaacaattgtttttgtaccttttctttgtgatagagctgtaaaagtgtatttacttgtaaactgcaacaagtttttgctccttcccccatcaaaagaataatatatcta

SEQ ID NO: 112333 - DNA, 1051 bp, Homo sapiens
tggccagtccttcctttctggataacaacgccaacatttcttatgtcttacctcagggatcattttcaggccacagacctacctgttttgttttgtttttttaaaatggtagtatctacagaacattacagtttccgtaaaatcatgtatataaatatgcctagaaaactacctgaaatatagcagctatcccataattactaattgaaatacgttagttgaatctgaaataaatttcttagcctaggaacaaagttagcatccatctgggtctctgcaaaaatttgtaatgtgtaaaaataggcatgtttaggaagttgcttaatttattaatatatacttcatttttatggcagttacagattctctaattgaatttatatttgcatgattacagttttttttttgttgcaaacgatttttatgggctgctgaagtttaaggagtctggcattttaaattgttcttcactgtctgagaagtaaaaatatgtcttaaaaaatcattgatgttatagtaaaggaaagctccctcccttccctaagttagtgcctttcagaatgtgagcatttgtcaagtggaattctgtctgatcctttttcattttctgagctattataagtgctttcttttcctttaactgtcataaatggtttttcttcccttaactaagtaaagatttctggaacaatgttttgaccagattgaaaccagcttctgtcctatctactagtcattcatttcttgatttctcgtgcatttctaaacatagataagtttctaatggtgaagaaagtgaaacagaaaggaaggaaagaagcaaaagctgggttgggtcaccatattgagcgaaggatatgcttgtggggaatcctacactgtgatattggagtaaacagttacattatggggtgagaccaggtgagatggcttatgcctgtgatcccagcactttgagaagctgaggtgggaggattgctttaggccaggagttcaagaccaggctgggcaacaaaaatgagaccctgtctgtacaaaaaaaaaaaaaaaa

SEQ ID NO: 112334 - DNA, 1475 bp, Homo sapiens
aaaaaagggtgcttttttattccaaaaatacgggaacatcaatattgcttttttaaaggaaatttactacaataatattttctttcggttcaactgtattaaaagtggaaactcttcgtcaggtgctccgagaacagtgaacaaacacttcaaatgaaaaaaatattttagagtttcagttgtatttccctatgaggccttgaatttagcaaaccttagttaattaactttttaaaggaaaaatgtgctcttacattagtggcttttaagcatttcttccgactttaccggcctttcccccttaggacaacatttaaaataagtgttttcaacaaacagagcaaataccttgtgaataaacatcaatttcacacaaccagaaaaaaaaaataaatcaataaatctcctttaggcatttgaaaaactctatactttttaaaaagggaggagttgtaattcagtaacaggaaaactaaaccccaagaaaccaggctgttagttttagatgtttttcagcatgaccttatggaggcagaagacgggctgggaacttcctgagcacctgtttcgttattggtgccctacttatccaaggatgggcaacaactgcccacagggcaactcctgtgagaaagcctactctgtttttgtttttaatctcataactggaatcctagggaaaatagtgttttctttggtaccaagttcttttggcttcatctattgggttttgaaagaataaactgaatgaagagctgtctagatgatacaactatatgtggcattttcatattttttcctgaccctgcaagattaataatccctaatattctcactatatgctttgagagttttgctgtccagtgaagatttgaaacaattgcacaaaaatttgaaaacggtgttttacttgtcatgtttaaagatacagagtcactattttagaagtgaagggataggggtctcaaaacaaattgaaatatattttgtgaaatatatacatatgtattccacttaaatataaaatatatagtaccaatatatatccttgatgcttattaaatactgatctatatccttggactttttaaaaaaagtacagtcatgtatcgcttaacaacaggggtatgttctgagaaatgagtcatgggatttcatcattgtgcaaacattgtagagtgtacaacacaaacatagacggtgtgtagcctactacacacctaggctgtatggcataacctgttgctcctggaccacaaacttgtatagcatgttatggtaatgaatactgtaggcatttataacacgatggtatttgtgtatctaaacatacacaaggtacagtaaaaatataaaagataaaaaagtggtacaccaatgtagggcacttaccacgaatggagcttgcaggactggaagttgctctgggtgagtcagtgagtgagtggtgagtgaaagggaaggcctaggacatt

SEQ ID NO: 112335 - DNA, 1082 bp, Homo sapiens
ctagcttaccagaaacacccctaaaactgctggtttagattcattaatcaacctcatggtcctcagatgggttgtgactccctgttgcgtaaacacgaaccatgttacttcctggtcctcctgacctccactagctgatttcagcgaggatcaggagttaggtcgccagctgatctaaagcagcgagtcccaaagttcagccatttgtaaaccacctgcatggttttggaccaactcttgtgtcaccccatagtttctcagattttaatatgcatacaagtggcatgggatatgttgttcaaatgcggattctggttcagtaggagtgagaggggacaaagatccagtacctttaacaaatgcccaggtgatgctgatggctctggcccactgatctcactttgaatctcaaagatatagtccatctgaaacaatcttttcttttaaattgactctgattttaatcttaaatacatatatttaaaaaggaatgtaaaaagtatcactattcaaatgcatataatgacaataatatgacttactaacttctaggtagctattattggtgcctgttggtaagcctgagtcagaggcctcttttcttttgttataatggaggttaacaagtgtagcaagtgttcgacattctggcatcaaatggagactttctccttaactagaccagaggatgaaaagatagttgaaaaccagtgactttatattgaaggatatttaatgccacgttctaaaacttctcttctggtaccccaagtcaccagggaatcgcactttggggaacacttgtgcttaagtaatttgcagcaaggcatgcatttataaactgaaatctattagtgaggtggatggatccctagaggtaaaatgcttggggaatgtgtttaaatgtttgcatactccatgttctgttttctgttgagagtgtgggagagaagaggggcatcccccatttctgaaaagttgctaaccctaggcccagtgagtagttacatcttaggtatgagaaggaaaatgctttgggaaattgtatctcaggccagcaggaagtcaactttaaatgctta

SEQ ID NO: 112336 - DNA, 1103 bp, Homo sapiens
ctttaactggagactccataggtcactgaccttttagaagaattcttcgtctggttcagagtgagagagtattgaaagattcatcctaacttgggcattctggtacccttgtggtgggagggcagaaagtctgctgttaaggagtttagactttgagtgtgtctggatttttacccagctatgttcccaagcttgtgaccttagacgttacttgcccaccttgcagttaagtctccccttcatctgcaaaatggcacgtttagtagtattaatattattaatagtagtattaagataacgtctatctcggaatcctgaggatttgaggagttaatatgtgtaaactgcttggaatagtcaataggtattagcaattattatactgttttcctcataatttattttgattgttttcccttctttcagaatcattaaaataatcttacattgtaacatatattttttgttctctgtaatattctgcctacataagtgcattctcaaaataacttaaaaggaaaaaaagatctaacaaatgttcacagtgttcttttcattgtaatgagtggcacgcagttcttatcgtggataccagaccatgaattcgcttctattgtttgttgttaattttcccttttttctttacccagttacattcactattttctttgcaaaatcaaagtgtctcctattagtattttgtactgggaagttgagtttctgatggatagctgtggtggtgttaggcctaacacctgggtggggtggggaggatagataccctttgtcaacatctgttaaatctgggcattctggaactatctagatggctgtaactaagtgtctttagttctttatggtatcataaatcctgcatattttggtcatttttttcctctatttcagacaaattcttgaggtcatgaaggtgaaacttgagtcagtgatcctgataacttgggttttccccttatatgtccttccagctgatgcagagctaggattttggattgaactacctggatcattgactaatcatcttggtgaatgagagactcactggcttctcctctagggcataatgggatgcgatgagagcttgt

SEQ ID NO: 112337 - DNA, 2117 bp, Homo sapiens
aaaaccatgagtttacagtcataccttaaattcctgtctgataccacagggtttagtttttcctctccatattttataactgctttatttgacagtgagattcttggttcgcattattcttaacagtttacttatttggtaaatctccccatatgtaaccaatcttctgcagctgccaccacctttcctcctggggctgccctcctcagctgttagtgctctagcatcctgtgccaccacccccatccccatatggatacctttctccctgagataccctgctctgggcttccacagcatccctcttcctacgtttttgtaaacgtaggaagcctaccagattggacctacctaatggctttgaattttcaggaaggagaaggcgaagagcctcggctactcttgaatgatgtaaaataagacttatcttccttccccatggtccttcattatttaaaaatagccattatgtcattcctaaacattctgttttccacctttaaaagctcctagttcctccatgtgtttacactaatgatgtttttcttgtaagcatctcaaagagtcttccaaacatattatatctttgtgacagatgaagaaattggagtacagagatgtggagtaacttttgagatgttgaagagcatgtcagggttcggttttagagtgttaggtctacatatactgtttccagattgttctttgccctggtcacggtgctctgcctagggtcccatttggacacacctctattaatgcagcaaccagaatgaaacacgttgttcacaggcttttctaaccatccgaagagcagcaggctcttgaactctcccttcagtccctaggctgtgctgtgcctggtggcagaagcctctgctactgtctggaattgactttgagtaagttactttcacagattagttcctcagttgctcatctaaaaaaaccaggaaaataattttctgcaaagttgttatccagtattatgtgagatcatgcatatcaacgtgcttcataaatggtaaatctctaaatacaaatactagttattaacccaggctaaactgcacttgctttccctggcagccaacgaacactttggcttggattgactttttagtgaaataaaaccttcactttttcaagtgaactctattaaaccatccccctaagctatatgctaatcagaagccctaaccctccagttaattatttgaatttagatttagttctgtttatttctcccatttaaatgtcttattctggcccattggatttcaaacctgctaccagcaatcctaggcctccttgaggcgtatgtgggtgggtgggtctgtgctggtggggtgtggactgagcagtacctctctttcctccagaaaagcttggttattagtttgatattttgggatactaagaaagattttgcttgaaaaaaggggtcccaccacttaagaaagaaaagaaccagtattctagcctttagatgtctttgaatcttgatggccaaagtacatttttaaaaaaattactcctcgtgtgggtttttatctcttggaatctctccatgcatgggaagtccctctcactaactaggggtcacttctgtaggattagttgatatttcacccctttatgcatgtagtgtggcagcctgattagtaaggaaatttcagtcttcccactgggagatctggttcagtaggtccatccaggatggggtcctggaatttctgttaagaaaaaaatcaaaacttcctgcaggtcattgtgatgcccagctgagtttgagaagctttagcttgtttttcttgggaagatgtggcctctccttcccgttgctccctggaggggatgtgtgggagagctgggcgtgggtggtgtagagcggtgaccatttcaccagcacatgaagctagtgttctttgcttacgagaaaaaaaaggtggcctattttatccctcatggaattttttattaatccaaaaacgccagtttatttttaaacctgaaagccctaaaaacaaaatgagaaaaatctcttgaaagagaacctctggtgctgcaactagtttgctagcagttagcatcatatagggctagaagctagccat

SEQ ID NO: 112338 - DNA, 1021 bp, Homo sapiens
taaattatagacattttctgttagggagacttgtctgaagactagttttattactttcatttcttcctcaaagatcctttcataaaaaacaaacaaacaaaaaacaaaaaacaaaaacaaaaaaaaaccaaggctgggcgcggtggctcacgcctgcgatcccagcactttgggaggctgaggtggacggatcacaagttcaggaaatcaagaccatcctggccaacatggtgaaactctgtccctactgaaatacaaaaaactagccaggtgtgttggcgggtgcctgtagtcccagctactcgggaggctgaggcaggggaatcacttgaacccgggaggtggagattgcagtgaggcaagatcacaccactgtactccagcctggcaacagagcaagactccgtctcaaaaaaaacaaaacaaagcaaaacaaaaaacctttcactaatttcttcttggcttgttcagttcctggtatagtgtccgtgcttctctctccccactgtgaatctcaaatgtagtcctgtgagtcattaaatatatttttattattagaattacagcttcatgtataaaatctgaatccttttatataacagttgtaatgacattctgagtaacaaagtcaacatcttgtacagattcctttctcattagttatcacaggctggtgggggaaaacttgtttcctctgttatatattggaacaattcaagacagaagggaattgattttattgagggtgtcaccgtactgggacatttctcagaaaaccctgagactgctttgggtttgggggagggagaagaaagaggattttgttttaaagtcatttctttggggtaccgaacaccacatcccatcactcatcattaatagatgttttgcccttttggattctggcttttaactgttttggattctggatacttaactgttcccaggcaagtaaattgatctcaatattctggttatttattgctacataacctccaagcttagttgtttaaaacacagt

SEQ ID NO: 112339 - DNA, 1022 bp, Homo sapiens
tgtttgtttgtttgttttgattcttttccttgatctggcaaacgtgttcagcagccagacaaagagttctccaggacaaggggaaaacgttggttcaaagaccatgttatttttcttccccttctcatcccatctcatcctcttcctcagtgggcacccgcatttccatagaaagtaaagatggtggctgtctgggtagggggttctctaagttgctgttcagtgtgaggtaaacaatgctccaactgcaggatcaataattatccacagcagtctgaacacggaatgtatttatttgaattctcctttaatttgggctgtttgctgtacgtatatacatctgtgagaatagttgtcaatacggctcttcatattctttttttgtaccgcactcttaccaggttattttattttctgttttctattataataccttgcattggtcatgtatgttttgtgaggggaaatgcaagggattggagaccactttccgtgtcagcatgtcatctgtcttcaggactaataaagataatgaggggacacatgaatggatgtcatatccgatcattccacaggcagttttttgccagtgttgtgcatgattcccgggagcagtcacccacctccctgcaattaaacactgctacaagtacaggaagaaggaattattttctttctttgccccttctccatttgtgaaaatgtttaaaagtggtgggtagccacggttttgagtaagatattctgatttgattggaacttgaaactttgtgacttggagaggcacggactaccgaactgggactggttctttttggggtagtgagttcaggcctcttgtttctacttgaacatttctaaaagttgcacattttagctacccagcaacaaaaagcacccagggactttctctgccgtttcctagcagggggtggtaaggaaataaaaggatttgggtctgtttccctgacagtttgctgtaattctgtggagtgcatagagacaaatttagccctttctat

SEQ ID NO: 112340 - DNA, 1115 bp, Homo sapiens
tccagtctggcctgtcatttgcccacccctgggctgcaatgcctgtaaactgagccattctcataaacatcccagagaaaagtagtagttagcacactggtaaaggcctctctctgcttaaccccagcagcaagtctgcctggactgagctgagaagatggtgggaagactgcacaggatgccttcttcctccatgaccatgaaggtggctctctacttgcagatgtgaatcaacttaatctaaattggtcaaatcaattaggaatctctgattctaccggtagggagcagattttacacatcagcagtggaaaatgctctcaattaacttgtgaacagaaactggatataacatgaaactaaggttttaatctgagctactgtgaaatttaaacaaagtaagaacagattccatgaaattgactctgtctttgtgtacttctgggcagtttcatgatgctagtctggatcattagctcactttattccctgtggggtcttctcaccctccactggataacttttccgaaagctctgcctggtattataattcaaaagctttgagaaacatgaaatttgtgatctgagatttttctagttatgtaatgataaccctctcatttccattgataaccctctcatttccattaaaaaatgttccaaaaaaacttgaggaataaattttgtgacatgagatcacataaagactggattgttcaaagaattaagtgttcatatctcatgtctaaaattcctctactagaaataatcctctagatagcgtcacaatcaaaagcttgagtctcaaagtaaacggaaccgggttttaacctcagctctaactgtgggatctcagatgagacatttaacttctttatgtgctcggtttcctcatccgtaaaatagtgacaataattgtacttatagagttattatgaggatttaaatgagataatgtatataacatgtttagtaactcctggcaaatagttattcaagattgttactattgtcatgttcatcaagttcttattccctctcgtgtgctagacactgcactcaccatcaggattgcagctaagggtagacatggttcttctcaggaagccaagctg

SEQ ID NO: 112341 - DNA, 2382 bp, Homo sapiens
atgcagtcagctcagggactgtccttactttgttcactgttgatttagtaataattatagtatcataataaataacaatataataatatagtaatgctcctgtaatttagtaataacatacctgactcgctctcaaatattttaaaagtaattaaccaagaatatcgcaaaaatgaagagtaaattgtgctgaaaggaaaagggtgtataattaatttcctattttattctcaagtctatgttttttaatataaagactaataaccctaaatttttaaatgtatttcttgtgagtaaaagttaatgactacttttttcttcttctttttttttttcttctaggagggtatacaaggaaaggttaggacttcctccaaagatagtgattggttatcagtcccacgcagacacagctactaagagcggctccaccactaaaaataggtttgttgtttaagaagacaccttctgagtattctcataggagactgcgtcaagcaatcgagatttgggagctgaaccaaagcctcttcaaaaagcagagtggactgcatttaaatttgatttccatcttaatgttactcagatataagagaagtctcattcgcctttgtcttgtacttctgtgttcatttttttttttttttttggctagagtttccactatcccaatcaaagaattacagtacacatccccagaatccataaatgtgttcctggcccactctgtaatagttcagtagaattaccattaattacatacagattttacctatccacaatagtcagaaaacaacttggcatttctatactttacaggaaaaaaaattctgttgttccattttatgcagaagcatattttgctggtttgaaagattatgatgcatacagttttctagcaattttctttgtttctttttacagcattgtctttgctgtactcttgctgatggctgctagattttaatttatttgtttccctacttgataatattagtgattctgatttcagtttttcatttgttttgcttttgtttttttcctcatgtaacattggtgaaggatccaggaatatgacacaaaggtggaataaacattaattttgtgcattctttggtaattttttttgttttttgtaactacaaagctttgctacaaatttatgcatttcattcaaatcagtgatctatgtttgtgtgatttcctaaacataattgtggattataaaaaatgtaacatcataattacattcctaactagaattagtatgtctgtttttgtatctttatgctgtattttaacactttgtattacttaggttattttgctttggttaaaaatggctcaagtagaaaagcagtcccattcatattaagacagtgtacaaaactgtaaataaaatgtgtacagtgaattgtcttttagacaactagatttgtccttttatttctccatctttatagaaggaatttgtacttcttattgcaaggcagtctctatattatgtcttcttttgtggtgtcttccatgtgaacagcataagtttggagcactagtttgattattatgtttattacaatttttaataaattgaataggtagtatcatatatatggaattaaattgatgtggctatctttgtttttttataaagtaaggcacagtcattcagtcttaggtaaataatgtactctcttaatatgttaatactcatgagaattgggatctgatgcatcaccatttgattggtagcaacagtggttgtaaaacttggttgctgaattgagttgtttctatgttaagtgtcaaaatgatagtgtagggaaagtacaggtggtggggacatatgcattaagaatcttgttagtgttgcaatctaaatagaatggaataaacaggtgttaagacatatttatagtggtaaattgttgtagtatggtattctgtaaacttgaaaacttgatctactctttgtaggtatcatttgaaagcaaacttgaaaatgttttgtacatagtacatacttgtatagtcctgtgagatgaagtatggctatcagaccaaaggataagccaaactgtaggtagcagaatggaaattattattttgagaggaaaatttgtctttgaatggtgattatgacttaatcattttaaaactgataaacttgacaaaaaccctgtatgaaataaacatgaaattaatagcactgatttcattgtaaaattttaaagcagtttaaagggtaccacaggttatcacagtactctcaatgccacaaacacctcttgttcagtattctagaaatactgaatcagaattctgtgtttattataatctcagcatactgtacataatatctgctagttaaacttgggtaat

SEQ ID NO: 112342 - DNA, 1052 bp, Homo sapiens
gcactccagccagggtgacagagcaagaccctgtctcaaacaacaacaacaacaaaaaaccagaccattaacaaatattcataaaaaataagaacaagaggagattaaccatgaatagctatttttattattctattaatatttgtttgctcataaatataagcagcagcagagcaaatgaatattaataaaatcagcttttatgtctgccatgacattaactgccaaatttgctgaaaaaggctgatttgatagtaaataaatgaatgagtatttaaaagtcaggacagatcaatatatgcaaataaaatttacacatttaaaaaattaactcttgatttaaaaactgcctttagtttctatgcaaatacagaagagacatttgcagtgtaatgagcttgtttataatctattaaatgtaatttgggatttttttttaagcttctgtgccttattggagaatcttttgatgactacagtgatgatgtatgtggcgctgttgttaatgttagagctaaaggtgataagatagcaatatggactactgaatgtgaaaacagagaagctgttacacatatagggtaagttttgctctttgcctacttattttacagtattaagatgagtaaaaccagaagttattttatttgtagctttagaaatacttcagtttgtagatcctgttttccttgtattgttttcgtgaacacttttataattttgaacggctcaattggtgcgcaacgtcttgtttttttgggttttttcacagctatttatttatttatttatttagagatagagtctcactctgttgtccaggctatatatagtacagtggcatgatctaggctcactgcaacctccgcctcccgggttcaggagattgttatgtctcagcctcccgagtagctgggaatacaggcgcatgccaccatgcttgggtaatttttatatttttagtagagaccaggttttgccacgttggccaggctggtcttttaacttttggtctcaagtgatccgtccacctcagcctcccaaagtgctat

SEQ ID NO: 112343 - DNA, 1776 bp, Homo sapiens
tgattttgatgagagctttgattatccagtctactccttcctttatatatttgagcagactgagtttatcaagcattcttaaccttaggagcatgggtccttggaatacttattattgggctttgtcagttggtagagggacgggacattcattaactgaaattgcatagtttttgcatgtattttctagctgtagaaatgtacagagcttctaaaatatgtttgcttctcagaaagtttaagaaccttcaaattaagtgaaacccaagatttgatagctaataagtgacaaagccaggactctaattctgcaatgtcatgcctctggctttaagtcttatgtgctgtttaaaaactacatcaatggcagttttatgggcaataaagtaagaagttgacagtgttgttgcttaactgtttctaatgattatctctcaaagtcaaggtaacaatgttgtgtaatactgttgtcttctaaccctgtaggatggtattgagcctatgtgggaagatgagaaaaacaaacggggaggacgatggctaattacattgaacaaacagcagagacgaagtgacctcgatcgcttttggctagagacagtaaggttttaaaagtataaagcagttttagaggtagttttggaatactgatacttaagatatgttatgttttacatttgttacttaatttaagagaaggatgcccaacactagaaaatcagggtcagtaattatttttgttctgtcatatgactcctgtttatagtacagtgaaacatcctaccacattataagtcagatattttaagtgattggcagttgactctcaccacagtaagctcactgtggtcatttcattaacctcaaaattatagaaccttacattttgtatgattgaagtttttgcaaccctcttacagcattgctatatgtatactaaacttttaaatacttatatttttagagcgagggtcttgctctgttgcccaggctggagtgcggatatttatttatatggctcatttcagcctcaccctctgggttcaagtgatcctcccacttcagcctcttaagtagctgggactacaggtgcatgccaccatgcccagctaattttctaatttttttccagagatgggatcttgctatgttgcccaggttggtctcaaacttctggcctcaagtgatcctcccacttcagcctcccaaagtgctggaattacaggtgtgagtcactgtgcctgtcccactaaactttttagattagtgaagcaaataataaaattgttgtgtactaccatttgacctacatgttgtgatattaactggaacttctggctttacaagacaaattaaatatgagataataagcattttctgtagacagaggttccaaaccccaagcttataggagcggggtttgtagtctcttttgtatccctagcacttgaaaccgtgcctggtttatagttagcacttgttaagttaatcactttaaatgtttgaataagtgactattttgcttttttttagagacagggtcttgttctgtcgcccaggctagagtgcagtggggccatcatagctcactgtagcctcctgggttcaagcaatcatcctgccttagcctctcaagtagctgggactacaggtgcatgccagcacagccagctaatgaatgaatgactttttaagaagaaaattctgtttttgagggggaagatcatgagcaaataccatttttgaattccacattaaaaagtcaggacatttcca

SEQ ID NO: 112344 - DNA, 1037 bp, Homo sapiens
tgttggtcaggctggtctcgaactcctgacctcatgatccacctgcctcggcctcccaaagtgctgggattacaggcgtgagccactgcacccggcccttaaatctttacctgaaatattcctagatggggttaacatagcaccaggagaaccagactaaggatagtagaatcatccatggtctgtagacacagctaagatcattatttctgccatctaatattggagacaagcaaaagattcttaagagttgccaatttttaaatcaattttgctgtaaaagactacaggagatcaaatgatctaagcctcctaccttcaggcaagcaactaagtcatcgcaaatgttattctgttattttgatacttgggaaatagtttagaaatacagactgcagggttccatcttatatttaggtgattataatcccaagatgtagggcttgtaactatatttatttatttatttttctaaaatcagttttaaaatgattattatgttgactaaccagtgacagtttgtggtgtttgggaaccgttgatctattctactcttggataccttcaaggataatgactgtttcagtcatgcaatcctgatggtcaggaagttcatcgtttctggtttttgtttttgtttttgtttttgtttttttatgtttgtgaaaaaaactgtgtattaacttcagaaattatttcatctacttaaagccaccttatacctctcttctcagtttcttatatatatacatatgtatgcactgagttaactaacataaaatatatttttgtcagagcagtcactagaagtttttttgaaaattatacctgtcatctgaagttgattatttaactgcttttaagatctgttttgtccattttagaaattgactccttagaaacaagtaaacatgaacttttatctgtttattttcatcatatgttctaaatgtatatatatgtaagcacctaaactctatattacatattctgtgtttttaattgttattttcttttacctagtctgtacaaccata

SEQ ID NO: 112345 - DNA, 1101 bp, Homo sapiens
aaatattctaacttgtacatctttttttaggatcatatacatgctgaattagtgatgctactcttatgttttaatgtaaccccctcaagatattctgctcatacaaagaaatagattgtggtataaaatttatacatatgtatgtacatcttcaacagcagaaacaatatttttctgtatatttccagtgcttggcttctaatagatattttgtattcatttgtgttgctgaaaaaagcaaagcatacgattaaaaccataaactttgagagtatttgagaacattcatttgagagtaaactttgagagtatttattttttattaaaagcattgacacttaataataactacatttaaggcctaataatttataggtctagttttctagttaaactaggattattattctttgcccatcatcaaaacatcaagtagtttttcttctctagttttgtttattcaggactcttaaataactccagtcttctgcaccccccaaaaaaaagcttttcattctcctacagagaaaaaggaagccttgagccaccttccccaatcagatttgcatttatctagtttgtttggcttttaccagtttacataattctaccttctaattagaacagttctccatgcttcagttacatgtagtcaatgtcattacatagtaggtttttataccataacttagagatatgaaggatttttcagttttctataaatgtgtgggccacttcctaatttctgtttttttctagcaaatttattgcagataaccattgagtccttttgtatttatccagactgcatagtcttaggattctgtttagatgtgccattataaattctcatgatggacttacttgagagacctttgagcaccacagaagagaaaggaggcagcaaaagggaaaaagtattttattgaaggtcattcccacaatatccattcattttatgacattagtagcgctaattttatagtcacttagtatcccgtctttttttgttgcctagtggaggctgtcattgatgatgtagttgggagttaccattaggtagtgactcagcaaaccttatgtggtcttaggttgtctcac

SEQ ID NO: 112346 - DNA, 1028 bp, Homo sapiens
acttgccttgacctcccaaagtgctgggattacaggcgtgagccaccatgcccggccgattatgtgttcttgatatgaagactatagtaatcagttacttacagtgggacttttattttaattcaaaataacactttaaaattctaggaactgaatatgtttttcctgagtgataacttgcttttaattcctgtatgtccaaagacttgagagagagagagaaagaggattgtttctttttctttcttcccctttcttcactgggtctcacttgctgaggctgttttcgaactcctggactcaagcagtcctctcgccttggcctctcaaagtgctgcaattacagacataagtccctgcacccgttctgcttacgtttcacaaatactgggcagttgcaagttttggcttagctgttcttctctgttaggccaaccagagttacgctctgaaagtgccagtttaggagttagccaaaaacctgtgagggatttttacatatattgaggagcccacttctcatctacagcagtttttctctggtaccctgtcccccaaagcctacctgcctgccagtctctcattgttttcatcgagactcccactgtctgcctggaaacccatcattaattttaagctagtgggataggaaatgtcattcagtaattatctgtttgaacacttaaatttactggtaagtaaatgttgataaaaatgtttggttttaaggcattacttactgtatgtcaattttcaggccttaatcattctgtgtaaacatttaaatttattcagttaagtaatcaagttaataagttcctgttgggttaagtactgtgattattgagtaaaatcaagacatggtctccgttctgggtgactttataggctaatagaaattcttgtacatgtcatatgttgataagaaaaaacatatcccttgggaggccaaggtgggaggattgcttgagctcaggagtttgagaccagcctggccaacatggtgagaccttgtctctactaaaaat

SEQ ID NO: 112347 - DNA, 1053 bp, Homo sapiens
gtggtgttcttagccgtaaaccctggtagtcctggatttaaatgacatgtttacttttccaggacttcagatttgtctgaagagtggagagaataatggttgtttcacgggattatgaagattgactatattgagatgatttatagtatgttgagataatatgtatgaaaataatgtagcacatggcctggtagttactgcttagtaaatgttccctatcaagtaaaaactcatagtttggatgaggtgtgagcttttcaaaatcataaagcaccatccttttctgttcttactgtgtctgtccttctgctcattatttcatacctttatttaatatagtgacttcaatttactagaatgttgtattagtaccttgtagaaataattgcagctgtctttgccatatgtagcatttacatttctaatatggacacagctggttttccagttcagctacagaaagtgaaggaaggggtaatataaggaagcactactggatatgagtcaccaatcatgttgttatccattatttggtgctgtagcattgaccgaacacgtttatatttttgtgtcatcaggaagggggagagtgttggtatcagaattatttaggtgtggtaacagtaatctgggtaattatttctaacttaatcacgagttctttctcttttcatatccctacttactgtgtgtatgattgggggtggggtgaaggtggggaaggtctggtgtaaggatctgaggatagatagaaattattgagccaggacaataatttagagagcataccctaggtagtttaggttaccactccttgttcagatattactgggatatgaatgttagtgatttatcttctattgttcttaaaattttttcctcatcttaaaatttaaaggactggaacttctccagagtttgaagtctagttcagtatgccgcatttactcagctcttacctttctaaactcttacattaatgtcatctcaagtactgattgctcatggtagccgacagttatggatcacttcagtgccaaactcttggattgt

SEQ ID NO: 112348 - DNA, 1877 bp, Homo sapiens
tttgttgtactatataattcatattaatgaacaattgaatgccaaccagactatgcaaattagtggactttttgcttaatgaaagaacccactatatcagagttcctcgataatccacgtaaatttggctctggggttcatattccagatttcttcaattaaaagaaaaaaatatacttgctgagtgcggtggctcacgcctgtaatctcagcactttgggaggccgaggcgggtggggatcacttgaggtcaggtgttcgagaccagcctggccaaaatggtgaaaccctgtctctactaaaaatacaaaaattagccaggcctggtggcaggcgcctgtaatcccagctactggggaggccaaggcaggagaatcgcttgaacctggaggtggaggttgcagtgaaccgagatggtaccactgtacttcagcctgggcgacagagcaagactccatcaaaaagaataaaaaaaaaaacagaaacaaatttcacacttcattttataatctgagttaatgagcatgattattagacttagagaaattcaatgtagacacacagtttatacacagaagttgcagagggataatatgcaaaatgaattatgtaagcttactctagtttggacagaaaactgtaggcaaaaaacatttaagtaaaatattgtttaatttacataaagttaagaatatgggccgggtgcggtggctcatgcctgtaatcccagcactttgggaggccgaggtgggtagatcaccaggtcagtagtttgagaccagcctgatcaacatggtgaaaccccacctctactaaaaatacaaaacttagctgggcgtggtgatgcgtgcttgtaatcccaaggtactcaggaggctgaggcaggagaagctcttgaacctgggaggcggaggttgtagtgagctgagattgtgccactgcactccaacctgggtgacagagcgagactccgtctcaaaaaaaaaaaaaataaacaaaagaagtttccttaatctattagtaccggtgagttgcaccatcttagtcatagagacttttttgagaagtggaaatgagcatgggttatagtctcatcttaatatctgagtgatcttgaagactgaaatttctaagtcagctgaaagtcggaataagatatattacggtgatttcaatttttaaatgcagtattcaaaggtgacagtttgtcaactgtaagggactaaagttgacattccatgaatgttttatactcatgtatatccatgcatttacatactattttccctcttttcttggaaattcacattgctgctttttaattatcaatccttagccattagcaagaaatgcaaagcctgtgattcacaatcctaagatgttcttcccactcctatccctaccataaaaatcactagtgttccttcaaaagtccctaatcatgtctccagaaaaagaaaggggctgggcttggtggcccacacatgtaatccgaggctttgggagacaaaggcaggaggatcacttgagcccggagtttgagaccagcctggccaacatggcgagaccctgtctctccaaaaaattaaaaaattagctgaatatggtggtgcacacctgtgtcctagcctcaggaggctgaaatgggaggatcccctgagcctgggaggtcagagctgcagtgagctgtgatcacaccactgcattccagcctgggtgacagaaagagaccctatctcaccaaaaaaaaaaagaaaaagaaaatgattttgcgtgtgtgtgtgtgtgtctaaaatactaatagtcatttctgggcacttctggaacctgagaatgtggtcagaaatataaggggtttttttttttttgtttcccca

SEQ ID NO: 112349 - DNA, 1037 bp, Homo sapiens
atggggtttattagcaatcagaaaacctttcacactctggaaccagctctagaccttggttgccagatacttttgtgtatcttttcatggtagcttgtggttttgctaatggtttaccagtttgctttgacttttaaagacttttttttttttttttttttttttttttttttgagatggagtcttgctttgtcgcccaggctggagtgcagtggcgtgatctcggctcactgcaacctccgcctccgggttcaagcgattctcctgcttcagcctcttgagtagctgggattacaggtgcgcacaaccgtgcctggctaatttttgtatttttagtagagacggggttccaccatgttggccaggctggtctgaaactcctgacctcaagtgatcctcccgcctcagcctcccaaagtgctgggattacaggcgtgagccacagcacccggcacttttaaagacttttataaaactatttcaaaaactcttatagactacacaaaggcttatttttcattgcgttggtgtaaactatccttaccttgtcaaaattcaaggcagcttctctgcttgcttacttgtttttttattggcaccagttttcatttatgttcctgggaattaaattgactgaaaaactcataagttgttgctacagttaactgactttaggacattaatattacataacactaatgaagaataagtatgtaaaatatacattttaaaccccttgacaggttctgatgtccacttttgtctagatctgttcctaccccactacactagtgtcagtaaaaagcattacatctggtaataggggcaaggctacgagactgtaaactataaaacaataaggagttctgtgaggtttctgtcacatttaggtcccttgagttttgcagagtttatgcagttttgtttcagcagcacagagcggaactgcaaagtgatgaaggactatattttgagttagtaaatattaatagctcctgatatatccagggtgttgtaccaagtgttctttaggatac

SEQ ID NO: 112350 - DNA, 1040 bp, Homo sapiens
tcgcaggtaggcgcccgctgccccgcggatatgccgccgctgcgggacccctcctcgcttctcccctgctggctcctcccgcccttgcggcgagtcgggacgcgctcctcctcttccccccggccgcgtttcctcctccccccacccgcgtcgccaccgccccctcctgcctcctggggtccctgggtcctcgggaaccgcgctgggctcacgcgggggcgggggcgccacccgccgcggccatgtgggctggggcggaagcgggctgtgcggggtcgcgtggccgcgctagacctccgcgttctggggccggttccccgcgctggggcgggggccgccaggtgtgcgggctgccggaggcaggtagcggcgccgggaaggagggcagcccgagcgtcgcgagcctccacatccgcagcaccggcggggctcgggtctgggcgctggaggcgccgggccgtccgtcgggtccctgcggggtggggggctgaagctacctgccgggctctgagagatgggtggcccgaggaccgtcggagtcgcagagaggaggaacgctagctagctccagccccacttctttgtgctttactaccgtgctttgacacttaagcaactttgggggtggggaagggagaggtctgtgtaattcattcttttctttcggtatataaaattattaatttacaaaactgtaagctaacgggatgagtcacctgtgactgaatttcccagagtgaaaaggacagttccattgagggttaggcgtgaatgctgtagtgtattttaagttttgtgcagtagagcaaacccagcgttgaatggggtccagactgaagcgtgtgctcgtgtttctgtttactgaagagtactagtgttgctgctgcatttcgagacccaggatgagggctgggcggcaatagtatggctcttagttacagtccaggtttagtgaagagaggcacatgaatattcaaatattaaattggtagcgtcctgtggggaggagagccggaataaagagaaggcctgattggggc

SEQ ID NO: 112351 - DNA, 1051 bp, Homo sapiens
ttttttttttttgagaccgagtcttgctctgtcacccaggctggagtgcagtggtgtgatctcggctcactgcaacctctgcctcccgggttcaagcgattctgctgcttcagcctccccagtagctgagattacaggtgcgcaccaccacgcctggctaatttttttgtatttttagtagagacgggctttcaccgtgttagctaggatggtctgtaactcctgacctcgtgatccgcctacctcagcctcccaaagtgctaggattacaggcatgagccactgtgccagcctaggatgtttgattttaaggaaagcttttgttctttagaggagtacaaccagttttacttgaaaattgagttttccaagagttcttgatgttcgattgtgtttattaatagaagttttccttcctatttaatagtttatgtatgtctttttcatttgtgtgtaagaattttttgaggacagagggtgtgttttactcatttttgtattttccaaagtgccttgcccacagtaggccctcatttccttacatgaaagaaaagacatcagtgggcttgcaatggaaaacaaagaaattctgtatttacattatcctttgtaaacactgaatagtatagtatattgttgatacactcatttatttgcttatggttgaatttagttacttttcagttttttagctgatgtttaactttgtgaatagcatagggcagttgctgtctcctctggttagaggatcagctgggagggacctgagtgatctgtaactatttatatttataaggcataaaaggtagtaagcatagtgtaagtggaaggagacctggattttgctcccatgaccttgggtaagtcccctcctttgcttaatgaagcatcctcttcaatggagttgagcagaaggtgactaagagagcatccagggtgcctagtagagcatatagtaaatttgggccttattgtgcatataacctcatatgtaatgttattaaaatcagtaccaaggaaggcttaaaaatctttgaggggaaatgttact

SEQ ID NO: 112352 - DNA, 1041 bp, Homo sapiens
aactttgataccatcccttccctcacacagcttatggcctcagggctgtgtcacatagtaactacttacatgggtgattttagtgtgtgtatgactgattgggaatctaactactgtaaataaaagaatctgcaaaaattttcttgcagtttttttccagtgtatgattggttaattgtctaatgattcttttgaaatacttcgtaatagtttgttgacataaaattgaaatataactgtgactattatataacatttagcctaatattccttgcttatttgaaataaagtttaggttgctttttgaagtgaatattgaacaggtgtcatttcttaagcttttcccaaatatttaattcgcaaagttacaggtcttggtttttgcaaatagtttacaataactcttgcttatatacaatattccttaaaatgtttcttattaaggaaggcctgacactaattttccttttttgttcttttaggaatgttttaaaggaagttgggctactcacaagttactacataagaaagcaagtaagtacaatcacaaatttttacaccatttgtcttagaagtggcatttgtgccagaaaacaagaattcttctagttctgaaagtgtatatttgaatgttctgaaagtataatcctgaatactagaattatgacatattttaaatttttgtgatatgtaaataaaatatgtctggataatatcttaatcttgtattacatatttaacatgaaaacatgagatagttgttagtatagatggatcttgcttgagccatacctgatgatgctgtcatcttttgacacactgttatgttgctggaagtgtttgcatattgtagtcagggattatgtgagtgatttggcttcatttaaccagattccttttggtttcttttagtttcaatttgtattgctttttctactcaaaactatattactttgttttttggtgttttaatgttattacctgcagtcttatgtttaattttcttttttgaagttttttgtgtgacactacaaagtaaaa

SEQ ID NO: 112353 - DNA, 1107 bp, Homo sapiens
aattgatcagctttgtgagaaataattatttttgattttgaatttgctttgggattacttgggatctgttcttttagtaagaacataatttatttgtaacatctgacctcagttgggtaggttttactagggcttatgtttcatattttaaaatgggctttctataaattgatgtggtcagaatacatttagaaaagctgtctatgacctgttcttgttcgatattatgtaaaaacttagtatatgtttacatggagttttttcttccaagacctttagatcttcaaaaaggagttataagggttttgaatatagcagtaaagcagttgctttggtgatttaggttaaggtaaaagtttggtggatttttgtgcctggacttgttggcttggttttaaacaagagatattcaaagtatgctgctgctcattagcttgaccactgaaacattcctttccctccttctcctccttcctctcatatctattcctccgtctcccagaagatgaaaaggcgaagcgagaagtgtcttcctggactgtggaaggtgatattaatactgacccatgggcaggttatcgatatactggtaaactcagaccacattatccactggtgagtaaataaggtaataaaaacaacattccaattttgaattttccaaaaatgatactcgtaatttgttttccagtagtgaatcatataatcaggattgtgtttacaaaggaactcgaattttagctcttgagctcttacggtgcatcatttgggagctggtagtttggcaatcatggaagaagtgggaaaaattttagatgaaagaactaaaacttttaaaaagaagtgtagggtaaggtagaatagatattttgttgctggcatgatggtagtgtgtacagtcgtccctcgatatccatggatgattggttccaggacatcctcactccccatatagttacgaaaatccactgacgctcaagtcccttaaagtcaaccttccgtatcacagattgtgcgtcaacagatgcagaaccaggagatatggaggactgactgtattatacttttctaaaattattttattatgatatatttctcccttaattt

SEQ ID NO: 112354 - DNA, 1047 bp, Homo sapiens
ctttgcacgtgttactccatttaacactttcaacactgctgaggtaggttctgttgtcttctccatttttatagataatgatactgagacacccagcgaagataggtaatttgcaacacaggtcagtggaacaatctctgaccttaaggcctgtacacataattaatttagactttgtgaaattactgattttgcatgtcaaagaaggtcgactctcagcaattttgtgtggttttatctagcaagctaagctatccttgctttgttctctaagaagtggggaactgtattacataacattcttatgaatatcatttttaaattttagttaaaccctactatttcagaaaaatttaagggaaagatagtctaaatgatagcctactgttgaggatgtataatttcattatttttctatttaatcttaaatgtagtattagcttgtattttagaaaaacaatcatagacaaggtaaattctaacaaatgttatgcagtgaaagtaagttctagtccttagaggtaactgctattcacctttatgtacagaacttttcagaactattctatatatgtaaacacattaggaccccgtctctgccatctatacacaaatggaaaaaactatatttaccttttcaccttgctgtattcacttaatatgtcttacaaatgtgtcttataaagccacctcctttttagtgaatgaaggttatgtggatgtatcatatttcttaagccaggcttttactactgagtgtttagatcatttcgaggtttttgcttattgtaatttgactgcaaatttgttgcaatttgactgcagtaactactcttatatttatatctttgtccatgtgtcaaagtatttctgtaggttgatagtctaaaataggtggatcaaaggatatatacatttttgattttgagagatattacaaatttcagagatttttccagttccattaaaaatacatggatgtctcttttctgctatatttttcgcagcatagtgtgttacaaagctttatgatctttgctaatctga

SEQ ID NO: 112355 - DNA, 2716 bp, Homo sapiens
atttatttacttttaaaaaatgttaagtgtagcctaataaaaggtcacaaactggagattgaaaaacacttaactttggttcctgtttcagaaaatagtgtaattaattcatcagttgttgatgtataattgcttcatgagatgattatgaaagtaatttgtaaattctgtggtacttttcaaatgtatatcatttactgagtctgattatcacacggcctggcatataataagtactctataagtattggctgatttctaataggtctgaaaatttatcttttagaattttttcttcagttggtttagcgagtttccctttgatgttgaaaatgtttttttttaaaaatctaacctagaccatcccaaatcatgaattactgttgtgtgaaacagtgagactactgtttttatgccacaggtttataattatgcaaataaatactacatctttgcattcattttggttttacttaccgaattttcattccaggaatgtctgaatctgaacaggctcttaaaggtacttctcagattaaattactctcatctgaagatatagaagggatgcgacttgtatgtagggtaagagtgattttttctccatggggtaggaaatgtttaagcagtacttagacatgaagtcagtggtttgctgatttataaagatagcaaatgttatattgttagactgaccagccatgctttttttttttttttaacttttttttgagacagagtttcactctgtcgcccaggctggagtgcagtggcgtgatctctgctcactgcaacctccaccttctgttttcaagcgattcttctgcctcagcctcctgagtagctgggattacaggtgcccaccaccacacctggctaatttttgtatttttagtagagatggggtttcaccatgttgcccaggctggtctcgaactcctgacctcgtgatctgcccaccttggcctcccaaaatgctgggattacaggcgtgagccaccacacctggcctttttttgtatttttagtagatacagggtttcaccatgttggccaggctggtctctaactcctgacgtaaggtgatctgcccgcctcggcctcccacagtgctgggattacaggcgtgagccattgtgcccggtttagccatgcttttcattaaactattgttagtatataattttagtcaacagttttcttcttaaaagcctatttcagaattaatctggtggatagtctatatttagatgacaatccttttcatttatttaatgatatttaaaaacattttgtcattttattttcacaagtcatcataacataggacagagtttaaggctcagagggttatgctgtaggcctttttgtgaaatacctatgatgagtggtagtagtggttggtactcattaggtgaaatcacatatttattctgaaggaaaatataatacattgatattattcatttaagtaagattcttaaggtttctattcagtgctttaaaagtgatttgattctaattttgtttgatatcctggagaactttctcttcctatgacttgctgtgattctttgaggaattcattcatctatttttttttttttgagacagggtcttgctatcactcaggctagagtacagtggcacaatcatagatcatatagatcatagctcatagcttactgtaactccaaactcctgggctcaagctatccttccacctcagcctcctgagtagctgggatcacaggcatgtgccactacacctgactactttttttttttttttttttaagagacaggatctcactatgttgcccaggctcatctgttcttttttcttttcctctacttttccccattatagaaatgagagaagactacctctatcagttgatgatagtttagatttcttaggatgtatattttcacatagaaatcagccaaccttactgctgcttgcttgttaacccaatttttatataaaattaatgtttgtttttatgtatttacatataatatatttatatattttctataaaattataatattcaaggggagattcatttttaccaatcttccacagtcaaacagtagaaagggtatagatttctgtttctgtgtcttttttaatgtattgagtgttccttttttacagcttgctagagaagttttggatgttgctgccggcatgattaaaccaggtgtaactactgaagaaatagatcacgctgtacacttagtaagaacttcacttttttactttgagtaattttgttacattactagatgctttgaacttaaacattaagtagatttaagttctgagtgtctaaggtaacttgggtaaactcatttgaaagcaaatttttgctttgtttcaaatatggaaaacattcaacagtcattattctcatctttaagaatctataatattaaggtctgaggtaagcttgaaatatcttgtttctgaaacaacatatttgtaataagcatttcagttgagcttttataaaatgattgattttatctgctttaagtaaatcctgccactacagacatcaaatattctgaaataaaaaaaagaatatgacttctgatggtagattagttaaatgtttcctcaaggcaatgaacagtccacataaatatttgtagtaagtatagggattaaaaataaataaataaagattgtctgcccatcaaagagag

SEQ ID NO: 112356 - DNA, 2040 bp, Homo sapiens
ttcatatgttagtataagacgtatcgtatgcaataatagcattttgagtatgctctgtgggccaggtactcaagtgcttcttttacattaactcattaatcttaccaacaacctcttgagggtaggtactattgtaatctccgttttataggtaaggaaactgaggaagagagaggttaattaattaaattggtaaaagttacacaacttgtaagtgatggaattggcattttcaatctagaaagtctaattctgtatgctctgaactattatttgtaatgctatgagaagtagagaagtatattcctaaatgagggaaaagccacaaatgtagttattggttgtaagattttttttttttttgtaattgaggaaacttcatattaatttagattttcagtaagaatggaattgctagtaaaatcatggtatattctgcatattctgcaaatggtatattgtgcaaccattaaaaaatattagcctgaagactagagcaggttggaaacagaaattacgtatactgtgattaccactgtgtaaaagcatccagtaaagtaagacttgttatggagagcagaccatgtttttctgttaggagttcttttgttgttccactgaatgtggttattaaaatatctggaagtactttaccgtttcttaattatactagtagtcatttttggggcatagtgatataggcttgtttcaacataagaattataattacatcaaaaatgcttgttaatatttacttcaaatattttatttttactttaacatttttcataaggactagttaattctaaagtaaaatcttcatatgtggtaatatttatatatatatttgttatagaggttgagtatcccttatctgaaatgctttggaccagaagtgttctgaattttgaatttttttggattttggaatatttgtattatacgtaactggttaagtgtctgtaatttcaaatttgaaattctaaatgctccaatgggcatttctttgagtgtcctgtcggtgttcagaaagtttcagattttggaggatttcagatttttggattaggaatacttaacctgtatgtcattttacttttcctttgtgcagttaccagtaaactggtttgtgtatgtgtacctgactggcacaaaccctgttgtatattgtttaagataatatccagtactgttactaaaataaaatactgagttcttcatagtagcatgtgtccaactgttttcacatttttcaaattttaaaatctgtaatttcatacagattttttcttttatatattccaaattattttttctgtattataggcatgtattgcaagaaattgctacccttctcccctgaattattataatttcccaaagtcttgttgtacctcagtgaatgaagtcatttgccatggaataccagacagaaggcccttacaagaaggtgacattgttaatggtaagaaaaatatgttactttcatcaccatgggcaaagaaacaacaaagcttggggaatctgacagtgacttgtgttttcttgacttgcttcctgtacttaaactttttcctttttaaaattcagtatcactaactcttaaatctacaggaagctctcttaacggttttgtgcatgttgcttttaagatacttccggtgtgatgtgtttggtgcagtgtatttctttaatgcttatctcatatgtgattggtaaataggtcaaagatgtcagtgaaatgtggagtctagtttttttcccccagaagttcactaatggttttgaagagaccagggcaggctttgttatagatacaggaaaacccttcataatatatgaagacctaaaggaaagctgaaaatcttgcagaagtgccttacttgagtggaagtagctttaaagacccctatgttaagctaccttgggaagttacaagtatagagagtagaggaagtagtttaaaagacattaatgaaggctttcctagatggcatttgtttttgttttgtgtattattttattttttggagacagggt

SEQ ID NO: 112357 - DNA, 2280 bp, Homo sapiens
attccatcttgatttgatatttgggatatataaaaaatgtggttgtaatacatctgatgaaatttaaacatcaaacatactgaagaccaaaatgaagttggaaaggcattagctaaaacaattggcatgtaaataaggatcttagtagtgaattttttccttggctttcttcttgatagagttcatttagaaaactgagtgaactaagaaattgtttttgtttgttgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccatgtagtcattaactttgctgcatttctttgggatttcagagggaaatggtgggaatggggaggctgtttgataatctaaaataaattcatgaccatttgagtagaaatgttttttcaggtgtaatggctgtacataaactcagtagagtgccagcagcatttgagatgcaaccatatttttgagagcttttaagacagaatgctgaatattaggggagcattttatgtactgattgtggaattaacaatgtgggcttattcagtgtctgtcattagaatataagctgaaggaagaaagatcttggtgtgatagttttttggttaaaagataaaacaccacactggtgataatgcttttcttagtttgggagattttaaaacaatatggact

SEQ ID NO: 112358 - DNA, 1386 bp, Homo sapiens
taaatttaaaaccaaggaaataaagtcctgtattagtttttttcttccttgaatatcatgattatagaaatctttgctgatgtggacctaaataagcttgttgttgagacttccagagttctgtcctgggtagtttaaaagtctcaattggccaaaactttaatgaggttttagtaaatcttaatacagaggaagggaaatttcaaaagtatttacttcttcactgaaaggtgttggtcaaattcttcatctccatgctattttggagtttctcattactctttaactcatcaaaaaattcattcttttaaatgccttttgtcctcagctaagtaacaagcatactgcagaaatttgttgaataaattaatgtgtgatttcttttaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaagagaaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatcttgaagggaggtactgtgccttgttcatacctgtaccccaaattcctaggatggcatctgcccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacat

SEQ ID NO: 112359 - DNA, 1541 bp, Homo sapiens
gttttatttttttttatttttgagacaggatctcattctgtcacccaggctggaatgtagtggcacagtcacggctcactgcagcctcaaactcctgggctgaagtgaacctcctgcaggcacgtgctccgctacacctggctaattttattttttgtagagatagggtgttgctatgttgcccaggctactcttgaaatcctggctccaagttgtcctcctgtctcaactttccaaagtactgggattataggagtgagccactgcacctggcccaccgttttaatgatgggattttaaaataattccatctgatccataagttgtaccttttaaaatgagttcagtattctgacagtatgatctagaaggatagtgaatattggaaaagatggataagattataaatatcttataaatttcctttataaggcattgctgcaaggtgctaaattactaatgaatatatttgaaattgtagtttacaacactttcttaatatttactggtcattatttttaaaacatttctttttcctgtgggttttaagaaacctaattccaacttgcctttttcctttttttttctttagagtcactcaagggaaaggattaatgccagatggtaccagcagatttacttgcaaaggaaagacaattttgcattacatgggaaccagcacattttctgaatacacagttgtggctgatatctctgttgctaaaatagatcctttagcacctttggataaagtctgccttctaggttgtggcatttcaaccggttatggtgctgctgtgaacactgccaaggtaagagactgacttgggttttttgcttctgccttctaatttaattcagtgaaactttcctggaatagtgaaattggccaatctgtatgaaacccagtgattctcttgactctggtagaatgagtactttataaactttctttactcctagttggagcctggctctgtttgtgccgtctttggtctgggaggagtcggattggcagttatcatgggctgtaaagtggctggtgcttcccggatcattggtgtggacatcaataaagataaatttgcaagggccaaagagtttggagccactgaatgtattaaccctcaggattttagtaaacccatccaggaagtgctcattgagatgaccgatggaggagtggactattcctttgaatgtattggtaatgtgaaggtcatggtgagtatgggcttcattcctttttagtttatggaactgctttttttgaagtgcagttttagattaaaaattgttttgttttggcaaaggaaaagtctcttaataagaatttttctagtgaaagaaggggaaaatatctatttgaactacaatgggaaatgatacaagaacagctcagggaaggatgagaaaagatgtttctttgcctttcaatgcctgctaagtgcatgtctcatgaaatgaaaagacagaataaagcagttgtgcagagcatgatctttggaatcaaatacacatccacttactaactcagtgac

SEQ ID NO: 112360 - DNA, 1052 bp, Homo sapiens
taccctatgttaaccttggctggtcttcacaaaggcgactggaccctgggccctccctgtcccaggatcccctaacccctaccccagaatggtttgtcataatctggaaatttgttggctcatttttctttcaactcctttatttttcattgaacaaatctctgcttttgaagagttgaggttatctgctatctttttttcttttctctccctccctcctgctgcaaagaaaagaaccaataagttttagggatttttgtgtgtatagacattgtcatccggatgtaacttgctttgaagcagtgtttctgttgtgagtgtctcttactgtaaatatttgttcatatttttgtgaattcagtactgtgtaccattgtattaatagtaactttttataaagcaaaccataaatatactgacttttcttacagataaaagagaaactaaaggggtgtgcccagtatcaccagccgttaagatataaaacagaattttctgtacccattctcttcacataacagcaggctaaatttgccaaaccatgtagtaaggaaagacgtgcttctgagattaaacgaaatcatttttatgaaccactgcccagtaagtgagagtaataaaacttacccactaaggctattaggaagactgcaggagataacctaactccttgacacagaaaaggtagttgtttttattgtactaggtaacaacactgaaagaactacctctttgaggaaatttaagatccccttgtgtgtgttccgtttttttttttaattgaagtagagcatgcatattataaagcacttaaggtgtatagatcttaagtgtacagctcaatgaatgattatgtatataaacacctgttgatttgaacgtcacccagatcaagatagagaaccctgccagcacccgataagctccctcatgtcccttccaagtcagaacctacctccctcttaggtaaccactgtcctgattcttcctttcactgtgaccttgtataaatagagtcatgcagtgcatgctcttttgtcaggtttcttttt

SEQ ID NO: 112361 - DNA, 1688 bp, Homo sapiens
tatttcagaaatagtcattacctctttaaaaatcatatttcccagctgtcatgaggaaactagaagtgagttggattccacctgttttgcacacaggcgatggttctctccatgcttgaaggcatagtgcccataaaatgaccttgtttaccttctcttgctaacgcgcgctgaaagggggactagatgttccctatttcgttgcatataaatgcaccattgcttttatgtaccactaaaaaattgctgccaattctaattgttaagatgccatggattataagcacatgctgattttagagaggttaaaatatgaaagaaatgtgtcttagagtcaatgaaatatagtattataataaaatgacttttcttgtatctgtacctctgaattgcatgcacacatacttacacattcgttgttttaatgtcctgatagatcattgccactgcggtttgccacaccgatgcctataccctgagtggagctgatcctgagggttgttttccagtgatcttgggacatgaaggtgctggaattgtggaaagtgttggtgagggagttactaagctgaaggcgggtaaggagaatacttgaaccacttgtttaataattttggcttattcctatggggaaattgtttttctgataaaactacccactatttatgaataggtatcatctaagtagattgtcaagattaagttgattcctcatctgggaagcacaaatatttggatatttttttctctctgattttgcagactactgtttttgtgaaacttttctaagtacatttccaaaaccaattttggcatattaagcaagaatttttagagatgcatcaatgaagcaggattttgaagcatataacttcattgttcttcagttattgtttaaagagtttcatttagataaaaatattgaaacatactttttgcatggtcagacagtatctgaatgatgttacctaggtaaagttctaagacttgaagtttttaactttgcaaagccacatccgttgacaggaatttgcaagggctgatgttttcatttagaaatagatactacctattcaggatgtctttgcatttgtttccaggtgacactgtcatcccactttacatcccacagtgtggagaatgcaaattttgtctaaatcctaaaactaacctttgccagaagataaggttagtatctttttatgttcttcttaaaacacaagtgctgcgggataattaaggaatcacagagaccgaggggttgaggaggaattatttaataatttaggttcattaacccagtcggattaacgttcaaaggactgagtcccgaacaaagagtcaagctaccttttaagcatttcgtggggtggggggagacctttgtagggggagcatattacagaagcaagaaacaaagacagttattcaactgagacatgcattacatcatttcttatttttcaaggaacaacgtgttttatgatttgagatgatctgtctagtgaccttgcagctgcacagctagagaaacagagtcttcacaatgcgtgggaaagggagagagaaggctcactagccacagaaaaacaggcagttaattttaaaggactccagctctttctcttcctcagggggagttgggttttcttacatacaactgagtttttgcttacacattctttaat

SEQ ID NO: 112362 - DNA, 1015 bp, Homo sapiens
ggctaataaaacgaagtcagaagtcacagtcttaacattagataaggtccaacacattacaaataaagaaaaggagaaggacatgttgtaattgtcaagaaggcaatccttagtaaagatctaaccattatgaaaatctgtgtatcaggtaacagtattcaaagtcactgacagcctttgggaattacatgaaacaatacatcagtataaggagtctttaactcatacttctcaacctatgacaatgtaagtagacaaaagatgagtatgtggaaaatgtacatgctataattaatacagatagtgataccaaattttgtaggctaaaaaaaatgcaactcgtattcataaaagtaactatattagaccacaaggaaaattttccagaagtaaaaatataggcagcttctctgataacaatacattaaactggaaaataaacttggtgagatgggatgaaagccttattttaaatttgttttctcaagagcttataaaaggggaaagataaaaagaggaaagatagaagaggaaaccaaatttgaaattatgtaatattttgaaaatagagataataaaaacactacatatcagatctatagatctagctaaagctgtgattagaggaaaattcatcactttaaaaatttatgctaatgagaataactgaatataaacatattaaaaagatttgactcaaggcattagaacaataatgaacctgaagaaataaaaaatggaacttaataaaaaatgaaaagagatacaaaatagaaataggaaaattgttggacatatgaataaatccaagatctgttgttttttgaaaatggtagcaaaatgtgaaaagtattagctaactggatcaagaaaaaaattacaaatacacaaaaatgagattgcagaataaacaaatttagatgaattatgagataaatctcaattctatgaaaataaatttggaaacctggatggaatggataattttctgggaaaacatgaagttccaaaattg

SEQ ID NO: 112363 - DNA, 1701 bp, Homo sapiens
atccctataccttttttctttctcaaagtcagttctctcagtgacacactttccctttcacactcactaattccataacaaaggcatttattttattaatagcctatgatatgaaacattttcaaaggcttttaagtttttaagtacagtatatttaccaaatcctgtatttgtgcccatttttccaagaactagtgtaataaattaaaagaggcatgttttcagttattttgcgacttgttaaatttatcatttataccatcacctttccagagagacttgagattcattggtctctaattaatcaggttcctcttggggccttaaatttgtaatataacattttccagaaaactggctatttattaattatacattttaggagagagttcttttgcctcattcttggtttcattaaaaattatggataaatgtcatctgagcctggtgatacatcttttatgcagtcaatgtggcttacaaaatcatgactgccagctattgttcaattttgtacctgtgacctgacaattttggtgaagaagttttcaaatgtgtgtctctttgtagaaacagatacatggaattaattaaatctataaactatttccttttctttttttctttctttttttttttttttttttgaaacgtagtcgcttgcactgtcacccaggctggagtgcaatggtgcaatctcggctcactgcaacctctgcctccgggattcaaacaattctccagcctcagcctcccgagtagctgggattacaggagcccgccaccacacccagctaatttttgtatttttagtagagacagggtttcaccatgttggccaggctggtctcgaactcctgaccttgtgatccacctgcctcagccttccaaagtgctgggattacaggcatgagccaccgcacgtggccagctatttccctttcatgattcatgtagatggagaggaagtaattggagaaggcattctttggtcatagaacaatgtgagcaaatatgtggcagtaaaaatgcgtttgttttgttggaacagaaataaagttggaaaagtagattactgccatattcaggaaagagtttttaaattaaggatttcagattttatcccacagaaaaagataaaacattgaaagtagtgtttttagaaaatgagcctgctatcagtgtgtggaagtaggttggaggggtctgaggccaacaaggaggaaataaaattaagaggctatttaaatgatcaaagtgtgagatataagaaattgatgtagtaaattcaaaataatgcattgtaattatattatttcaaactttgtttcatatatttttgaatggatttgttttgggaaaagagaataatcatttttagccaactttcataaggtcttattaattagtaacctctttccctgttgtcttaaaggatatccatatcaaaccagagcactatagtgaactcataaagaaagaagacctgatttaccttacgtcagattcacctaatatactgaaggaattagatgaatcaaaggcctatgtgattggaggattagtagatcacaaccatcacaaggtactattaaatttttatttttgcttttgcttgttcttaaaattgatatatcaccatttcctgaaagtaacaataatactaatgatagctcatctttattgagtgcctactatatg

SEQ ID NO: 112364 - DNA, 1049 bp, Homo sapiens
tgcatatactcttgtgcacatttttgtgtgcatttctgatttatttacagaaatttaaggaaatactgagtcaaagggtgtctaaatagagattttgaagctcttaaaacatatatatgtgttgccttctggaaaaattgtaccatgaccaccagtagtatatgaaacaccccatttctttagacctttactagcattgctgaatatttaattgatattaaatggtatttaaatgatatttacaattaaatgacatttatttgtctaaagttttatttatattattttatggtttaactttaatcatattgattatttgagttttttaacttttttgtgcttgtaaattatctattcatgtcaaaagttgtttttcagaggcaccaaataatgtcatctgaaatgttgccagcatttattgaaacttctaatgttgacaaaaagcaaggcataaatgaagatcaagaggagagccagaagccaagattaggtgaagggtgtgaaccaatatctaaacgacaaatgaaaaaactaataaaacagaaacaatgggaagagcaacgggaactccgcaagtatgtgtttcaaaatgtatatgctctcttcctatttagagatatgcaatgttaaaccttgcatagccctttggcatattaaatgtaattgtgttacttaaaattcaattactaattttagacaaaagcgtaaagaaaaacgcaagagaagaaaattgaagctaacaacgtatattgttagctaacactgtcaactggctgttaaaactattttttaaaattgtttgggtttcttttagcactgttgatgatcttgcactcaacactttttctaatgcagaaccttattatgagtagcagcacaatttttgaaacaactgacttagataagggatgtaattagtgtctgtgtgctagttatggaataaaaacagccaactcagaaagatcaagttttggcctgacattgattttgccacaagaactgttgcaggttttggtgaaagcagtttggctaaatttgtcgttgtaata

SEQ ID NO: 112365 - DNA, 1867 bp, Homo sapiens
taaagagtaaagctatggctgttttacttcagccataaaaaagccttacagattctaaatttaaatgcattttattgtgaatctgactcactttttgaatttaattttccacttgagttatgtaaaatcatgtgatatggtaattttctgtataaattaaaaataatataggcaagagatgtttttctctcattttcaacacagaaaaattaggagcctttcttcgttgttttgcatttttaacagtgggactatcttaattccttcatccaatactcacaagaatatatgaatgaatacacgtctgcaggtacacacttaattcttgaacgggaaaaaacagacatcactgtaactacctcccactcccaaaacactaactccagaccccgccccgcataaacccctcccctttcttccattgcgggttcgaaatggccgcagttcgatgacgtaagacgcaaccgccgtagcctccactgcgtaactaccgcccctgcctctgggaattgaagtttctgtggaaggaagcgtgagccgtaaccaggccaacccagaaaggctttctttctgagatttcacttccctgtcaactcttcagctcggtaagtgtcctggcactggttggcgctcccccgcactatggtattctctggacgcaaaggggcgcgtgccatgcagccccctactagcaacaagggcttccgggggagaggggagcagtggtgtggaagtggtttcctgcggcgctcttgctgaaggaaatgacgtcgatgacaggcgccccccgcggcctacccagctgctccctggttcgccagagacagcttaatcccgtctctgaaatgcgtttgctggctgggagcctagaagggatagtgggcgaggctccgccccgtggtggggcgctttccgtcggcgtgtgttttggggttgccatcggcccgtagtatgtgaaaagtgagtttgcaaagaatcagtgggaaatctgtactctaaagggccggaaagcgtgttatggccctgccacttcgtggctagagaccgtgggctttacctctttaaagctgccttacctcatttttcctgcaaagggctgacgtcgctgaactctctgaaatgtagagagcccgaggggaagttgctgcaggtgctgtgagctgaggacagttttataaagatcgaagtgttacttgatttcactgaaatactttaaatttgggaatttttctacagatatgaagaggatggcaacacattacttgtcactttctgaaagaatttcatctgccccttccattcccaaccctctgcccaaaaggcttgacaactgaagtgaacaaagggcttttcgctcctccacgtttagtccgcatgtcttttaaaagggcattcctggccgggcgcggtgactcacgtctgtaatccccgcacttcgggagggcaaggcgggtggatcacctgaggtcaggagttcgggaccagcctgaccaacatggtgaaaccccgtctctactgaaaatacaaaattagccgggcgtggtggcgcatgccagtaatcccagctactgggggggctgaggcaggagaactacttgaacccagaaggcggaggttgcaatcagccgagattgcgccattgcactccagcctgggcaacaagagcgaaactccgtctcaaacaaacaagaaaggccgggcgcagtggctcatgcctgtaatcccagcactttgggaagccgaggcgggtggatcacgaggtcaagagatggagaccatccaggccaacgtggtgaaaccccgtctctactaaaaataacaaaaattagctgggcgtggtagcgcgcacctgtagtcccagctactc

SEQ ID NO: 112366 - DNA, 1357 bp, Homo sapiens
gaggctacggcggttgcgtcttacgtcatcgaactgcggccatttcgaacccgcaatggaagaaaggggaggggtttatgcggggcggggtctggagttagtgttttgggagtgggaggtagttacagtgatgtctgttttttcccgttcaagaattaagtgtgtacctgcagacgtgtattcattcatatattcttgtgagtattggatgaaggaattaagatagtcccactgttaaaaatgcaaaacaacgaagaaaggctcctaatttttctgtgttgaaaatgagagaaaaacatctcttgcctatattatttttaatttatacagaaaattaccatatcacatgattttacataactcaagtggaaaattaaattcaaaaagtgagtcagattcacaataaaatgcatttaaatttagaatctgtaaggcttttttatggctgaagtaaaacagccatagctttactctttattcattccttgagctatttttcctatgctgttttgcaaaacatcagatgacatttcattgtttataatacttgaccttatataatcttttgctatatatagatcatgtcaactgagagagaaatgaaatacaaccccgtagattgtcattttctatttagtttttttctcctctacttctaataggtgattattgcagaatttgaaggtaagaatgaggtttgcatcttgaatagaagactggcttctcatatagaaagaattttgaagtaaattatccttgaagatatttgaacatgtttaaaggcttcagtgaatagaaaattaaatccagaatttgagattctctaaaagagccgaaatttctttgactttagttacaaaactaaagtcactcttgccataagcccttaaattttacttgaaacactgtatcagctataacactgttgtgagtccctcttctgtttcttcctcatctcaaacctaaaagatctttgttaactgagcactggcaaaaaagtctggatccacttctgatctgttagtagggcatcttttttcagctgcctccatatgagggcaaagagtagctgagggaggattagtaattggatatgtagcccttcacatgtaggtcattaaattcaggctggcaaagtgatgtgccaaatctttccacagctgttcagttgctcctatgggatctgttttataaataattatacagttttttcagagttaatacctggcctccttagatattttaaacaaagttttaaagcaaaaaaaaccacttcatattctaataatgaagtcaataaattttcttttgacatagacatttaactttgtagtcatttggtgcaaaatttaaaatg

SEQ ID NO: 112367 - DNA, 1038 bp, Homo sapiens
gattcaaccttaacccaaagtataaattaaatatccacaagtccttattgatatagtgattaaataaatcaattggaaattaaagacaaatttcccatgtggaggaattcaaataatttacgtagctactccaccctcaaggaggaggaacataactcctcactccataaatgtgggatgtacatagcatttccttccaaagagtgcactatgaaaaaaagggtgaagaaaaacaattaactttacaatggagaaatctgacaacactgctgagccaggtgatcaaagtcaatgtaaatagagataaatcatgttgatattatgtacctctgatgtaatgtggtatcaagaaaatagcactttacctctgtggtattcctcctccaaacttaacaacctcagtcaaatcatgagaaaaataccacaaaaattcactagaggaatatcttgcgaagtatctgaccatttctcctcagagctattacagccaagaggagcctaaagatacttgagaactaaatgtaatgtaccctggatgggagattggaaaagaaaaaaagaattaggtaaaaacaaaagtaacctaaataaagtatgaattttagttaataatatattaatattggtttattaataataacaaatcaactacactaatgtaagttattaacagaagtaactgtgcaggctatatgagaaatctttgtgttattttagcaatttttctgtaaatctaaaactgttataaacaataaacctattttaaagtaacatatacattatacaatgtgagaaaatataatggcaaaaaaagaaaatgcaagcacaaactatattccgtctctcagggataataattattaaggtgttcagtgaatattgttctaatcctttttctgtgctcatatgtatgtatattgtttaaacaagaaatctcaaaccatatctacatctgctgtttaccagactgcttcctttacttactaagatatggtaaatatactatatttacaagtttacatatttacatataccaaa

SEQ ID NO: 112368 - DNA, 1030 bp, Homo sapiens
aaaatgatagaattcatagtgaattaaagaaaattaaatttcctgatacagatttaagaaataagacattatctttggaaaaataatgttgctacttacagtttctattttaagatgaaattaattttaaaaatacatatgaattaataccattgaaaaggcaagtgaaaaaacattttatgaggaatggtttcataaaactgttgtgaagtgtattaatatagaatcatgtttcagatcagctacattataaacatcggttttccaaatgctgcattgtgtaaaatgatcactttttagtttcttaggaagacacactgttaaaaaccaattgatataacaacatagcgttatagggaccaattttaaaaccatgtactctaagtaattgatagaaaacaattcacttataaacttataaaacctgttagggataaatgtggcttttgatattaaagtaaagtttgcctcaggattttttgtgtagaaaatttccacatgaggaaaaaaacctaatcttcattattggagcaatagagggttaaatttaaaccaattcacctcagcaaatcacactgtaggttcttgaactaaagaaaatattttcaccaatttctaaatatttactatttaaacatacagttcttacttggacaaaagaaattttttaatgagaagaagatttataaattatatctgactgagagtgttatatagaggacttactatttcatctgccaaataaactgttgagtagtcaaaatatgtgtgatttaaataccatagtatcaaacctaataccataagtattttgagaaaaataattgagacatggtacttatcatgagcttctcctgttttcccattttataaactagaacattgggtgacctcatgttttcaaatatacttataaaaaatttaaggccgggcgtggtggctcacgcctgtaatcccagcactttgggaggccgaggcgggcggatcacgaggtcaggagatcgagaccatcccggctaaaacggtgaaa

SEQ ID NO: 112369 - DNA, 1080 bp, Homo sapiens
agcaggaacaaagtatttcaaatgaatattgtacatttacaggaagcagtacaagcatttggtaatgaagcttctcgatgtttttttccccttatttgggcctgtatgcttagttagatttacaggatgttagaattgaaagggagctcagggactattgcatttttcctttataaatgaagaaactgaggcctggttagaaatggggaagcaaaaactcacatctcctttctcaagctgcctcctaaagaatcaatttcttcaaactttgatttatacatgtcaactcttgcccacaatacagcacagtatttcacatgccctagaagtttccatggtgactagattgaggctgagaataattatggtataatgagtaaacacacaaattctaagtttcaactccagcctctgccatttgccggctctgtgtgtctcctcaggtaagttaaataatctctctgagcttcagtttcatcatcttatgaaactgattagatggtagtagctcatactttaatgacttattgtgaagattgaatgaaattaggcacataggacatttggaatgattcttagcatagtataagtattcaataattattattcatatttaataaaatgcttttatggttattaattccatcagattctatgcaaaagctgtacgttctttgataaataataaagaattagtttagggacaattgaatttgcatttatcaaatgtttgtgatgtcctcttcaaactttaatctagttccatagtggactcatataagtggtagaatcaagtgagcactccaaaaatagtgacttgacttggatatttgaacagaattttctcctacactgactaactggtatgtctctcctagttcagtgcacttcaccctatgagactggaaattaaatattaaaaccccttcacatgtaaatgaacaaggcttaaagtccatttgcagagcaggtggcaaagaaggaaggaaaaagatcttgaataaccctattctctcccaccaaccccaagaaatctacttctcattggaaggaggggagagaggaactcattatgccagt

SEQ ID NO: 112370 - DNA, 1050 bp, Homo sapiens
aacattgtgctctttctcctctccctacatctgaaatgctgccaacaccattgctatctactcatccctcaagactggtatcacggatcattatcttccaggaagcctttcttcacccccactagcttcttttacaatgctcctcttctgtgctccagagcaccctctgtttgcctttattctaaaattaccatgctgtgggctaattaccttcacatctctctgccctccccaccagccagaaacatctaagtacatgaatcattgcttgtccttgcagctttacagcctagcctggctcatggcacatcttacatattcattgcagtgctacatctcctcagaaataaaaatcctgaaaattgactgagaaagttattttggctttgttagaagtgggggagaaggcatcaagaactcagaacttgagaaatttaggagtgcaagacaataaatagtccaaaggcagaaaagaccaaagaacaaatcaagatctactctgcaaccaattcttgttttccagttgtccagtcccttcataatttcctctttacccacccttacccttaatatagatcaccagtcacttcaacatctctttcatttgccctgttagtttaacttcacattctcctctgctacacttcccctaaagatctccactcaaggtcaaacaaaccatgtcctattaagcgtgttctttatcggcaataaaatgcagataatacctaatttgtgagattggtgtgagcagaagatatagtatccttatgcagaaataaacctctttaaagcacattctggaaaccttgttacttaccttcttttctcactccagctatcagatggattcacctcttttaaaatggagtttttaaaatagtggtgagtgattggttgacaatgacttgaactcacactatataatgacaagcttatgaagttgattgtacatcactatggacaaaaaaaatgtaaaggtttcctagaggatctgaaatgtttctcattacttctcattggggaatcattggtgactggaccagtata

SEQ ID NO: 112371 - DNA, 1012 bp, Homo sapiens
aatgatgtcgtttattgtttgcaaattgctaactggagttaggagctacagaatgatgccagtagatccagtctgaaaacaatctctcacaacacatggaagcttttcaagtgcctaggtgaaaaatgatagacagtaatttaaagatcaaaagcaaacattcttcatttaaaaataggacatgaaaggaaggacaaacgtcctgttgtgacagttctggtcttcactcagtgcttttctttttcagctgggcaccaaagaaggttacctcaccaaacagggaggcctggtcaaggtaaggaagtgtggttttgctcatgccagccacagaaaaaagagaacacgtcatgtagactcaattctcatcttgatagtttttcttggaagcataattgcctgctcattttaacccatttgtaatattcacctgactcaagagttcatttttatggctcattagtcaaaattctggaaaatgacttgactgttctttgacaaagccctgcataggtgtagcctgcagttaaaagtcaataaaacatagtcctcataatggaatgattgaggatgaagatagcaagtttactctagaacatctttcgttcttcttctaaaacaaggaagaagtcaaaattgtataaaatgtttctttaaggataggccaaaaacatcactgatgctactgaaactatgttataaaatccaaagaaaaacacaatttaagctcttacaagttcagagtatccaaatgttccccatttatgagactgtatctttagaattcctttgtttcatctcaatgtgccaagaagaccttcatggaatgtgtctgctccttctcgttttaagagtcacggtatttaacctctcacagacactgacatgcttggaattagcctaaataatttcattatttgtgtcccttctagatcgaatgctccctgaggacagagagtattcatattcatagcatatttatgtttaaatcctctgttacttcttttaactgggc

SEQ ID NO: 112372 - DNA, 1020 bp, Homo sapiens
atgctgaaaataaacttattaatgactacaaagtttttggttgctttatttagggttatagtacaggttgaacatccctaatccaaaaatttgaaatccaaaacattctaaagtctgaaactttctgagcactaatatggcattcaaagaaaatgctcactggagcatttcatatttgagatttttgggttagggatgctcaaatagtaagtattgtacaaatattccagaattcaaaacacttctgatacccagcattttggataagggatattcaacctgtattttgtttcagtcatgggaaataaactatgttctgatttacttttggtaactatgtattttggacataaggaaatctgagtttcaggctttgaggaacatttttctaacatgtaattttcttaatctctttattttaggactaattgtcagcctagaaaaggaacttgctccattgtttgaagaactgagacaagttgtggaagtttcttaatctgacagtggtttcagtgtgtaccttatcttcattataacaacacaatatcaatccagcaatctttagactacaataatacttttatccatgtgctcaagaaagggcccctttttccaacttatactaaagagctagcatatagatgtaatttatagatagatcagttgctatattttctggtgtagggtctttcttatttagtgagatctagggataccacagaaatggttcagtctatcacagctcccatggagttagtctggtcaccagatatggatgagagattctattcagtggatcagaatcaaactggtacattgatccacttgagccgttaagtgctgccaattgtacaatatgcccaggcttgcagaataaagccaactttttattgtgaataataataaggacatatttttcttcagattatgttttatttctttgcattgagtgaggaacataaaatggcttggtaaaagtaataaaatcagtacaatcactaactttcctttgtacatatt

SEQ ID NO: 112373 - DNA, 1149 bp, Homo sapiens
tgaggaggaacctgtctttaaagctgtccctgaagtgacagcggagagaaccaggcagcccagaaaccccaggtaactggcgctactttgcctggttttgaggcctagtcccgcaggtggcgcgggtggtgagattaaacagaaggagaggaccctctcttcttttctttgggcctagctctttggggtggaggggcagggatggggtgggctgaggtaaggtgtgccagctgagtacctgtgggggtgctggggcactccgactcccactgggctcgctgggccaagccctagaaccgcgggggttttacctggttctgaccagggctgatctcgcgtattaagttgtgggtggggaggacgaggaagccaaagagggaagagtcaccgggagtttctcttccaggcgtggagattgatcctgcgagagaagggggttcatcatggcggatgtgagtgacacccctacataagaggaaggggagagtggggaattttgaggggcatactgagcggggagaggtagaacttcccaaacagaaatttgttttgatcctcccagccccacccatcccagttaattattttctctgatatctgaagtgggagactaatatgaatgaatttgcaggatcctgagtttctgcctcgaatgggggtgtaggacactaaggtgcttgagactgagaaaattaggttctccctactccccagtccagctggggcataagagaggctctgtatatttaccatttgaaattctgaatgatggtttgctgcttttcctgtcagaatttggtcagtaggacatgtacccacaatacttttttccagtaagtgataacaatatctcatttggtttattgtagcaatttacgatgatttctaacccatgcctctttagaaacatggtaacgtgtgtgtgtgtgtgtgtaggaggataaaatgatcagtcgggtttggagaatagtaagtgctggatgctcaaaacaagagatacctgattaatccatgtgaggtcaaaattgatacctaaattgtcagtgaaattcctgggataagagagtgtaatgagacaaaataagatagtcttctggccaatgcggttgcttagtctgtaatctcagcactttgggaggccgagatgga

SEQ ID NO: 112374 - DNA, 1655 bp, Homo sapiens
atagtttttaaaccactggggaacaggagtagagagaaaggattccaacgtgagttgacaggattctatccttatttattttctgtgtttgttttacctgctatacttcaaataaagttttcattaaaatttttttcctactaaaatggcttttaggaattgtactttgattttttttaagtcagttaatcaaaatatatcaaagggctcctgtaaagcatcacttgagcttaagcaactaggtgacaaaaattttattcaattagcaaaatatttttctttattaacagaaacagatatgcagtatgcagcaaaagtataccgtgatgatcgactccgaaggaaggcagatgccttgagcatggacaactgtaaagaattagagcggcttaccagtctttataaaggaggatgaactggaatttttatttataccttttagcgtactctttattttttctgtaagtaagtttggtttcatcatgagggatgaaggaaaagatttgatactgaaaactaaactgaatagttggttcctgaaatcttggactgtttatgacctactggctcctttaaatagtaactgaaaactaaaatggaatattttagttaacgcttctacaagtattttcattttaaaagcttacatgattcctaactaaagtgtcatgagaaaggattatcacacctgtagcaatttccagttttagtgattctccattttttcccttgtcatgtaaatatttatggaatgatcattttgtgtacatacaggttactgcttttttatttaaattcttttagtgtttagctccatgagacacttcagtttaaattgatggaataaatgttatatgacacatttacattttccttatcaaggtgtcaaatatgtggactttaaacaatgaaactttttcaaaaagaaaaaacaaaaactttaactttgtgtaaaatcttatagtattatcagcttagagggaattgatatttttaatattgccgttatattccaaaatatatattgagataaatgaactggtgtagaatatcagtttgctatttagttttatgaattactatacatatacatgcatagaaatgaaatgctatactgataaattttaaagaaaatatgaggaaatggctataaatattaaactaaaagggtcttcaacagtaaagtgcagttatgtcatttaaaattccaatactttaaaggccaccaaattttgatgtatatgtccttgaagggctgctaaaatttatgaagaggactcacattttcccccatagaaatttgcagtttcttggtgatcatttaagcaggatccaaagaagttcctttacaaataagtaataagaaaaatgagtactaaaatacagctttgtgccttttaaccctatgccaactcctaaacatataagtagattacagtatacttatctgatcagagcatgatctgtttggccacatgcaagtgtgagcagaaatagagcagcacgtagaatagtaacttaaagcaagtcatcctttaaaaattctgagctaaaatctatttaccattgagtaattgaattaatcccataggaataagctccttgtaagtaaatccatgatatgaattagaaaaaaaaaacagctggaaattgaa

SEQ ID NO: 112375 - DNA, 1054 bp, Homo sapiens
atgaatgtaaatataaaacataacaatcaacaataatgggagtcaatctttaggatctagggtgaggcaatgattttttaagacttaatcccaaaagcacagtacataaaaggaaaagttgttaagttggactttaagattttttaagcttgctctgccttattacgaggatgaaaagaagctccaggatggaaaaaaagatttgccaggcacgtatttgacaaaggacaggtatcttgaatatattaaatataaagaactccaaacactcaaaagtaaaataacagacagtccaattagaatgggcaaaaaaatgaagaggcattcctttgaagatgatatacagagggcaaataagcacagtgaaagattttctctgtcattcattagtcattagagaaatgcaaagtaaaaccaaaatgggatatcactacacatttatcagaatggctagagtgaaaaataatgacaataccaaatgctggtatggatgcagggaatggatcactcatacattgttaatgggatatataatgacacagctgttctgtacaacagttgggcagtttctcaaaaatctgtgcagctactatacaacccagcaatgcactcctggggatttattccagaggaatgaagatttatgtttacacctaatcctgtacatgaatatatatagcaattttatttgtaatagccaaaaactagaaaaaaactagatgttattcagtggtaaatggttaaacagtggtacatccttaaccatggactactactcactaataaaaagaaatgaactgttggcatatatgacaacctggatctccagagtattatgatttacaaagccaatcccaaaaggtttcattccatttatatatcatataatatcccatttatatactgtgttatttcattaatataatattcttgaaatgacaaaactgtcaaaatggagaatagatgaatggttgtcaggggttgggaagggagggaggaggagttggatgtggttatgaaagagcaacatgagagtggtgttagaaatgttcta

SEQ ID NO: 112376 - DNA, 1908 bp, Homo sapiens
aatgaaagtatcttacccaaggtcacacaacaattagtagcaaagtcagaatagtagctgaactttcagactcgaaaaggcctttaaccgctacactgttgccttgccattagtatttccaggttaagaagaaagttatcgatagattcaattaattgtagaaaattattaatgaaaatatggggccacttgttttgttgtctcttaaatttttttctctacgtcgttgaagccctgtgctctttgcttttctctctatcctttccattacattgccttctaacactatacccatgaggacaggaaaataaaatgaaagaaaagagttaataattttttaagttgtggtttaaaaacctgccaaatttacggtcttaactatttttaagtgtgcagtccattagtgaagtatattgacattgttgtgcaaggactcttcagaactttttcatcttacaacacaactgtgtactaatcagacagctccctaccgccccgtctcctaagaccctggcaactaccattctactttgtgtttctgtgaatttaactactttagttacctcagataggtagattcatgcagtatctttttgtgactgtcttacttcacttagcataatgttcccaagtttcatttatgttgtaacgtgaagaattcctctttaaaaaaatactgattaggctgggcgcggtggctcacgcctgttatcccagcactttgggaggccgaggcgggcggatcatttgaggtgaggagttcgagaccagcctggccaacatgatgaaacgccatctctactaaaaatacaaaaaaattagccaggcgtggtggtgcatgcctgtaatcccagctactaggggatgctgaggcaggagaatcgcttgaactcgggagatggaggttacagtgagtcgagatggcaacactgcactccagcctgggcgacacagcgagactccatctcaaaaaaacaaaaaaaaaaagaccaaaaaaaagctacagtaaaaaaactgaataatattccattgtatatatacaccacattttgttaatccattcatctgtctatggacatttgggttcctttcacctcttggctattatgaataatgctgctatgaacaaggatatgcaaagagcctgctttcaattattttggataccaagaagtgggattgtaggatcatacagtaattctatttttaatttttgaggaaccacaatacagtttctgtagcgcctgcaccattttactttcccacgaacagtacatagggtttcagtttctcaccatccttgccaacacctattttctgtttttgttggttttgatagtacccatccttgagtgggaggtgatatctcattgtggctttgatttgcatttctctgatgattagtgatgttgagcatcttttcatatgcttattggctagttttataatatcccatttttggagaaaatgtctgttcaagtcctttgcccatttttaaatcacattacttgttttttttttgttgagttgtaggagttccttatttattctggatattaaccccttatcagatatgtgatttgcagatgttttctcctatttatatgttgccttttcatcactttgttgatggtgctatttgatgcacataagtttttaagtttgttgtagtgccatttttctatttttgctttgtttttttgtgcttttgctgtcatattcaagaaatcattgccaggagttaattatttttgaatcctcccctactgttgaatatgatttcatttagtcattatctagtcctagagggacagttttaacattaagtgagtaggcagtctagacagaataacttggcttttgaagtctgactccacctactagcttgtaaccttatttttgagcagg

SEQ ID NO: 112377 - DNA, 2701 bp, Homo sapiens
caccgtgggtccgattagccttttctctgccttgcttgcttgagcttcagcggaattcgaaatggtaaacttcgcagagacgctcgatgactccgcgggtttttgccggcgagagaaaaacccgttacacagagggatgggggtgaagtggcgacggttgggaacgcgcggagacaggatttagaagagtggggggaggtgttttgtcggctgctagcggagcagcctcggatctcgcggcgggcggcgacggttgggtggcgcgcgcagcgccgctgggggccggcgggcggaggcgcgcggccgtggcgagcgcgcggcggggggcgaacgggcggggtcgcccctgcggcgcgccgcgggccggagaccccggcagggtgcggggacgcgctcgcggcgggacgcgccgcggtgggggatgggcgcgccgccttggtaattctatattctccgttcctcctccgctcgcgggcgtgtgcgcgccgcaggctggcggtaaggctggaaaggactccggaaaggccaagacaaaggcggtttcccgctcgcagagagccggcttgcaggtcagtagttgttcgtgcagtctgggagtcatgatgtttttctttgcatttccttttttgttattcatcgctctcgatgggcgttttgtgtatgcgtgggtgatgcggtgtcgcgacttgggctgcccatacgataaatatgggggggaggaatcacgtgtttcgatgtcgggacgcgttgctgcgcccgtgccccttgctttggcgcgcatataatttccccatctctagttctcatttttgtgcatttatgtttgtgtatgcttaaaatttaagttcccagtgggccgtattcatcgacacctaaaatctaggacgaccagtcatggacgtgtgggcgcgactgccgctgtgtacagcgcagccatcctggagtacctcaccgcagaggtaaatgggtgaacgcctataatccggagaaggtttggggggcggggaggcggcaagagggaaggaggaaagtgatgcaagaaaactcccaggccctgaacgcggcgagaggcctaagagaacgctagagggagctggtgttcaacaaggatcctactgagcttgagttctctgctcttggaattaaaattgcgtgccccctgtatatcttgccagtcagatagtgaggaacgattccagttggtagatctgcgtttgtgagggttttattctgttctctgaatcttggccaaaggaaagttggaaggcaactgacagattctgccttttaggtacttgaactggcaggaaatgcatcaaaagacttaaaggtaaagcgtattacccctcgtcacttgcaacttgctattcgtggagatgaagaattggattctctcatcaaggctacaattgctggtggtggtatgttaacttctaacattttaaaaaatttcttcagaggaaggaattttttgctgcttttaattagtttttccaggagaggaaatttaagtatattttcaatgatggaagtatggttgtatcatgaaatttgatttatatgtataactcaatgaatttttacttcatacttgagctgcatgtttttaaagatacctttcaagttgaacagtatacactttcttggtttcaaatactgtgattttttaaaaaatcttaagtagaattaattcctgtcactctcctaggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaactagttgtgtattaaatttgcttggttgtaataggaacttgttttgagtatctcatctagcagcaataactaagcacatttctttgtgactgaactgtcaaatctgtagatcaacaaagtgagatagcccaagtatatttttttaatgttatatgagctactaaagttttaatttaaaaagttggcaggagctggagtgggattgtcagtttcttaggctaagtgtgaccatttcagtttgtacattggcttcgcttgctgtgtgacagcactgcactagtatgctgttagcatggtggacttggggagggagagaataggtaggaatgtcctgtatatccacagaatgaactccgaatttaaactttaaagataatagtgctacgtgccaggccctgctttgaagtctgaagttgttaagtactcagtaacatcattggggatatactatctccattttatcgaagagaagcagggtttcttatttgaaagtaccgagttatggtagttagcagaattaacagcttggctcacagcattatgtaaaaattgttacc

SEQ ID NO: 112378 - DNA, 1119 bp, Homo sapiens
tttctaattttaaaaagtatggttgcatctgtactaaacatatacagacattttttcctgtaatttcctaaaccacatagtgtaccaactatttacatagcataggcattgtaatggatattataagtaatctagagatgatcgaaagcatacaatctgcataggttatatgcaaatactatgccattttatggaagggattgagcattcatgaatttgggtatccaagcggtggggtgtggggacagatcttagaaccagtcccccacagatacagagggatgattgtattagtatttttgtgacacttatctccacagctaaattgtaaatacagtaatgcccctattgcatatttctaacatagtgaccaaggaaattgttgtagagatttgacacatttttattactgtattgtcttcttttgtctgtatatatgcaactgagatggaaggcaataccatacattataccgcatgatacataaccattccctaataatagaatatatgatagcactagattggtgctgtcagcctgttaggtaaaatagagcatagccatcaagtcattctactttccaggcaatacaccaagaatagcagttgggagatgggatatgtagtgcttaggagcttccctcaatctagctaagaagattaaacagggaggaaaattcaaacaatgtcttaatcattaaaaccacattaagaaggctgttacaggctgggtgtggtggtttccgcctgtaatcccagcactttgggaggccgaggtgggtggattgcttgaggcaaggggttggagaccagcctggccaacatggcgaaaccctgtctctattaaaaatacaaaaattaactgagcatggtggtgcatgcctgtaagtcccagctacttgggagactgaggcatgagaattgctggaagccaggaggcgaaggttgcagtgaatggagatcatgcaactgcaccccagcctgagtgacagagcgagactctgcatctaaataaataaataaataaataaggctgttacaaaataagtatctgattggctgccaaatcaacagtacctctagtttaaaggacagagacagttgcaagctggagcgtttt

SEQ ID NO: 112379 - DNA, 1010 bp, Homo sapiens
agaactaatttacattcccatcagcgtgtataaacattccttttctctgcaacctcaccagtctgttattttttgagttttttttaataatagctattctgactagtgtgaaatggtgtctcatgcggttttgatttgcgtttctctaatgattagtgatgttgagcattttttcatatgcttgttagccatatttatgtcttcttttgagaagtttctgttcgtgtactttgcccccaaattttttttttttttttttgggaactttgcaccatgtttgtaaagcgacatttaaatggtattaacttgtttaactcatatttactggacaccttctaagcaccaggtattaagcaaagtgctagagatacagtagtgaataagactgacttactgcctgaaggaggagataatcattaatcaactaaccatacaagtaaatgtcaaactataacagtgataagtactacaaacaagaagggtatgctccctgagactgtatagtggggcattcgacctagtttgaggtaaaagaaggttttcctctgaaggtgttgttttgagtcagaaggatagatggggtttattaatagatagataaggagggtaggccatgggagaagagtggctcagacaacaaaagagaacatacaaagaccctctgttgtaagggagcctgatctagtcaaggcactgggagcaggccagtgtggcagagctcaaagagtgggggtgagcacagtgagatgaggctactgaggtacacaggggtcagcaatacaacacctaattttaagctggcacatgactacttggaaaaaagactacatttctcaacttcctgcagctgggtttggccacatggttaagttttggccaatgaggtgtaaaatgaagtacaggttgcaatttccagcaagtgtctttaaaatgagaaggcatgtcctttccccctacttcatcctttctgttgacagaaatttggattacatggttggggctcaagtagc

SEQ ID NO: 112380 - DNA, 1700 bp, Homo sapiens
atatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatcta

SEQ ID NO: 112381 - DNA, 1044 bp, Homo sapiens
ttccaaagttaagtggagacaggagtttataatttctttttttttcatgtcatcattgagttgcttgtcaagaagttctttctgggattctgagatggcatggaaatgccccggttaattccttttctagctccttttagctcctgctttaagccctttgctaggtttttaggtatagcaaacatactgattccactgaatttgccattacctagtacaatggaggaatacaaagagggacatgctgcagcctgtctaggttaaggtgtttgatgcttatgatgtggccagttgatgctggttctagaggcttgtccctgaaagcagctttcctctttatgtgtccactttggatttctttgagctaaactttcatgaagacaggagaaatgcttacatcttaataacttcaagaggacattttggttggcaagagacattggctgttttcaaacctttggttacttccgagtatggtaaggagtctgttgtgtggtgtgcaggtcccgtcactttgttcttcactgaaggattccctctcactgagaaatctctaacatcacctgctgcaacagctgtgccctttgttttcctttggataatcctggttttctttttttaatgattttctgtttagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcactttttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaa

SEQ ID NO: 112382 - DNA, 2030 bp, Homo sapiens
taatcacagaaaacaaaaggattatatattttgaatgatgtggggtgggggttatggcagctgttttgaccagtagcttataaaacaataatctttgagctgaaccatgtccctccctcaaatcactttcaggcagcactgaagagaataaaaatagccatcttaattctagtcttcagaagtttgtagccaaaggaaaaaaatgttcatttaaatagtgctttgttgtagttcaacattaatttgtatctctaaaaaatattccaacatgagacagctgtatataagatgaacagttctggtaatcttaaatcaaattgtaacctactggtatttgtatgagaattaacaccagcaaaatattataaaaagttcaaaagcatctagtggctgtggaagtggccgataacaagaatagcgagtatcaagtagcactcaattgatgaatgtgtactgagtgtctgctttgtgccaggcactgtactaggagctgcaggggacatcaagaagtgtccatctccagctgtgttctagcactgctcaaggacagtagagtcgaacctttagtatttgctttttacttgactgttgtttaaatatatagttataagagaactgcatatcaaaatagtttttaatatttattatacataccatatcctttggaaatttcaaaaataataatttgaagttcccctttaaaacaaaattcttcagttgtattttgttcttgcaaggtaacttttttgtttttctcaaaattatgtgcatatggtcctttggtgtgatacaaaaagtgccactttagactcttccaatttgtacatgatttggatatggtaggggaaacaatagcactgtaagagaaaatacaactgcttcctaaatagcagtgaataaactgctatttatgtgggaattctctattcctcttggcaaattctaatctgcagtgtgcattcttgttgatagtttggctgttttctgtggtttctgtgactctgtgttgtgttaagtatactaccaatgtaaattgctaatacccattgtctgaccagcaactacagcagagcacattcttccataccaggatgacaaaaatgattagaaatggagccccattccagaagtatccattgttctagctacatttttaacactcccaccctattggcttttaaaacctagaaatttcacttttaccatttaaattaattaaatcatttcataaatgataatgatgacaaacttttatacctgttaattatgatgaaattatattcacagtagtctaaaaaagacagtagagtaccacttcatgctattcttttgtatttcaaaataattgagttagttttcagggtgggtgctcattagacagctctattattttgcaatttattactaaattagagaagaattaacaagctttgctttgggccttggtctttccccattttcgcatcttattcctctcacagttgactaatcaccattatgctaacctttaaaatgcagaggggggaaaaactatttctcatcttttaatgagtattgaaacaactgtgtatatcttttaggaatctcatccatactaataaaaggcactgcacatttgtgtaggagtggctggtaaagtttcagcttgaaactgctttcctttttttttttttcccccccaaataaggttgggaggataaaggtaccatgaaattatccttaatcagccatggtgatgcagcccaattgagcattggtgattggccctgaaatatctggcttgcacttcacagggagtaaagcaaactgatgtcattggttccccatttatgtgttttatttgcagctcaccagttggtgtactcactgaagaaatcattaagttttttgtacaaatgccttacctatcgctgtagcacaccaaagattactttttaaaaaaatcaaatatcattcccactttgagaattccatgttttaattgaataggaccaaaaccagttcaatgcatttttgctaaatattgtgaa

SEQ ID NO: 112383 - DNA, 1013 bp, Homo sapiens
ttattccgtcaaatcaaatcacttccccttatttttgctgagccttggctgaaaaacttaacatcagcattctctatggctcacttttaacatacagaatgcacaacaaacactttgtattgagatgcctgattacaaaatcaaaatggttttctttatctatctagcttcgatactcaaaagaaacagaacctccctaattggataatgtaaactttatggtagcaatcgtttatggaacattactggtatataaataaattaaaataaagtatgttaaaaaaaattttaaaaaaagatccggagagccaagatagagggaaatgtgggtgcttatatgcattttttttcctttcagtcatttctttctttttcacaaaagaaattaaaagttaatgtcgcccctcattgtgccttccagagaagagagtgagagtgtgctgacgctgaaaggcttgaccccaactggcatgctccccagcggagtactttctggagggaagcaaaccctgcaaagcggtaagcaggctgatgggtatgactgtgtgctggggcatcgcagtcagctgtgtcattagagccctgatttattcattcatttaagctctgtcttggtcttcggttcttcttctcagctggcagaagggctgaaaccccaatcagtttgatcagtcatgtccaacataatagctccctcattctctggaatgtggtctttactccacctttcccccattccctcattcacatgttaatctacatattcagcctagctacaggacaactcatttaggttgcctacatgcacaataggtttgactactttgagccactccgttgtcaaaaacaactttttaatcacatttttaataagtattctggttatgtttcatttatgagataacacatacacacataaccactaaaatatacctgtatgtctagattttcaggagatgatttcattatcctcttgaatggaaattggaagccatttgtgtcttttctctgat

SEQ ID NO: 112384 - DNA, 1064 bp, Homo sapiens
atctctaaatataacatataatgtagtgacaaaaatattttaaagtttagcatacctgtaacctcactggggagactgaggcggtaggatcacttgagcccaggagtcctagtccagcctgggccacatggagagatcctgtctaatttaaaacatgtatatattttaaagtttataatgcactggagtaaaattggggaaatttaaagtggaactcaatttcaaagaaaaaaagaataatataagatttctaaatatcaatgaggattttattcacggacttttctctaagtgaatgatagtgggactcaaattgctgtgatatttatatgccattggtaacagagtaatatagccatttcattttaatctcataatgtttacaacattatttacaactatttaaacatggaatgggaatagtattctttggggatattattttgtagctacatgactaaaaattataaaggctacaattttgaagccattccatcagagtaaacaattatccattgcttatggtgctttttttaaatctaggactcaagcgcctggtggtgtaggacaatgtactgaagcacttgtcacaattcatagccaacagcaaaactgggtggatatctaaagtaacttctgcataacatccctttgctgggatataagagctcaaggtttgttattgttaagttaggtcaggaaagaaaaagacaagataaggtttagggattacttcaactgttggacatgtattttcccaaagaagacagtctttatattcataattttcgtcatctgtaaaaagctataaagaccaattacacaagtttcttagaggtatctgaagtctgttctgtcttatgcattatatcttctatttcaaaggtgctgattttggatggacacaaaacccatttttatctttaatatagcacaacaaaagatactaattatctcaataccttatgcttcatttcatcaagaggttttattcaaattcagtaattgctctgtttggcaaaaaataaaatctgaaggaacattgaaactctgtttaataatat

SEQ ID NO: 112385 - DNA, 1098 bp, Homo sapiens
tgttttctcccttcactttgttacatgttatcatgcagagataacatgtaaatgtcattctagtatttgataaatgtataaatccatatgggcccagaattaagttccagtctgaatgcattcttccagcacttatcacgtatgcacaattatgtcctcagtaaatcctattaaacagttatatcctcatccatgtcaagagcaatctttgattagacatccaggcattatgactgcttcccttttagataataaattgatattattaaatttagatttattcctttttgtttttattttctgttattactttataaaattgatgtgtttttgtcacgataaaggggttgagccaaatcagattttatggctcttaattgcttccttggtaaatattaaaaaacaaaggcagggggagcaatatcctctgtaaggcatgagctgaatatgtgaccgtttcttgaaaaatcaatggaaagttcctaatctactgtaaagtctttcattttcacccagttagaattctgcttatagtcagcttctgcgactcaaccaaggagtcattaaacagacggaacacaacatcttagagaacaaaagtgcatggaatccaattagagtttggaagtgaaagtgacttataattaaacagaaaataaccaaataatgacagttattgggcatttgagtgtagtctgtccatttttaagacttcctatccaaagaatttggttatgttttatgacaagagaggtggagaaaaatttaggctcttctggccttccttaaaatccattgaacacttaaaatccgttacacccttaaaatccattacacaggagaaacttttttaaaaaaaattacattttaaaggctcttctgttgctttcaaagtgggttgtaagacagaatagccttatgccaaatatcacaccattcattgcaggctcttaatatatactgagattgtagtcaagttaaaaaaacatatggaagaaattcagaatatttgctttagagtgatttggagtgagtggctattatgtcccaattttatcacctatgggaaggataggtaatagagttaggatccatatt

SEQ ID NO: 112386 - DNA, 1044 bp, Homo sapiens
cttcgttagcttctgtcttataaataaaggaatttgataggctgtctggaaaaagattgctgttttaaattggcctctggtcttctatgttgaaaataaaatttaaaacttctgttatcttgtaaagtttggaagcagtttaatgccaatgaatgtcttttgatgatctaatttatatgtaatagggtctttgtttcctgtttccacttcttatttcgaatgttaaaatgatagtctggtttcaatttagggttgttattcactggaacactttagagaaaaaagaaatccaagtaaaggtatctcatttggcagataatgctcattaatgaagaaggctcatttcagaccaaggtttagtaagtgattccaaagtagagctaacagaaatcaaccttcattacaagagtttctttattgttcattattataataaggaagtctggagaaacagtaagcattagcaacctagtgatagttttgtaagttaggaatagttatttatctgggactgtcttttaggtcctaaaatcataggcactgagatcacttttttaaataatacaaattatgtttgagactgtgatatgtgataagtctcactcaccagaaaaaactgtggaagttaaactgaagccctgtagaatgagaaaggaaagaaaaaataataaagtgaatacatttcaagccaaatatagtttcaggctgcactggaaagacttaatattaaattagaatttatgtgtctgcttttatctaaagagcaaaccacatggtagaactcttatcctttgtcaacatttttgccttatcctaatgttaaccataagcaagtgaatatggaatcagagtagctttttgcatgcctctatgaaaccatctatgtcctataccagaaaattatcttccatagtctgccttgaattagataattcttcgtatctaataccacaggttccagagtgtctccctacctatttctgtctagctgttaacagttgtacagaacttaaagtgcaaagttgggaattagtgtgactaatg

SEQ ID NO: 112387 - DNA, 1085 bp, Homo sapiens
taatctgtgatttgagttatggacgtttcactggatatattatacctctcttaaagaaaaaaaaaactttaaaaaagtagcctaagtgccttcagaacatgtattctctcccccagcatataaatgaaatatattcaaaatagcaatttcaacatgcaaatgtatttttaaaggagttttcatatccattcatattccaaactagacatcctaaattaacgaccaatttggaaaaatacatatattactttcagattaaggtatagccttagacattttaaattggggacagtcctcccattgacattaataatagtttatgaatatcttccctgaaatgtgagacaagcttgagtaatacaaactctttttattgaaacatgtaagtacagctataaaacccgatctgtagcagagactcattaagctaccggactactcactgaggtaacaggaaacgttacatacatcaacagatcatgatgctttaaggatcgcttgtacaggccatttggtcaacttttcagacatattaatatcattagtcacatgaactttagctaataactataatcagaaagtggtaattagaaacttaaagtaacatatataatttaatgtcaacctattgtttatttcaatcataattacctagagataatatcttgcttgaacaacaaaataataaacatttgttctgataattagtattttctccaaaacttgggctgtatagtcaaacataattagttctcactcatttcataaattatcatataagctaagagagatgattactctttacaagtagtactacaaataaattgtcagcagcttttccctatagatattatccaggatatctactgtattggaaagccaattattaatgtataaatctcattgattttgatttcagattttagtaaccagaattagacttgtctcaatatttttgtagtttttatatcttcttagcttcactttgggaatacaggttttacgaggataaaagggcatacttgtttttcaaagcctgattttctgttccctatggattcttaacaaatgtcagttgacgataa

SEQ ID NO: 112388 - DNA, 1031 bp, Homo sapiens
taccatccacttatggttccataaccctggattatcaacaggaggaagcagatatatacttgtagtatatatctgtggttaacctctaacaaaacctctaaacaaaatctttctctgcaaaattgtagattttggaaaagaagaaagttttggtaaatagaatatccaaaaaccaaatcaataaattcaataaattaatctcctcatgctgagaattagacataaatttagttctttaacattatggattttattgtcttggggaactgtggctattatggaaaaaacactgggttgaagtaaaggaagctgaaagtagtgaggaactccaatggtgaaaattgctaaacgattcagtaacgtcttttctaaaggaaaaattgtgatctgttagtttagtatgaactggaaaaacttgtataagaagtttttctacttcatgcaagtcttccaagatgataaaagccagtattttggagaaactaaaaggtctttatagaaaaataaataatgagtcaagaattaagagcacttgacttctaaatcgtagtattgacacagtcttgctgaacagttttgaaatgctgatacattaaaaatctagttttcatttgcagtttgtaaatttattgtttcacaatttttaacaacatactcctctgtccccagacaacctaattttcgtaaactttaacatgaaattatatgatattataaaatttttgctcattgttaacaagttgacccaatgatgttctttaacggatttccctttcatacaggcaagtaaataggaccaaatgtgtaagtctttgcactaagtgaaagatattgttgagtaattttatgtgaaaatgtatattttatattacattggttttgtatcttctattcagggtgacagctgtatcagagttcttttcaagctattatttgtatagctcttatagtgaaaccttaccctaaggtgttcagtattatctactttggtttacattctctaatgcaataatttaattgccagtatgaac

SEQ ID NO: 112389 - DNA, 1036 bp, Homo sapiens
gcctcagcctcctgaatagctgggattaccagcacccgccaccacacccagctaatttttgtatttttagtagagatggggtttcaccatcttggccaggctggtcttgagctcctgacctcgtgatccacccgcctcagcctcccaaagtgctgggattacaggtgtgagccaccattcctggcctttttttgttttggccagagtcttgctctgtctcccaggctggagtgcagtggcgccatcttggctcaccacaacctccccctcctaggttcaagtggttctcctccctcagcctccccagtatctgggattacaggcacatgccaccatgcccggctaatttttgtatttttagtagagatgggatttcgccatgttggccaggccggtttcgaactcctgacctcaggtgatccgccagcctcggcctcacagagttctgggattacaggtgtgagtcaccgcgcccggcctatttcactttttttaacctcgatgtggactatcaaggtaaaatttttctatagaatgtatatatagccaagtcaaatgtctgcctgtgacaaaatgatcactttgcctgcttttaggcaactcctattatggtatgctagtgtagacactggccttccctgttcttttggaaacaaatgacttttctcttacacatcaactccatctgttctttttcctgtattcttctgaaatttgcaactttacttgaatttgttcagaattgtttaccaagtattgtaaagctctcacctgtatgtgttaaaaagagattttagaattgtgtaaaatcctaattgccaaccgagcatttttttatgtctgtatttaaatgattcttaggactgccagtcttctagagctaatgaatcctttcccatttggcagcagacagcttactgccaacttcctcccatctgataaatgttcccataacaacactaaggcagtctgcttagtttcattaaataccaaaattatagcctgagaaaaatgtataatgtattataccatatta

SEQ ID NO: 112390 - DNA, 1546 bp, Homo sapiens
tatgcatcagaaccaactatggagctttaaagaatatacatgtttagctcctattgtgggagattgttattcagtaagtctgaattgagctctgcttttcagaagctccacagatgaccccgattcacacaccaaggtaaaaacggatggctttcaaatgacacagaaaggagatttcacacatggcagggaaggaatgtaaactactgacaaccacccaaaggacttttctctgtgtaccttgggtgagtattgatagctacttggaaaaatgtgatagtaagtaaaacagtaaatatttaagtattcctgtagatgctagttaattcctttttaaatgggattgaattttagtactttaaaaaataccaaaatgattatttgcccaaataagtttgactagactagaatgcgagctccttgaaggcagggatttgtgtcagtttcacagatatattggtaaatgtatcagtaaataagagtgctcaataaataagagtttaaataaattgaatgaattttgaaagcttaagatatttggggaacagataagaatgattaattataggctgggcaagaatttttgagtgaaggtagatgaaacgtgattattctgttacttttcttagtaaaatccaagtataggtatatctaagaaaagtgcagacatgtagagaagagatgctaggtgtgaggttgacccaagcatggtgaacattttttggcaaatatgaaggcagtctcctgttgttatttttttttttcacctctcaccctacttccatgatattctttcccagcccttaactcctttccagttagttaaattccatttatttatttgtagtaacatgcaaaatgtttattgcttttgctttttaaattctgactgatgctctctgttatgtagttaactgtggctttagaattaccaggaaaaattatagccttgagggtccaggagattaaagcctaacatctcaggtactttgcagtatattctgccattggatctctatgggagattttcaacaagagtcaggaggagttttttttttcttttctatgtagttttatataattgtgggaaaaaatgtcttgatgctctaaattacagacttttgtgttacttgttctaaggccacttttcttttgttatttcaattggtaagccaagaatcttaaattattatctgggagtaatttaagtcacttttgtatcttgtgttacagctgttaattggaccacgtttaagatcagcaaatgctagcaaataaatactgtattttatatggaaaactatagaaataggggaaatttccataattgttagcagagccaaaaaacttgggccttgcctgataattagctgcctaaattcaaaatatactgcatgacacttactgtaaaatgaacagtcttttcagaatcaaaactgactccccaaatttaagaggataaaaatcaccaacatgtcttaaaagcatggtttgtaaattatttctgagtcagcattttttgaagcctcttcttacagatttctct

SEQ ID NO: 112391 - DNA, 1051 bp, Homo sapiens
gagagtgagatgaaatggagggggagtgggtgatcgttcgagagatagttcaagaaagagaagaaaattgtggggagtcaaatatgatgaagggatttgtaagattggtgataacaagaaacagttgatttgaccaatagacttaggttccacagacaaaataagaatcattgagagttagccaggggtcatagaaataattatctgctgactaagagtgaccagggaatgctagttttgaagatgaggaaaggatttgtcagaggtggtttatgtgtggttggattgaatctgaggaattaggacaagaggggcaatagtaacacttccattaatatgagggctgtgtgaagaacacttaccaacttgagggttttatgttagatttagtgatgtctaggtgtcatgacaaatgtaaatgcttatttctagaaagggaccagtggtaaaattatgatgggaatagacatggcctttttgaggatagacctttagaggtttcggagttgacttactctggataattatgcaatttagaatggtaaaggcaaagagaggaagggttttagcaaaatatgtatcctgattggtcaaaggactctgggagcacagtaccaaaagtctgtccagtagaggtcaatgggagacagtgtgactatatttgttagatagaatacattattttcaggggcagtatgaccatgattttaaataaaaatttcagatgtaaaggtaagtcttttttggagcagattttgattttttgcttaattaatcaaggcctaatgctaaaactgttaagtattcatcatgctactgacaaataaaatctgaatatttgcatataaagtaaaactgaaacatggattcatgcttgtgttctagattctttcacataacaactgcattttatgtgtaatgggcatgttttaagggtaatgctttgccacctagtgagaagatcattggctttagaataaaacagacataggctctaatcctgcccacaagttacctaacatgctcctcatttaaacttctgtgcaagtga

SEQ ID NO: 112392 - DNA, 1036 bp, Homo sapiens
gctggaaggttagggttaaatattaatctctataaccagcacttactctgataccattctatagggaatgggggttgaagggatctttgagcaggagagttacataatcatgtttgtggctggaatagtgtcctggatgagatgagtaggaagaggtggggaggaattcttaagagtggggtgattaggaaactttcatacttgttcaaggaagccatggcagggtagggggatttaatcctatttttattacaagaccttttataaaatgagtgttcaagttgattttaaaacatctgattagtttgtatttaaaacgttaatatctcttaaagtcttcttgaaaacagtaagatgatttgtgcagggatccaatttacatttctccctgaagttctcatattttcctgttttcctttcacttagcagagaacattccactcatttgtaatgcaaaagcagaccgggagcttaggttttttgaatagaatgatttagaactcatgttctgctctctgggcagaggggataggccagcatcagctgggcaaactgctaatctctctggtttgcctgtttcctgcagtgggggatttgtccctgggtcagcagaggattccctcagtgccggggcctgccatttagcatgtcaggcagttgccaggagaaccctctggctttgttcctggatgtgagagtggactggtggccaagtttaaggtcatggcagtccttcccttacagcagctgacgtcaattaggagaattccccttgcctgcactctgaggagagttaagcagggataggaatctggtgtcttctgggacctaaaagatcagtgtttattctcctcatagtgtcatttgtcactatgaagcaatgtggccttagtttatatggagataaaatattttgtctggggcattttgcccacttgtgattttagtggccaaatctttagggcctgtcctgcagccagagacctattttggtacccagcccactgctggcaagtcagcacatttcagtcccagc

SEQ ID NO: 112393 - DNA, 1031 bp, Homo sapiens
ctactaaaaatacaaaaattagctgggtgtgctggtgggcacctataatcccagctacttcgatggctgaggcaggagaatctcttgaacccaggaggtagagggtgcagtgagctgagactgtgccactgcactccagcctgggtgacagagtgagactccatctcaaaaaaagaaaaaaaaattgtatagtatacagcttctaataccagagactttggatctactctttatggagtttgcttaatttacaggttttcatttttgaagaagctaaaaatattttcctcttaaatattattctgatttagacatagaatagtgttctttttgatataaagggggcatctaaaagtatttcatatatattagtgattgctaatttcttttaaaattattggtcttcaaatgaatatttgaatttgactgttaagaaagagataagctcttttgagtatcagactacacctttctttatcaaaatatcttgaatgattcccattctagagagattgacattatttacattttatttttgtctggcaatgctattttttcttatttgtaattcagaagtattaactatgtttagggtcaggtagaggaggaattggctcgaggaacattaacccaatattggaccagtggtgagtaagtcaagccagagacttactctgtaagttactgaccgataacttcttttgtggaattcagaaataagcgtagtagatatgtaaactctcaaaagaagtgatcaatattttataattaaaaagccactaccatattttcctctagtccttccctcctactttttattaataaaaatgtttcagtctcagatgtttagagaagagttgtactaacatttgccatggtttgcccccatttaagaaaaactgaggaattaatgtcctagttattggaaatctagatattccttcattcttttagcattttttaaagttaaaatgaacaaagactttctcttcaagtgttcataagacaatgaaaggtttgggttcatttag

SEQ ID NO: 112394 - DNA, 1091 bp, Homo sapiens
taacagagggtgcatcaattcttcgacaggaaaaaaatttgctggatattgatgcgccagtcactggtaagtcctgaggagggaggttgcccacttgtatacacattttgttgtttatagcatgaaatcaaaagtcctagttaccagtgagtcttcaaataccttacccatcataatcttttactgttgaatctatacattagagtagtaagtatattatacatatatacacatattttcatgtgttaaatatctgtaagattgcaatgctctaaaaagtggaatgcaacttagagatggtgatgatttctgaagtgatactttaagaagtgatattgtttttaagtagaaatactaagtggcacacaggatattcattgggaaagattagacaaagtatcccgagacttccacaatggttgagtaagggtataagttaaaacagtggttttcaaagtgtgatccccagactgatagtatcatcatcatcaccatttgaaacttgttaaaatatgcattcttaggccccactccagcctactgaatcacagtacctggggtgagacccaacaatctgtgtcttatccagccctctgtgtgattctgatgcacattaaagtttgagaagcactgaactttcggaagaaggacacatttttttctcttttgcccgtagcattttgtccctacaaaatatcttttttttttttttttgagatgaagtttcactcttgtcaccaggctggagtgcaatggtgcaatctcggctcactgcatcctccacctcctgggttcaagcaattctcctgcctccacctcccgagtagctgggattataggtgccatcatgcctggctaatttttctatttttgtagagatggtgtttcaccacgttggccaggctgctcttgaactcctgacctcaggtgatctgcccgcctcagcctcccaaagtgctgggattacaggcataagccaccactccgggcctttttattttttattttatttttcgtgttttagttttgttatttcttatggtcagatacatattttgtgtaagtatgcttctcttaggccataaaaatta

SEQ ID NO: 112395 - DNA, 1063 bp, Homo sapiens
tagagagacacaattttttcttactacttatatatttttttctcatcatctttaaacttgttctttagttttgcagtttaacactttgccaactatctcaagcaaaaactaataattataccacctggtaagctcttcagagcttgggttggcttatgtttgttatctgtggcccatttcttcctgctcctctcactgcctagcatgggatacagtgcatagttggtgcctaataggtgctgctggttgattgattaattgatatagtttgattagcatggtggactgtgacatacacaaatgtccacaagggaatagatggtgttccaatctaaggaggtcaggccagaaagtgttttaagctgtgtctgacatgtgatatgcttaagctgttctcttaacatgtgctgacataagtatctttgacagtccttgttcacacagtagccacatgaaatatgggacaagagctgttcctgtacatgtcctgattccagagagggatgaaataaatgtgtctggacttgcgaagacattgcatctgttgtggttgattgactggtgtggagcttgttaagagggaaaattaaagtgcccagcattttgtatgcgtttacttatggtatggatcagtggatctcaatctgaaattcatatttgtgtaacctgggattaggtaaaaataggccaatgccctggccctaccctaaaccagttaaatcagaatctctagacatagggcatgggcatcatcttttaaaaaagcaattctcagtgtgcaaccagttttgaaataggttgaggttttgtagaaattaaaccaaagttgggaaagaagaaaggctaagaaatttaatttccactcaccttgttctcatttacttagaaggatgcagggtctagaataccactgtccagtaaaagaaagctagataagcaattttaaatgttctagtagacatattttttaaaagtaaaaagaaatagttggaattaattttagtaacaaattttatttagcccaatatgttctaaatattattatttcaacataaaatcaata

SEQ ID NO: 112396 - DNA, 1039 bp, Homo sapiens
ctatatgtgataatactacataatttagtatataaaacaagaggggagacgtagcagattatgaagaaaaagcagtggtcaaacagaaaagaaagatttagttgaactttaaattataatccagtgaattccttaggaaattgatgaggattcattttcctaatcgaaatttaattgtgttgtgttttctgtttctccatacatgtgttgtctttattaaatgtcatttatgtgtatgtatgtatgtatgtatgtatgtgtgtatgtacacacctacctaccattacgctatagacatctgtgttttcaacattgaacctatcaatagagccacatttgttttatttttggaatgcttatttaaagtagatcatgtttaattgcaaaagaactataaacatttgtacctgcagtactgcgtcgtgtccatcatataaaaaaataattatcctgaaccatggacatgtttgtggttgtaaatctgttctcttttctctgcttgaagtgatagtgtttcatgatatcagtattcttcaagcatttatattagaagacaccatgaatgcagaggtgaatgaatcatgttcttacatgagagatttaactctgagaggccattgtaaataggatgtctgtacattttgaagtcttaggcttcatatgaaaaaaaaagaaattcctgtaagatctttgagtaaaaatgttacttgtaaaggatgtgccaggtttcaaggacttcccagtagccatagtatgaatacaagaaacacagttgtgcatttggaacttcaattcagttataccgtgaactgaattgatgaatttactgagttagaacttttttcgtttttttgacagctgttgaaaggatctttatagagactccttcacgtagcaaaacttttttatgtatcagtagtctgcagcctctgacttagaccatttgtgttacaaatatgcactacgtattgcacagaagcctgggttattgaaacatgtaaccatttcaatatcaggaggttctgcatttttcctgttt

SEQ ID NO: 112397 - DNA, 1045 bp, Homo sapiens
tctggttgacatattaaaaatttctagacgtatgactaaatgcttctaaatattagaacttaaggtttatgaattattgaggcatttatgattctgctgcaaaatagattaaaaaataatccagatctcatggaatcacactgttgtgagttctgagaccttaaacaaaaaacattttttaataaagaaggaactgtatttatctagccacctctctttatgtatctcaatactggtgataaatggttccaaatatagttttttcttctttttaatatctctctctctttttccaatctcttgggcattttcttctatcctttcccaatttttttcgttactatctcacttttctttttgccctatttgccttaaaaacaactgctactcacaaagcactgtctaccttttgatttcctccttttctacctctccccattcctactgcccttttcaccctctccattgtggatgaaactgggaatatgtacagtacagaagggaacagttaactcaacatttggcccaagggttatagtggagactgactcctaagagctcaatttatactaatgctgccttttgattcattttttttttcacccaataccatactgccaaactccctagttgtttcttcaagtcagggtttacttttgcaaagaataaatagatcaaaataggaagcaaatacagttcttgaaaagtacaagaacttttagagagaagaggctatcataaaattatacacttttgctagaatgtttatctgattcttatatacttggtaattaaattctgaagaatattcactttctttgtacaggggaatcagcagcatccagaaccttgtatagatagctggcttcttagacccagcctggagactcaagctgtcttagctttggggctggacagttgaaattccattcaaaaccacaaggcatttttcttttaatgtagtttggtgtgtgtgtgtgagtgtaaaataatgaataaaagttgtattacacttgtcgtgttcaatttgtcacttaggttgtat

SEQ ID NO: 112398 - DNA, 1019 bp, Homo sapiens
attaaaaaacaaagtaaagcaaaatctcatttgtatagttcatatttagataattaatttgggtagatagcagcctaatatgtagaaatgaagaagttattttaataaatactagtaaatctgtatggtgtttttcatttattactgataatttctttttctgttgttagaataccagaatatagaccattaaaaatggaaaaacatcagttttaaaaattgacattttcagaataaaagaacaaaaaataataatagtatgtttttatttaaggtcatgaaactaatttaaaactcaagagtgttaggaaggaggttttatatagaaatggaaatgcaaagagatattccttttttctacaaagctgatctgtggtatgaccataagctaattgaaaagaaagcatgtaaaattaaactcataagtgtttggtttccatgtggtcagtcataaggtattgagaccaaaacctgactcatgtatgaaggaactaaaggtggtcaggttcaaggccttccaactagagataaagcatttatttctattgcatatactcttgctgattttattttgtctcttagcattgtcactttgtgtgaagtagctacaatttttttttgaagaaaataattccaactttgcccagtggccaaaaattatactttaactcctgacagactatataaaaaaatgtgtgcctctggtcccaggaggaaccaaatggctcagtcagcacaattcatcattactactggcaaaaataactcagcatgcctgcgctgcttggtggtgagtcagtggcatcatattcatatactgacagcaatttttttctttttaggaattaccctctgtatcctgagccaaaacacagagcagtaagattaaattaggtatcagtgttttaaagagcaaaggctgatgttattttaaattattaattcattttaaaaggtcaagtagggtttaggtgctgaggtgatgacagaggtcaatttgatgatggtcttgatcttgg

SEQ ID NO: 112399 - DNA, 1023 bp, Homo sapiens
tctctgaagaatagtggtttccttttaattcaaaaattgccatttattccagagcagttatgtattgcatgcattaaaagaatcatctttaattctaacaagaaaactacatgaaggaattctaatctagaaatttaatgcatatttgggtctgtctggctctaaaactcaagttatttttacatcatactgctgtcaggtgacttcttccacattctaaattgcaaatagtcataggatgttagagacggaaggaacgaagtattggtcatgtagtaaaactttttggaagggccaaaagaggtttatggacttgccaacaaccaacagatagtggccagactagaatttttgtcttctaattactgatatttgctgtttccaagctcctttccgttaccatttaggagcagttaattaaacacctactctcttgggacattgtttatattattcaactctctctctttctcatatatgtgtgtgtgtgtatacacacatatatagagttttaaaaagtgtgtgtgtgtgtatatatatataggttttttgtccctcttcaggcagtgcatagtgaagtggcatatatatagtagcactcaataaatatcgattagtttgctgctactattttgttattgtgttcttcagtattgctattttgctcttttagccctctgacaactgtaagcaactttctatattaaaattcttttgttgaaatacctacattgatatctagtttcctgattataccttaatacatacaaaataaatcagaaactgaatgaaaaaatatgtatagggaaaacataataagctgcatcacttaaattttgtaaattctttgctcatggtaaatatagaaatgatgctcatactgtgtttagtacaaaatgcagaatagtataatgggacataggaagggttggtggggaaaaaccttctgtgatggcaaagaagtagacatatattaagatgacaaggaggcctgtaatcccagcactttgggaggctgaggtg

SEQ ID NO: 112400 - DNA, 1034 bp, Homo sapiens
cagatgttgaaactaagggtatgaggatatgaaagatacagccacaggtacagtataaaacagtaagaagtagagcttggattagtattcaggtctgtctgactgtaaatcctaggcattctcataacaccacactgcgtgaccttgacccagaccttgacctaggtgcttaacttatttaagtgacagttcttaatctataagaaaaggcttagattaatttatatcagaaatctcattggctctcaaattccaaaaactcaattattcttgtgtttaaaactgaaccacgaagcactcatttaatatttattaaataacattgaataaactattaccatcataccttatacagcgtttcagaagtacaatctgtagacatccaaaatctaatgttaaatggctagcactgagaaaagtaaagaaacagtaatttgctatataatttgggaaaaattcactagaaaattagtttgctattttgtattatgttgtaaatgtattgagggaactgtcttcaaaatataaaataatataaaatactaacaatttgttttgaatagtttagttttgtcatattaaaacatgatataatacattatagtgctaaactgagattgataatataatgttgttggtttctgtcctatattaagaataaagcaaagcaatgtaaatattttaaaagtcattttgtagaagataaaactgaaagctaatgttgactgaaagttctctgccatgtacttaaaacccagtaataactgaaatgtcaggaaattgaaatattaatattttaccctcacaaaatattaactccttatgttcaatactttttttttgatgtttaactttggtatttcaaggaagaatgaatgtactaaaaaacacacacacacacgtctttccttttgcaatgggtgaaaatttctagcaatcttgttccaaggtaatttattgtattttttaatggatgctttaaaataaggataaataataccaaaggcattgttttaaaaatattttatatttta

SEQ ID NO: 112401 - DNA, 1067 bp, Homo sapiens
ttacttcatagatgggaaacgttaaatgcttattttcttttgtcctcaccatctctattagtctattggtgactgaatctgctacctaggaatacaaccctaacattacagtgcttctcagggaaccagaaaatcctacttgtaaacattcccaaaacataaagctgtttcatattaggtctattgactccttccatcattaaaactctgcaatcatcatatctcagtttaacttcatcagacttcttaatagtcatttaaatggaaatttctattgtagatatggtttatttggtatcagtgagtactaacagtagtgagcaggcagccttgctagccaaatatttgcctttggagttggccagtgattttgattgctttaaagtacatgtagttacatttctggcaggtgggtatttaccatttctagcaatgtttatgtaccatcatgtaattagcaacctgttgtaaatcatccagccagtgatgatttgccagaatgaacaatagctgagattatgcattgctgactttgctattgtaacccaaaagacaacatcctttttcctggttggtaggagtctcttcagacattagatgatttttaaaaagttaactctatagactctgactctattcagagagcaaactaatatagcatttttattgtgctaatagcaaatctctattaagaattcatatatgtacctttgttacgttttgtaatatgttttcaataaaaatcttgatgtaagaagagtggtgaatagaacatcagcacccctgttcaggggcagaaaagaatataaattgttagggatactggtaatccaccaattactttaactatctaatgaccatagtttaggcaaaagagagaggaaaatgatttaaaattattcattatcgtatttaaaaaatggaggaggaagagaaaggtgagaacagtaaagtagatttgatgcttatttaatgcctcccttgtgaaaaaataacattaacacagaaccaacagtgattatggtaacaaaacaaagtaacaagctaaacatgcttatattttagta

SEQ ID NO: 112402 - DNA, 3564 bp, Homo sapiens
taattctgggaagaataatcattaatgcttgattatttcttttgatagctttttttttgggtggggggagaggggaagttaaaacacacattgactgtaagtttttttagaaatgagttcttcagaagaatgtgtgagaaaactcatgatgattttatagttgatttgggaatttgcagagctcacagttaattagatatttctaaacttatatgtaaatttctggtaatgctttgcaatgagatcactgatacttttgaagaaagtgaagttctattttttaaagtgaaaataattatactacattagtcacttataaaggacaatgcttattttttttcagactgatttgctgaaaagagttaactgtggtgtttgcaaatgctttggaagaaatgcagatgtttggaaaatgtcttttaaaaatctggaagttgtaaatattatgcagcaataatgttacattatggtagacagaatatcttgttacaaatactaaagagtaaagaaatttatatttttgctccagatttaaggatttgagtctggagtgctcagtgctagatatgttgccttcttttatggtattttctacaataccatactttcaatactgtgattgaaaactgactatacttctattacaattcttgaaggagtttacctctgatatgctgtaagagtctcatctccaccatttgttttaatcttggtcaaatgatttagttagccagacctcagctccttatttctaggagatatgaatggtacctacctgatgcagttttatggaaattaagtaaagcaatacacataaagtgtttagctagagactgctatatagtaaatgctcaacagaagttagtgatgatgttaccttgcttgtggaagatcttgtcaaaaaatcatttgttcttttgccattggcttgtgctttctctgtgaaaatgatacctctaaccccttttcttttgtatcctttcttttaagaactcatttattccctgggacagtggaagtaattaagtgatttactttagtggaacttccttctagcttactccagatagaagtaaccagaaagtaggtgacaatgttaattagaaagataaattaataccttttatgtggataatttacctgatgataatgactgagaaatcattgtgagattgtcagagggcagtttatagaatgaattacttttgatgaacgaaggttgctttttcaggggcagaagatagtttggacttacattttagagagagagggaaagttacaatatgctgctggcattcatcgtttagttaataatttggctcatcagggctgaaacagagtttgcattttttgatgaaggatcatttaatataaaggcttatttagatgacctattgtcattccatagagatcttgggtatttccatatggactagaatggtgctaggaagtaaaagattttctgggaaatcagatgtgctattttaaggaatgattttatcaggtcatttaaattttgtgctagacttccaatatttttgttttgttttgattacgaagtgttctgtaagaccagaaaggaagccagcatgttaagaaagttttaaagttattatatttctgatactgcacgtatacagacacacacatacaaacacaccatttcttttccatctctgaaaatctaaggtaagatttaaattacagacagtatgaaatcctgtgatgccaagatctttattagaatagcagtttgcacctttgtcgttgatacgatttgccccgtattcagaagcctgtgcagctgaagatgagtcattaagagaaactggaatcagtaaaactgcattttacaataatgctttctaaactggtcaccttgctaaaattggatgaggctgaagacagcagtttctgccttgaaaggaaggagtaattactattaacattggtcaggaactttcttatgttcgtgccttgacagctcttagcactttatttaaacatatactttggaaacaggttgtgtggcttgcacagattttaggggcatgaagctgataaagtgggagcatattcacaatataccagtgtaagagaagagagcgtgtggcagaagattgacaacttattttaatttgccagtccagatcttctgttctgatggaaagtcaacatcctttaggatggtgtgtgtgtgtattttagtccaaggaatctaaaacaactttcagaatttgtaaattttcctgaacataatgatttcaatgtgacactataaataaatctggcttataatgatgtactttataatcctgaccaggttacttttacgtcatgccagaaacacattttttaagctagcacttagaaatattacttttagctccagaaaataaattatctggtacaaaaaagaacaaagttttgacctgtaaggaaatggtgcccactgtggggactggtctgtggagtggagggcaactgaacttactgggatttatcgatctccttggtgatcgtggtccatgtggcatccaggctcattgtggatgcttgcttgcttgctgaatgaatgaatgattgccttcctgtcaactgggaaaggaggaagaaaaccatgaaattgaaaacaaacgtgtttagcagtaagattcctatccgctgggttcatgacccatgttctgactagttatcacaattgaatttatctcaaggacacatgagaggaaaccgttggtatgtggggggtggctggagaggaatgatgatagaggaggaaagtacttgtagtgtgactttcctcagagtcaagagaaggaagtgcttgcagcaataaaagtatttaaatataaactgaagaacacctctggttcttgtttttggtagatggagaaacccagagcagagctgaagaggtgtcatctgctctccagatggagtcagctgacaactcagaagcagaaaccaggtcttctgactctgggcaaatgttagatgctccctttagtagcaggaagacctgggtggaaatcctgatttggagtgtggtttgttgggcttcaacagttcacttgtctggtttctcctaaaagacatttgatttcacagatgtttaatttcttttgggaaaggaaactggacttcattgtcaagcttgagagaagagccaggcttaccatttctcctttctttctgagttttagcaaaggaagtctcaagctcttcaggtaaagagatgaggaccaggaaatgggtggtggtaaaggagtagtttagctcagtagtaggtaaacaagaaagagaaaaaaattcaaaggaatgaaaaattcctcaggaggattatggttttgtgttaaagtcacacatttcttatcaaagcagagatcattgattagctaactctaatttagatagtatttactgtttccagttggaaagttagtgtctaaaacattgagagatttgagggaacatataggttatcttcttgtccaagaagaagactcaggtgtggacagtgcagctgcctcttgtccagcccttctctttccttttgcttgc

SEQ ID NO: 112403 - DNA, 1100 bp, Homo sapiens
catttcagttttcatattaaactaaagattaaaaaaagactcaattcctattaaaattaaaaagtcaaaaaattcaaatgcaactgtgagctacagtgacttctcatttactaataaagtgctgggtcataaaaaataaataaaaaggaaggacagacaacagaaacagttcctgccttgggggaaaaagacatgggggaaaaagatatgaaaatgattcatgccttatttcatttatttgatgtaaatgaagaactttatgtgaagacatattactttttatgtctattttgaaatctagacatagacttcgatattggggtcaaattgctaatttaagtactgtgagaatcagtgtactaagctaatcttgtgaaaagatggttttggatggagactcttcccagtaattattacggagttaaggcaccctttttaccatcttctctgtcaacctaactgacatgaatttctaacctggtaaagtgagaagagtgatcaggagaagataatttgcatagtatatatagatttctattccatttatataaaacccttgaatggtaccttagtagaaacaatataaaataaagctaatatgggttagatgataatgtggttaagtggatttttttttcctgtctgaacaaaagaactgacaatttaatcaatagacccctgtcagtctggagagatgcttctagtggtcagcacggcactctggtctttgtgtgtgcatatgggtgggggcagggcagggtgttgcattttcccattaatcatggtaaacattaaaaaaaaaacactagatatcaaaatggaaatgtaaagttgacagtggaaaacaatttagaattttagaaagttaccttaattgacagtaaggaacacaccttgtctgtcttttcttgtgagccttattgccctctgtgaaggaagtattaacaaaaacatttgtttgttgattataagattgaatgagatacaccacatcttttacagtaacagggacaagaatggcactgatgcctagaccccactcttagaaattctgatttaatttatctggaatggggtctaagcagtagttttttgtgtaa

SEQ ID NO: 112404 - DNA, 1069 bp, Homo sapiens
atttattcatgtttccaagtgattcatgtttagttatcctttccttgaatcaccattcattaaaagtggtttggtcttctttatgcctatcttctctgtttgtgataatctttctattctttgggattcaggtcaatttactaagaaaaactcatgattaaatatcttgaagaaagcagacatgggctgggtgctatggcacacacctgtaatcccagcagtttgggaggctgaggtggaaagattacttgagcccaggagtttcagactggcctgggcaacagagcaagaccctgtctctacaaataaataaaaaaaataaataaaagagtagctggctcccagctactcaggaggctgaggcaggaggatcgcttaagcccaggaggtcaaggctgcagtgagccctgtttgcaccactactgcagcctgggtgacagagggagactctggaaaacaggctctattgcattatttcatatggctaacaaattataacctacaatacaacaaaattcagccaaattcttatggatatagtggtaatataaatttttggtttctctcctgaattgtttttcttttaatcgtctagaccagagctgaaggctacttccccctcagagagaattgtttggcctaaaagagatttaaacagtttgtattagtttccatcataggggattcagaagataaaatctgacttttccctgctacctcctttaataagggcatatatcaccagaactctaccttgcctcctctatcctgtcttccctcatacatgctatgtttactttgcctcccctggctcctataggcatttgagtttgttgtcttttcttgaatgattaaatgagatatttgcttagtgattatttgaacttaataaaccattgtgagaaattgaaggtcactgtgcaactgggcttttagaatctggatttacactgagactgagggacaaagatctgcacaacaaactgaattttatgtgcatttgtacattttgcatttttctgtatgttaaatagtaattgcttgctggtctcaaaaaactgattcatga

SEQ ID NO: 112405 - DNA, 1217 bp, Homo sapiens
catttttgggcccatcttttacccttgtttgtggtttatctacactatattagtttatggggagacctttcctcttaataaatagcaggaagctgtccacttccagtggtgctgactcatgtagcaacaggaagaggaatgattcctaaagatgggaggggaaggggcatgatcctcttccctcccttaaagagacaaattcgggacagaattacaaagcagtttatgtgatggatgagtaagccatgggttaaaagattttctccttaattatgcttttttatttgtgttttattcttactgtactggcttacccatgtgaaagcaattcctaatgcccactgccttttaagtttatgtttactttctctgattagaagattaaagagaaatatcatgtttacacttacagtcagtattaacttctgcttgtaactggtggtatgctggtgggaaaatggttaactagcacttaacagtgatggttggcaccagtcagttcttattggttgaatcgaaataattactgaaaggattttaactatataagatataacttactagctaaatgcataaattgttagtatgtgtcatgagtttattgtcgactgaaagctgcttttttaattatcaagttttggaaaacatgtagaatcctgtaaagagaaatccagaagatttgagaagacaggtgggagtgctgttatttggagaacagtttctgtgtgtgatgtgaactctctgaaagaccttgaggaggaggaggtgaacatagatgaagtggctggctgaggtgggaggattgcttgagcccaggagtttgaatctgtactccagccttgggtgatatagcaagatcctgtctcaaatatatataacagaggtctaactaaaaattattagaattgatttttacatgtagtttatggaacaattcttaaaaattcataaagtcacactgtatttaatctactttggggttcaaacttacaaaaaggacttttaggcaatgattttttggaatgtaaaatataccataattaaaaatgaatattatcgaattgttaagtcttatgtagggcatcaaggacttcactagcccacctgtaaattaagaaataaccattcagattaaacaaagcaagtataaaggaagttggatggaccctttttgccaatatgcagatgtatcatttctagaagatgtactttaatta

SEQ ID NO: 112406 - DNA, 1051 bp, Homo sapiens
gattcttgacttagaaacacataccagtttgtattctcaaaacaatatctatcctacttacatctatcaagtcatgaattggaggatcaataatgaaaatttataaaattcttgtcctttgaactcaggatgatctgaaggtcttatagtacttcaaatgaccaaaagtcaatctggagaatgttcttttggaattctgaagccaatttagtttctcttctgctcccttcctgctttagttgttagcttttcgttcttacctgggaatagtttgctccttgtttgtcccctttcagctaactctcttaccttaagggaacattaaaaagtatttgggttacaagttatttctccataaataaagtgcatgtgtatcaacagagttttccattaagaagatatgatacagtctacccacagagagtttttgtttaataaacacttccttactctgtgccaggcaccgtttcaagtactttgtagatattaatgcatttaatctcatgaggtagataacattattgtccacattttgcatgtgaggaaactgtggcacggagaagtaagtggaggaactgaggttgtctgactatataattttgtgtgctacttctctgagcataagagaaggatcagtactaaagagaagcatgcaaatgatcagtaatgttgaaaacatacttttcttggatgaatttctgttgaatagataagtgaatcttgatatgattgccttattgtcctacgtatcttgtatattatagaatgaggcattatgtctctggaatttatccaggctttgggggttaacagaattgggtttaaattctgactgccacgtacttataattcttataattatttataattctaagcaatgtctttaagtataaaatggaactagtagtacttcctaaggtagttatgggataaatgagataatgaatgtaacaggccaagtatattgaaggcattcaataagtggtatgtagtattaagtgctataactaggatggtagaaatagaagttgtatagtggaggagataaacc

SEQ ID NO: 112407 - DNA, 1028 bp, Homo sapiens
atataacattgccgacacacctcagaattatgggtaggcctggttggccttcatgatcagttgtttttcaggacacaatgaagttaatattccacctctgtggtatccgcagtctgctttatagcagagcaagagtctcaggaaacatagtttgagagctccaagttcaatatggagaggtctgtttctgagcagcagctatttctaagccactgcagctgggaaggtggtagagggagtgatgaggaggggatcaggtgtctttggggcagttaatggacctaattctgagggttagtgagaggcaaaatttggggtaatggggtaatagcagagggctgacaaatgacaggtagactaagcaatctttaaataaaattgaatatattttaaagacatgcttacctcattgtaagcttataattaagaaactgaatatggcaaaataattgcagtgttaaatttatttcataacattgaatttaaaagtcgtagttaaaataactttttaatttttttatttttttttttttttttactaatagcttttaaagtttcattttttatgtttggtgccagaattaagaagtggccctttctccgtataaagcaaatggagttttatatgctagattcaatgttgtgaactgggaaaaacatatctggttttatataggctttaagaaaaatcaggactgatcctaggaagattaggaaggggatttataggactaatatagtcactatctcagtgttatgacttactgctttggttttcatggaattttcttctaaagaacattgtgagtcactggtgtagacagaatcctgaacactcttagaccactgacaagtagaaaaccctgtttgcagccagcagggtctgtgatttgcccatagtaggtacttaataaatattgttgacttgatttggcttaggtttgtcactggaaaatgtaaaagccaatgcacatttatagattgatttaaattttggggagcatttttgctatgctatgtacatttag

SEQ ID NO: 112408 - DNA, 1038 bp, Homo sapiens
acctccttacgtctgctcaaatatcactattctcaatctggctactttttcttcttaattttctctctaatgcttatttgacatgccgtatatttgtctgtttattgctttacattccaagaatatatgctctaagagggcagtgacttttgtccattttattcgctaatgtgttcccatttcttactacagtgcctggtccatagtaagtgctcaattaatatacattgagggaaaagactacatgaacattactaccacgatgatgttatagttgatttcagttccaggaactgaaaatgtgaaagtgcttccgtcaatttctcctttgaaacttcactttagataacttacttctttagtgagaaacagcagccccttattcttaaaggaagatttccattgtgtgcctttttcttctgcagctgtctctgagcaaattgctcattctagcttcttcttggaatgagtctcttctctgaacttctcttggctcttccctctttcagcttggcttctgttcacggagcttagttctacttcctgacctcacagagcttgccctttttatagtaaaaagcctgtggtgatgtcattggctcagctggtttcaatcaggctgctcagttgaagctgatgaatgactctgcaagttatcttttggagggctgtacttattctgatacaaaatacgcagttatatacagcattaaccatttagcaattatcccatgtgagtcatgggaatgctttttcccactctttactaacggaaattctaattgatcattggctgccccacaagcacagcagagtcaggtatctgatgttggtcaactgcttactggctcttactctgcttctaactctctaggacctcctgcagcctttctcctgcctgttactttattctgctttctaaatgtcattccttagatccttaattaagctaccccaaacttgtttctcaccttgaacctctgccttactgttactcatccatttgctgctcttggatcacacatttttttttgacct

SEQ ID NO: 112409 - DNA, 1960 bp, Homo sapiens
aagcaagttaaggataataattatttaaacataatcctttatgtcaaaattaatattgcatgaattttgaattctatatttacctgaaagaaacctgtaaaatctcggtgctgtgtggacgttacagattttagtgcattgaggtgtgagacagtgagtacagatagagggagacaagatagagaatccttgtctcccatcagtatttgggtttgtgtttgtgtggttttcttgctgttgttagaaacaatacgtttcttaagaagatgccaaaagaacttgctttagcaagttgacatctattgatgaataagtatgacattttaatccccatattttaaatgatgtttggttactatttgtttaaaagcaactgaataaaaacatcttcagctatccagattccaatctgtacagatgactaatcatgtggaatatttgaacataaaggttctagtgaaaaataaaaattaaaacaaaaaatgtagttgctcccagatttgaaagtacagaatgttttctgtgccttttagatatgggtaactatgacattgaaaacaatggtaaccacgggaaatgcaccttacaaaataaataaggggaaaaaaaaaagacatgggggtggggagtaggaaggagttggtgtagtaacagcttagtgagtaaataaatatttaaacttcatgctttgttacttgtgtaatcatgagatttgcagaattatgttttatattacatttttagttggtatcttttttatcttgtgttaaataatctgttaagccaaatttaagtactgttcagaaacaaaagcaagttacaagctttgtgggtgttaatgtcttcatgtgtaaaaaaccagaaaattgaattagatatatcctaaggttttttccaagcttttaaattccatgattctgtgacccaggaggtgtccaggagtcatgtgagtaaacttttaagttttgaagtaacgttaactccaagacttgaaacccttgaaattggctagaaatcctatacaagatttccagaaagttaccgttatacttcctgattacgcttatggatacaaatataaagcaaacaataaccaaagacacataaaacaaaccctgattctagcagtttacgaaaagaggaaatttattagaaggttctgggggatcattgtccagtagaactttctgtgatgaggaaaatgtttagagaatctgagctatccagcatggtagtcaatagtcatatgtgactatttagcacttgaaatatgtctagttcaactacaagactcgattttacattttatttagttttaattaatttaaatgtaaacttttaagatttaaaggaatcctgggagtaaccgaaacgtcggtcttgagaagaataggaagaaaccagggtggccttaggaactaagaactgctttggaagcagtagtggtgtgttcttcagagtcataccatgacttagttattagtggtacccaacctggatttatcagataacaatggcatcttccagggagagaaaatctgattgtctttacatgagtttggtgtctaccctccaaatcaatcaactgtaggttgggttgcagaatgattgcgtacctgccagagtgctgacagttcccagggaaggaggaagtggagccaggcagcagtcttaagagcggtttgccacattacttaagagaaatatgtttttccctgcaagcactgatttttctaactttaaaatactcttattttgttaatttacttgtattgcacctgacttatttaccttttttattgctaattaaaaataccactctatgttgagtaaacttttactaacctgagagactaatgatttataacattgtgtagaaggaaatcaaagaacattatagccaaaagcaacaatatgagccatgctagacaatgctctcttgttacagagagtattgata

SEQ ID NO: 112410 - DNA, 1669 bp, Homo sapiens
taatgattttacaaatatgtggagcatgtggaaatgttatgagatgccaagtgaaagtgcagaatacaaaactataagcaaaccatgattacacctatatgtatatatgtattctgatatacagatatgaaggaaatgtgcaaaataaaatgcaaattttatctgtagagttatttttgttgtaacttttcttttgagtatattttaatgtagatatacatagttttaatgaaattggaattacatttataatgggtttataaaagatagcagaccagtgtcatttttcttttttttaaaattgaaaccggtaagtaagagcttgtttttttcctcctacgcagttggagagtgacagatattgctgatgaccctcactttcaggatttctgtcttgcagccaagttgggaggaaatgtttcgaatcaaaaaggggaaggatgaagagactcaaggcacttcattttgtgtgtgcctgtgtatatgtgtgtgtgtgttttctagggggttaacacattgccccagcttggattatttctatcctcagaacagcatataaacattttttggggggaaaaagttaaaatatttacacagctgcttcctttatttttttttaaatacacagataatatttttactacctcatgaacatcatcatgtctttgtaactagcatgctaaactttatttctccttttggtagcactattttgttattaatcccttctgcccttcctccttcccctccttcccgttgttccctcttatcccctcctccgaccactcccctccccctcccgctcccttctcccttctcctcccctctcctttccttcttttaaaaattataatctgttaatttgtttgaacctagggtgcctgaaaattcagataacttgagagtaattaattaattccacattagtattccaatgcatttgtaatgacagccttgcaatttttggggggtaggtaaccattaattttgcctcagtaaaataaatggcctttatgtataagctaagacttgtacaaaagtagattaatgtccttcacctgtgactctacaacaccaattcattcactttggtttttcagccagacatctggccattttagtgatttattgacttaactgattaatttggtaggggaggttaatactattgtgccttcagatatagccttaagtttctgtcaccaagaggtgatggcaatctaacctgttggcctcaggatgtgctttgccttccctggattcctcagactcctatttttatatcagattctactttggttgctggcatgactttaagctggcagggcaaagggctttcttgaaggtgactgtctcctcaacctgtctgacttaaacggttgggtcaaggaaggaaaaaaatggtatgatgcagcaggaattgggttgttgaaaactgtattttatttgcatttcttgagtttgcacagaacttaagttaccagcctttgattagcaatataaatttaaagtttgtcttgggcaaacttactgaaaactcctttaggcactttcctcacatcaattaaaaaaaaaaaaaagagaggttaatagaacactagctactattttgtttcctttttaatgccacgtgatctgtataccttggaaggcagaaaaataattttat

SEQ ID NO: 112411 - DNA, 1031 bp, Homo sapiens
gccagcttcccagaccttacttcaccagtcatgcattctctgaccgtaacactaagagtacaatggtaccaaaattttaatgtaacattttgaaatagtaggtgagatttggataggatggttagcaagttggtttatcaaacttagcctgtaaatgaccacacaggtttggaaatagaaaataatttacattatgtgatatagtacataagattgtcatgtggaaaaacaatacaaactagattgaatattcaccatatgagaaaaacactttcttcccttttgaatcacattagcttttaagaatcttcaaaacttttcaggaacatgctatatccacccaaccccttgttttttggttaattgttgtttgccctatcctaaggaccaaaagctatacttacttccatttagtttgtcagtcttttaaatttatttttctaaattgagaagagcctgattaaggagttctgtggcaatagaaaatctctcttcaattcattgccaaagcatagaggcttctgtatatagtatttaaaagtagagctctaaagtaattatttccttggatcctaagaggactcgtgttagtgaaagcaaagtgggacttatttcgacccacaaagaagagctgatttagaggccatgtggtgatgccatgggagaggcgcatgtactgctggtttaggacgagctcttctgataagctctcagctgttacaacagataagagaaaattgatagtttcagaaagcaatgaaagtcaactaggactacagataaacagcatctatgattcttttcaaatgtttgagtacaaaacacccatattttaatttaataaacaattactggagacttactatgtataatatgctagaaatgttagaagctctaaaagaatgataggacagagttctgcccttaaagactttagaactttttagggaagagtcaggtcccactataggggccgtgtgtgtgtgtgtgtgtgtgtgtgtgtgtgtgtgtgtgtgtgtgtgtgttcatgg

SEQ ID NO: 112412 - DNA, 1079 bp, Homo sapiens
cctggcatcaagtgatccacctgcctcggcctcccaaagtgctgggattacaggcatgaaccaccacacctggctggcaaaaagggattttaaaattaatttaaaacattaaaacaaaaatggttttatcactatggtaatattaatggtgttgcaccggtaggttgctcacggtttatgtttttgatgtgatatttgtcctttatgtgttaggaatacccaagccaagatgtgtgactgccaatttttgatcctaatagcttttctgactaaacctgttttatagctactatgatcaacatcttctggataccaagtgtttatatgggtagcttgacttgagagattgaaatgtttaatgagtggacattaaccttactaatttgtatctgttaagtgaagctaatttgtagcttatttgtctgatttgtggtatgaccctatttgtggtctgacccaaattatttgtctctctgaaatagcagtgtgttagtctgttatctgcttatttacttcctccaccccgccttcttagtagactatgtttctgggaagcagaggctattatattgttttaattttaaaagatttttatgcttttaagagattattatcttgatcacctttgcaaattcagtgccaagcatgaagctgggtacacattcaaaaaaagtgtgttcaaagaatgccttttaaagtagctgtaagactatgtggcatgctggtccttgatgatatagggcagacagtgtaaacatggccttacctcctaatgcttatgacctgatgaaaataagttagacattttataatggaaattataaatttatttactcatattcatttcctgaggctctgtacatatttggtacaatgggggtatttaaaaagacaagtgtctgtcctttagcattccaaagagttagaggacaaaactgtaaaattctggtatgtaatatttatttcttataaataaatacatatatacacatagcagtcatgtgctgcataacgatgattcagttagtgacagaccccatataggacagggtcccatatgattataatggagtatattt

SEQ ID NO: 112413 - DNA, 1038 bp, Homo sapiens
atataaaatatggtgctatataatactgctttaaaagctggacgcggtggttcacacctgtaatcccagcactttgggaggctgaggcgggtggatcacgaggtcaggagctaagaccagcctggccaacatggtgaaaccccgtctctactgaaaatacaaaaattaaccaggtgtggtggcaagtgcctgtaaatcctagctactcggtaggctgaggcaggagaatgtcttgaacctgggaggcagaggttgaggtgagctgagattgtgtcactgcacttcagcctgggtgacagagcaagattctgtctccaaaaaaaaaaaaaattacatatatattatatataaatataatatatataatatataaatttaatatataattaatatatattatatataaatttaatatacataatggttgttaacattacttgtgtcaaggattatcaattgaattgggtgattcataacacagatttcattggaaatgtttgagtagggagggcctaatatttagcaggtagtatcatgttatttgacattaaatcaattgaattttgtagtttcagtaaacacaatgtgaatgttggacatttgaagatatgaatgctagtttgtatgtcagtgtctgtgtatatgtatttatataaatgagtcattttatatacaaatatatgcatttatgtaaatttgtaaatgtaagtataaacatgtttactgtcttggtgtttgagatgattccatttgtggtgaatgatggtgacttctgttttaaggatgtttggaatgatttaaagtaaaatcctgttcctaaatctaaagattgtgataattttagatgaatacttttcccttttcattattattttttggtgtctaccagaatatttatacatagtgatagaaacagtgattttttttgtatggagagaactcagaattattcagagatattattattttgagggaggcagatatacagtacaatccagaatgacatttaggactactatatgaaatattacgtggcag

SEQ ID NO: 112414 - DNA, 1031 bp, Homo sapiens
taattctcacatcttaactaaaggagctaccacaactaaacaaacagacaaaaaaaaatcagagtataccttcacaaaataagcagtctatatgaaataagggagttgcatttggtttttttgtcagtaagtctgtaatgctcgatatatcaactttcagaattacagtaagtcagagcaaagagaatgaaatctgtagctcagcttgtttatttttttggtttgcttctgctgaattttgtttcccccaagtcagaatacgagtctttttgtgttctctctcttctcttattcttccgagaagtgaaggtggtgggtgtacagcccatatttgtttactttttctgtagctcatatatctattattactggtggtttcttagtggaaatttttctttcactctcactttggctttacctccaagtgctttcttctcttggctgcaattgagcactataatttgtggctttccggagggggagccttggtggtcaggtggaggaggcaggccacattccaaaagtggagtggtaggtgttccagacagagtgctgattcaagagtgagtaggggtgtagggtgaaagttggctactaattcaagcctcacctgaggcagtgttgctcaaacagaaaagtgccctctctaattagctgcccccatatgcgcttagattaatgacagccaactaacttagaaaccccttccagagtaagctagccaaacaatagatgttccatggacatgacaaagagctaattttcttgtgctaaggaatttttagctcttgtatttgtggtggactgcctcatcacctaatgaaggtgaagtacattctccattttaggaggcagagttaaaacattttcctcctgtggatgtctgattagaaaaaaaaaaaatctcctacttcactgtacctttccagcaagtcttatcctctcaaagcactgtgtaaagctttgaaattaactggttcagtgagtagattatattttggtactttcctatttgtccttaaaaacatttt

SEQ ID NO: 112415 - DNA, 1318 bp, Homo sapiens
catagatgacaaaggccttgctatcaaagtacagaaaagggatgacagaggaaggtggggctggggttgggaaggtttattattattatgattattattattgtttttgagacagggtctgctccttcaccctggttggagtgcagtggtgcaatcatggctcactgtagcctcaatagcctaggcttaagtgattcttctgcctcagcctcgcaagtagctaagaccacagacgcacaccaccatgccaggctaagttttgtatttttttgtagagacggagtttccctgtgttgcccatgcgccacaatgcccgaccaggaggtctttgtagaaaactctggattcctttttctgggaagtatcttcctcttgctaatggaaaaatgtttaatcttatgtatataaaatttcacattgcagaaagtatgttttacttgaattatgaaattttttgtgactacaaaataaatgaattttggctaacactttattaaaaataattatgggccaggtgtggtggttcacacctgcactcccagtgctttgagagtgagaggacctcttgaggccaggagttagaaacatagcaagaccctgtctctgcaaaaagttaaaaagttagctgggtatggtggtgggtgcctgtaatcccagctacttgggaggctgaagctgcaagatcacttgagcccaggagttggaggctgcagagagctatgatcatgccactgcactgtagcctgggtgacagagaccttgtctgtgaaaaaaaaatctgaaatattacatgtaaggggattttgtgaacattctatatgctaggtattgtgataaaactgtaaccaagtatattgtatatagtatggaatgatagtaataccaatatctttcatagagaagtttctcctttccagttttaaaatttaggattactttgggtcaggtctattcatctttgaagaaaataattttttaaaattccattgtataacatgaagatttttgtatgtgaaaaatacattaaaatcttgataaataagttttaattttacatttcaggccagacatttgttgtatgaatctatgagagcacatacaggattccttgtcatatgtggacatgagtcattataaagtgtactgttaaattgtttggaggcacacccaatagatgaaaaggctaaaaaatgtaatatgtaattatgaaattctcccttgactgcttagtaaccattatgctttctttatcactaattatttcgggtaacagattcaataggtttacaataaggattcaaatcgtgaagtggaagat

SEQ ID NO: 112416 - DNA, 1045 bp, Homo sapiens
ctttctatatatgtcttatgttacataatttaagttataatttatatacagacagttttcaacttaagagtcttttgactttatgatgattttattgcgatgtaatgtcattgtaagtagaggaacatctgtacttacaatgaaaatgaaattgaatatattttaatgatccattttatataattgcaatgtatgcattatataatacatatatgcatgtatatttactttattattcagtttaatcaaaagtatatgtaatctctttatatttattgactcctgattgtctttttcaactgcttataattaaatgaaatgtctgtgtaagccacatagaaaagtgcttggcaaagagtaggcattcattaaatgtcaactattatcattagtttagtttttaaatgatacatagtgatacaaagtagtagatattagagagttcagcctggataacttacaaattgattgtatgtgtgtcttcataactaccttgagtggaaagagataaaaaaaaggtaataaattggatggcttggacaaggttgtatgttcagaacctgagctttaccagcagaaaaattgcagcatcatactgagcgatggtatcatttttttggtatcatttttgtatccttctatcccccaggctgaagtgcagtggcacgatctcagatcactgcaacttccacctcctgggttcaagctattctcctgcctgagcctcccgagtagctgagattacagacacacgccaccatgcctggctaattattttacttttgctagagacaggttttcgccgtgttggccaggctggtcttgaactcctgacctcaagtgatctgcccactttggcctcccaaagtgttggaatcacaagcataagccactgtgcctggccaagaggtggtatcttaatgtttagtattgccttacaatatagagaggcagcatggcttaggggccagaacacctaacaaatagctacagacttcaggtaacttattcagttttcatgatttttaaatatctccttagataa

SEQ ID NO: 112417 - DNA, 1304 bp, Homo sapiens
cagccattttagaccttgaggataagattcatactaggcaagcaaccagccttattttgttgttttgctttgttttaggttttcagcagtccgaaaccatggtttttagtttatgtttctagtgatgagcagaaaagggggtgaggaaggggctgtactggcccaaccagaaaccaaaactacgaacccatgactgtattctgttcctgggacatgcctgcatggagtagtccaaatccttgatgactttgtggaattgccaaactataggctagattacccactttgacttaatttctgtgagcgggaactgagcttctatcttatttaagtcattgttattttgggtttgtcatatacagctgaattaaattctagcagataccattctcagtgaataggacctttcttgtatactttattggctttattcttttgggcatatttctgcgtcttgaatgagagattctgattcccacatgtcaatgtcagtgaataatgagaaacagcaaaatatgcatgggggaaagagcatgaatctgactttgaattttactgattatgtgatcttgggcaagttattttaccttattgagcctcagtttacttttttataaaactggggttgtactgtgtcttagttcatttgggttgctctaacaaaatgccttagattagatggtttataaacaacaacagtttatctctcacagttctggaggctgggaagtcagggtgccagcatgggcagattctgatgagagcctatttccttcatagatgtgtgtcttttcattgtaacttcacatggtggaaggagtaaacaagatgccttgggcctcttttttaaagacgtgaatcccatgtaggaggactcagccctcatgactcaatcatgtcccaaaggccccatctcttaatacgatcagattgagtattaagtttcaacatgtgaattttggggggagcacaaatatccagatgttaagatttctgtaagtaggactgttgtatttaatgaaaaaattataaaaccaagagctgttgttttgaatcatgttttgaaaaaatacaaatgaaatatgttgttcttctgcgaagtgatttttataaaagaagaaattaagaagcagttacccttataatgaaggaaggtagccattcagataatttgaagaaacagaagaatttttatactttgtttccatttttctttctctagttcaattgaaaaaaatgtcaaaaatatctcatagggattacttttattttcttagaaatatattggtagatatttttcatta

SEQ ID NO: 112418 - DNA, 1290 bp, Homo sapiens
aattcactacagattctgtgtgtgtgtgtgtgagtacatgtacacgcgtgtgcatgtgtgaattcttagttgtttctataagatagaataatattacctgatactgttttgtttttagagttgatgatccttgttaatattttggcttgttgtccctctattcactgactcgtatggaaattggggattgggtagaagaaattcaggtatacacaatatcttatatagtcttcaaaattatcctagaaagctggtgctatctttgagatgaaattcaggtataaggctacatgtacatgacgtagtctgcttaataatatatgataccacaaagccaattgtacttaagagtttttgctgggtcttctttatcactcttagtatgctatttattttgtatttaaaataggtttcttgatataagtttatcccttggatatttaaacagttttcatcaattgataccattatacttctgttctaaaacatcttctaaatatccctgaataaattcttacctcaattttttaactgatttgtgagatttctttttctccattaacctgattcttattgaaaggaatgaactgctattatggaagtactgccaatttcatatcatctaatctgcccatttgaaattgatgatttagtcgtaaaggagtatttttagtttgctttaattaagtagcatggcttgtaatgtgaaagttttgggtactcttgaataacattagattacagaatttatagttctaaaaatttatttaaattattgaatcctaaacatatgcttaagaatgtgagtgaacctttaattggacacttccactaatttgtagcctttccatggaaacatgccacaaatcaataggttaaaataaaacttagtcactttgtaaatagtatagtaagagtttttaaaagtaataatgccgtttaactttcattcttttttgggtatacattactgaatgaataaactctctgttcttcctttttaaagccaggctttttttttttttttcaatatggtataactcagaattcttcacgtttaagagcccagtaaattttaataaattttctaagtggctgcctgcttttaaaataatatttgtcttcattatgttctcattcattgctaatttaatttttaaaaataactttagttgagagattgcttgtccagcagaaatggagctatcctacattgagaagagcaaacctgtgtagaagaatttaagaatatagagagtttgaaagaagtgggaatctccaagctatcat

SEQ ID NO: 112419 - DNA, 1051 bp, Homo sapiens
tcccagctacttgggaggctgaggcacgagaatcgcttgaacccgggaggcagaggttgtagtgagctgagattgcaccattgcactccagcctgggtgacagagtgggactctggtctcaaaaaaaaaaaaaaaaaaagatgtcagtagatttagtggtgtttggtgagagcctactttctagctgtgttttaagggcacttcctaatctcgttcatgagtgtctggcctcatgacctaatcataccccaaaggctgtatctcttaatgccatcattttccaagatgatggttaggatttcaccatatgaattttgtggagacataacatttagaccagagcggtagtgattttcatgcattttcgaatagactgtgctatctattttttatgggtaagattaggcatgtttttgttggcatagaaaaaattgctatgtgaagagagtgactgttatttctctaacatttaaccagaaagcctaaatatgttcaaaagagctcatttgacaagggttctggggcagaagtgttaaaggacaaatgaaacaaggatttcttattcttaattggagttgagggaaagggccaaccttctgtagggaaaatgactataaatggtctttgcagtgaagacatcctctgttgcaacagccacctttttggtcggcttgtttttcctctttcttcacagagtactgctattaaaaacacctttctcttggcacttgcactctaccatttgactcttcagatttttcttgtttctgcataaaattttattgctcttagttttgaacctttgtgcagccgtagtaccaagctctttgcctttttcttcatttgttattcccatcttggaggcttattcactggtactcggtatgcctggaagggttcccttgttttatgccagatgacaacaacaagtgaatcctgctccctagtccttttatagatagcttttgggggaagaaaatttaaaggaaaaaataaaaacaaaaattttattgtcattaccgaagatggaatgacattcattctcatctga

SEQ ID NO: 112420 - DNA, 2095 bp, Homo sapiens
gtggaattatcacaataatgtatattttaaaatgcttttgtagttatgcctcagaataggcagatagatactgcctattcatatttgaacttctgtcctgtgaagagctagccccagaagggatcttttgcttttgattatttagcctatatttaagaggtttcttttctcttgaattgttatccccagctacttgttcagagatgtttgtaaatgaagggagtgagtgggaggaaaagcttatgttacttgtagaccagagaatagtatagcagctagaagtggtgtttgtctgtaggctacccttagttgatttgtgttgtcatgcaagaaacattttgatgcatttatttcaggacacggcattttggagacttcattaaatgctacctgttgctgtttgtgatggaatctagtctagaatgttaagaggcagtagaaaaagctgaaatggcaagaagatggcactcttcagtctttaagattcacctgtttgcattttagaaacacattaccattctttttgcttctcttaaaattggagctatttggattaaaattaaatttatcattatgatgtgacctacttggtgtcagttatttttactgtttcttttaatccctaaggtaatcctgtgaggaggttaatatggaaatctgttctgaagtctgtgaatcaaagatgctaaataattttctcatgatcagagagctagtaagtgatcaagctggaattgaaaaacagaacatttaaaaattattttgaaaaaatgtcagatatatgtaggagttaggaggacagttaacccacatatacctatcccatagattacttatggagattttattacatttcctttattccctccttccttttttggagacagagtctcactctgtcgcccatgctggcgtgcattggtgcagtctcggctcactgcaacctctgcctcctcggttcaagtaattctgcttcagccttctgagtagctgggactacaggcacatgcgaccccacctggctaatgtttttatttttattagagatagggttttgccatgttggtcaggctggtctcgaactcctgacctcaagtgatccgcctaacctcagccccccaaagtgctaggattactcttcttttttctttgccaaagtattttaaagccgatcccagacatcatgttaatgaatgcgcacattttaactgtgaggctagtgtttagaattctgtacctgatggcctaaggtataaaagagcatgacacaatatgaagactgtgagcagtagaagccatattttttctacaacataagttatatatctgcattgagttttcttgatatggttagccgtcatttgccactcatttgttaaaaaaagatcaatgcaataactaatatttattgagtactgactctgggttaggaacagtccctcatattttatgcatattaactcatttagttaacagtagccctgtgttctgtaatcatttattgtgggttccagttgcttgttgaaaacagttacctcttttacataaaaatgaaatattccacattgctttgacttgtggtatcttttccattccttacctttagtaattatgatttgttaaggaatgtatagaacagtgctactcaaaagtgtggtccacataacagtagcatcagcattgcctggaagcatggtagaaatacagaatttcaggccctaccttttgaatcagaatctgcattttaaattaggtctttaggtgatttatatgtatattaaagtttgagaaggtttgggttgcatttaaacagccttgcaagcatggtcacacattacaatcacttggaaaacttttaaagctaccaatgcccagcactgtccctgaacaattaaattagactatctaggtaagcctccagcatctttttcctttcctccccctttaaaaaaaattagattctctaaatgagaccttagtattgttattgttgtttttcaagcatcccaagtgattcttaagtttggccatgctttaacatgcactagttttataggagtagagtatctttgtgttctgttccagcttcttaaca

SEQ ID NO: 112421 - DNA, 1075 bp, Homo sapiens
ctagacaaaatctgtatttaaatcctctgtcctccatatgccaactgtgtgtccatgggcaagtcatgtaaccatcttgaacccatttttcttacagaaatttggaaacgatactaattttttaaggttgttgtaacgacgagaggaatattatgtaaaatgtctagccttagtgcctgcacagaaagtgttcccaatatatgttaggtattgtaattttgctgctggacagctcctttgaaagacatgctttttacttgtagaagtagtagtaattttcattaaagtaatacacttcctcacctcctatccactgtcaaatccgttgtacagtcatttggggggccctaccattccatggaggcaggttggcagtggctgtccaatggctggtttctgtgatatttgacaggtgtcaccttgtttttctcgaaaggttgtcctcattggctttcatgaatttcttcttttttgactttttgctatctcatcttgactgaatcctaaatgttgatgttccctcattcctttatacctttctctaggcagtctcatgtccttacacttacaggattgattaatgcctgtaggctgatcactggcacatctgtatttgaaacctagacttttctcttgagctgtctctcaaaccctatatacaacagttgctgtggatgggtatggtgaaaatacagttggatgtctgttctcctgtgtttcctatgcttggtgatgtcaccaccacccatcccagtcaattaaacatacctctcagttcaagtcttttaaatacttctaacctagtgctgcaggagcctcccaacatcagtgtctctgctttcaacctttttctcttgcatacacatatgttttgtcacattggcactaggattatttttctaaaacgaacacttgattatgccgatacctacttggtggttgatccctttttttactggtttgcaggaactctgtatattacggaatttgaccctatcacatgaattctgaaaatatttataatatagcatatgttacattgtactgaacttattttaagtctccaatttatttg

SEQ ID NO: 112422 - DNA, 1052 bp, Homo sapiens
cgccattgaatttggcaaatgtagtaaaattggttgtaatttgataactagtttcagtttcactgagatatgaaggagaccagtggcttccaactatggtgtcaacacagtgttgtgttaaactcagctgtgaggtattaacagctactgataacctaaagaagtttgcagatgacttattttaagatatctacgtataaacgagagtggatttacgttcaaccctaaaatgctactttcacttgcattctgacatgaagggatggagctgcaactgtcatggtgggcattttgtataaattgcagttgcttgatcttactgataagtctttaatcacagtggaaattacatatgtgtgtatttccctgaacatttttttttatagtggttcattagaatctggatttgtttatcctagtgtttcgtagaagtgaatgttatatcatgtatatctctggggggaagaaaggccgagacctgtcatgggagactgtgcctttgctagccagtctgtaaattgaataatcttgaaacatttaggtaggcacatttggggtgacttcaaagtgctttatgaagtcttctctcctcacacatctccagagactaccatacctgaaatttcatgattgtttaagataagaattgcttttttgatagatatttcagaagtaactgatatttaaaacataattaactgactaatttaaatttttttccttttgggtaatgttgaatctaggaaaaaaatcctgttattcaggagcctttttgagagttaactttcatgcttctttttaaatccatatcccatgcctctttgaaattgtcactcgggggttgggcgcggtggctcacacttgtaattccagcactttgggaggccgggtgggtggatctcctgcggtcaggagttttagaccagcctggccaacatggcaaaaaatcatttccactaaaaatataaaaattagctgtgcgtggtgtcatgcgcctgtaatcccagctacttgggaggctgaggcaagagaatcgcttgaacctgggaggt

SEQ ID NO: 112423 - DNA, 1283 bp, Homo sapiens
tataggttgatttcctcaaaggtgagtgatggtttctttctcaggaagacaggtgatgatactaaattgaggggagagccatttgacaagcatatgggaggcccatattagtcttcacaatgtgcaaattcaaatgaataaaaatgtataagattaggaattagaacagagattaaaacatactgtacaccccgataggtgataacttactgtgtatataccaataaaaaatcttcaggcccatcacgagtacaggctgctcatgagtcacctctcctgatggcatgtctgcatggtgagtgtttttagaaaagctcagtactggactccacaccaacagagtggcagtatagtgaggcacttgctcttagtcccatccttacagaagaccgctaaagctgcgctaccccagatgtggttgtatgacttctggttaaagaaagccagctgggcctttccaagctccattttatttttgttctgaatgaatatttccagtctctcacatgggccgggatatactttgtctcactaacacagaaatactttcatttcaaagagttgaagactaaggaaactatagtttcctacataaaatctcactgttagcttctgttgatttgcattcagcaaccaggagggaatctctgttgtcctcgcctctggtcagaattctccctgagtactctatctcgttccacgtgcccttccagaaacggatgtgttaaattttggagtatgttttacaaaacagtccccaagatgattaaaggactttaaataaattgtgacaggaagtgagagattattcagtctgaacaaaaaagggtgagtggtgatttaactagaggcttcaaatattagaaagtctctttctgtagtggatcatactcagaagttgttcatcaccccagtcaactaaagaagagaaaatatttagaagcatcagagaattaggtgatttttaaaaaaatttaaccagttaggggcatttaacattgggatggtttatgggaatcttctgaatggagagaatagatgattcttatttatttttgttgtaaatgtgaactttatgtgtgctgaagaatagtctaagcctaaaattatggcattttgaagctggaaggaaccatggaaatctaattttctgtctggctcagaaccctctatttgctggggagaaggattgggggatgtaggggagacctttgatctcttacacttgctcatgcctgaatttaggcctacaaatgagactcccagaattggaaggtacacca

SEQ ID NO: 112424 - DNA, 1004 bp, Homo sapiens
gatattgtaaaattctcatgtgcctcctgaagccttctaaattgtttttattttgagtgtattatattaagttccatttgtaactggttctgtatggtgactggcgaattggagtgcttctttctccagcccaatcagggcatggagtatgagaaggaggcattaataaggttacacaattagaatgagagctgttctgttcggtcacttgaactcactttgtccctgctgaatgtaaaaggctaagttctattcaatttaatttatttgcttgaacctgacagctgtctttcagtttttattgtattcccctttaggctggtcaatttctgacaaatgagaaaaaatatgttaatcactgagtgtttgattattggatgatttgtgtattttagttattgtctagatttggacttgaagataaaatgacctggtaaatttcatgaaaaagaacaaattggaaaaaacctctttccctgtttacatctcaatatatcatttcctataatgcttctgtaatccagaaatgctgccttctccaacatgacctccttcccttctctggcccccaaaatgtcattggatgccatccagtggaaagatacatgggctatgaaaagttaagaaaaaggtggcactaacgctgctgtctccttagattctcacaagtgggctttgagccatccgttgacatttgtttttaaaacatcttgtaagttatgctgttttatcaagttaaattaaaagcaagatatattcttaaaaagatggaacctgagtcaggaattcaagtttgttttattttttgtttgctttttacaaaggaatttgattttaaaaaatgataaatctggcattgttggttcatgtatatttaatgctattaaagttacacacattcctgttctgctgggcctgattattgggataacaaatgttctcctgatcattcagttctcttctttcgagcttcagttcagaagttacctcctttgagacctgca

SEQ ID NO: 112425 - DNA, 1041 bp, Homo sapiens
gagcatacagacagacggacacacgcgcgcacgcagcgggggcgggaggtagggtcgctgccgggggtgggggaagcccgcacttctaggggcgctgtgcgcccccggcccggccttgccgctcgcctcggctcccgcccctcggggccgcttcggggcgccgggcgaggggcgcgcgttaggcggcctggacgccgcggcccctgcggggctctggcttcctagcagggcgctcccgaatcccaagggctggagccggtagggaagcccccaggaagcgcctgccgggcccaatcaatggtcggggaacgcaggcagcacggaggcggcggcggtggcagtgccgctgatagagtcatgcggtccatagcccctaagggcaggcccgagcagctggagggtcggcatggatccaagcatgccagatataaaaataaagctcatctgtatattccatttaagcgtgtctcagttacattcacatctcttcacagattaaactacaatttcgttatcataaacgacttgtgcccagtaaagtataaccctctactggtttttggtgcggtcttaaatctcctggttatagagcagttactcagaatgttcatctacaaggcattgttaggcctttatgataattactgtggatagaattatagtgatggtggtagcaatggttttggttcacagctcataaaatactgatctggcagaggggagttttctttttctctgaagagaccgctactggcacccactgacaggcctcccagtggccaccattcactggcatctgagctgctttagtgctgggcactgtattaggtacaggctggggataccttcgggtggattacctccccacataagaaagcttgagccgaaatatatattttagagctcattgtttcactactgggtggagtgacaactgaaagcttagctttaaaacatcagtaatcaggtcctcaccaggcaatattgcagtggcatttagattgcttatggcatgttcatcctagtcctttcgtgcccact

SEQ ID NO: 112426 - DNA, 1053 bp, Homo sapiens
aaaatattctacatactggtgatcttttagtaaatagtaaaggttagggtcaagatattcaataatttttttctagcagaatcccacaactgaatattgtcaagcagtttaaactgcattcgtgtttgttaaaactttaaaagggaaacttaaaactaaagtatgttgtttttctgattttaatattgtgctttctagagatgaatccttttactgtttgaggcactataggaattatgtatttaaatgtatgtatttaaatttgaagcaatgtacttttttgagtttataaacttgggaagacaggaaataaaaagatttgtttcctgtagaattttacattcatgatttaattgaattgctaaaatggaaagaacatgtacgattaatggagacttggaatctgagattattcatccatattgatacacctgcaattcctaaatgccctcccctgcttgtttagataaaatgtcttcctgggctgcagcctactggacaaacttgaacacaaaggaacacacgttatatgtacatttaatactggaaccgaaaagctgcttgcagtgaaaagcaaaccacttctaaactctttgagactttttaaagaaggtagtataatccttttaggggttggtggtgatgtgaaaatctattatctttttgctgaaatttcattcttatgttaggcattggcactcacttgtgctgagtaaatgcccgtgtttttcaaacccagatagtaaatactgggggtatacatacaaaaatagtccttcccctttgtaagcattgctttgatctttgcacttcctttttactctacctcttaaacaagatctgtgttgattgagttgattaaagcacaattaatctgaaataggcagaattttagatttagtgattatattccttacatttctgttgttactgttcctggaaacaaattgaagtagtttgagaaactaatatttatgcaggttgttttaactacacttttagacttgcagataattgattaagtaagttactaccttgactttcagggattgc

SEQ ID NO: 112427 - DNA, 1024 bp, Homo sapiens
agagcaaaatgccaatactccctgtcctagtgtcattgtgccccctgggaaccctaatgcagtcctgtgggaaaacaaccattttattgagcgctgctcacttcagttcattctgctttgctgccacttagttctggttctgaccctgatctcccctcacatcactcacaacaaacattcaagtttaaaaattaagttaaaagttagttacatatatatgtaactaatgtgtatattaaatatactgatatatattagttacatatacagatatggcaacaacaaaaaaggttatatatatacatatttgtaactaatatgtatattaaatataatgatatatgtataaatacatatttgtaactaatataattatatttaatatatattagttacaaatatgtatatataatattttttgttgttgccagcaaaatgagaaagaaattaaatgttaacatctataacaattgcactgtaaagccgtcattgttgaaaagtactccgaagattaatagcggcagtgtttgttaaaataataaaataatccaggcactctgcctgtgacttccccatgagatggcttccagaaaaagataaatttttgtgtgttcccttacgagttcagtctgcagcttctgggcatgaagagaagcataaacaaaacaaacaaggctctaactttgttataatccttacgctactagtagaaatgtatggacaattcatgcatttcatattggaaaataaagctattagatttttctttgagatgaaccttttttttgtaatttattttttattttttattttttttcagtagagatgggattttgctctgttggccaggctggtctcaaactcctgacctcaagtgatccacccgcctcagcctcccaaagtgccgggattacaggcgtgagccacctagcttggccaaggtgaacctttttgataaatgaggctcactaatatttctaggatttacttttcactaacttgaactaaagaaagtataagacct

SEQ ID NO: 112428 - DNA, 1882 bp, Homo sapiens
ccaaatttaaaaagcaatccttagaaactttaaaaatatttcctattttaaaccattacataatcatttaccctgcagttacaattctttttttgtgatgggtggggaagtatcccatttctcttagaaagtcttctgtaatagccaaataggagtcaatccaagttgcttagagaggtagttcaatcctgtgttgaaatagatgacttttggagtaattgtgctatatttactgagtatctgttgaactgtaggagtccagtcattcaaggcaagctacagaaatgattttattgctgaggcacttaagtatcttcacatctatatgccaatattaaatttctcatcatccttgatccccacccctttgcacagattggtatccccagcacattagggaatgcggttgttagcctgttagggtccattcagtagatttctcatgccagaaatctagaagcccttcttatacattcagctttcttcttcagtcagtcaccaagttctatcaaggcagcctcctcatctccagaatccatcccttcctcgttgaatttctagattttatttttgcattgtctcctgcttctaacccatcgttcatttcgcataatggtcagctttctaaagtgtaaatcggatcatgtctctgcagtgaatcccagttgtcttcacaagctgattctcgcacacctcacccccttactccctccggtgttccccaaccatcccctaatctcaaatcctccacaccgactttcagtttcctatccacagtttctgactttgaatgcctttgcttatgccctccctgtatgagaagtgccttttctttcctagccatcctgctaacttctaaacccttaggcctggtttgagcatcaccatttctctcacttgcctttctgttttctccctcccctttccataaagagttatgtgcccccattctgtgttctcctgaattcctgtgggtcctagaaaagaaacatcttgagggcaaggagttcatcttatttactttttatttgcacagcacctggtgtgtttgctgaataagtaaataccgaacaagatatcaagagacagtgctgccaattaactgtgtggctctgagcaagttaattaacttctctgagtcttatttttgttctgtaaaaaaaatgaggtttgacaaaatgagcatctctctctaaaattatgtgtttctttgatgtaattgtattaattggaagacttcagattttcttgccatatcaagataggtcaacttaagaaaaatgcatgtgagtaagtaccaagccaattcttgattatcagtatgataatatgaggaactgcccattttgtcgataataagttataatttttggtctcagtgtaggttctttctcaaatccagatgtttctggtgttgcattttttcattattattcagtctctcgcattcatatttctccaaagaaatttatggaaaacttgagacaaaaattgaatgtaaagtttaatatttaaatgctagattgattcaaggtctcactaattataactatatttggagggagaagaaggggaggtggtggtagtatgagctgaatcctcctctgttccttcctagaaggaacacaacgtcctacatcaagaaaaaagacagaagcatatcttggagatatgaaaagaaccaccaggtaaactaaaaagaaaaagagtgttaaaaagtcagcctttaaaaagcaggattggagatgaggaggggtggagtaggggaagcattgcttgtttatagaagctcttccatcttcgtatagtgtgatttttatttttttattattttttccttccttttttttgacctccagctttagtatagtacagttgacag

SEQ ID NO: 112429 - DNA, 1019 bp, Homo sapiens
ggaacttctatccatttgagaagatgataaatatataggtaaagttagattgcagtaaaactatgctgtctagtgttaaatcaccagtatatataagttttatagatattatgtgactacagagctataggttataggaaaaatataggatttcttggcagaaattggatttaactagagccttgaagagtggatgctattgaggtagaaaagatggcatttcaggatgcagggcatattgtgaacaaatgtacaagatggaaatgagcaagtcattctgaatgattaatctgtctatcatagagggttttgattaggacatagtagtagttgatgcttataatatgatttaatataataatgtaatgtgctgagtggttgaagtctttggactttatcttataagtaatatggcaataatgtgaaagattcttgaagaggaagaaaccctgcagtgagggagaacagtacagagcctattactgtcattcagaggtgaagcaataaaggtctctcctaggatgttggaaagaaggggcagatccaagaaacaacatgaagaaaataatcagcagaaattggttattgactagatatgtgtgaaaatgatatattggcagaaattgcaaagtcaaaaatggggctcattgcagcaggaatgatgaaattgcttttagatagagaggtgaagggatttaaaacattaacttgttttaaaggtatcactgcttaaagctaacagtgatttattaatatttgcactctgaaagttttaacagttttaattttatgtatacaccacagtgttttggctactatacttgcctcttttgttcagttgggaattgagtaaactaatagagtaaaaaaatgagtacaaagtgggctttgactagaactctaacaaagtgtgatcactgaattaccaagataattaacccataccccacatatactccatttcccatgacacatattatattgcattgtttttgcctatttgccttcctacttcctaa

SEQ ID NO: 112430 - DNA, 1055 bp, Homo sapiens
caaggcttggacaaaatagttctcactatgtgtgtgtgcccctcagggtgtaacatacttttggactcagtctttttattggtttgtttttgtaagtagatgaagctcagtagagcaggccctcagcaaagttgtgatgtaaagaaatctggccgggctcgttgactcatgtctgtaatcccagcactttgggaggccgaggctagcagatcacaaggtcaggagttcgagaccagcctggccaatatggtgaaaccccatctctactaaaaatacaaaaattagctgggtgtggtggtgtacacctgtagtcccagctagtcaggaggctgaggcacaagaatcgcttgaacctgggaagcggaggttgcagtgagccgagactgtgccactggactccatcctggacaacagagcgagactctgtctcaaaaaaaaaaaaaaaaaaaaagaaagaaatcagtctttggttttgccagccttgcattttgtttcttccttttcctcttatccatcttctaggcccaggcctgttaaatttcttatccttattcccaaacaaaagacaaaatgttgtgacgtcgttctttacctttcaagtgaaactcacccattatttagtatgggtactactagtcatagttgcattttaagtctcttagctccaattgtggaatgaaagatgttttttctattaaaggtaattaggcgggtaaatatgatggcttaagtccacagaagcagaccacggtcttatggcctcacatcctttagaaccttgatgaggaatgaggagcagcaataaagaactaatttgcacttattaaacaccaaagacttgccaagtggtttgtataacattatctcttttaatctcttagaaatctcagtaggtaaaaagtgcaatgcctgtgaacccaaacagactcagagaatggaattataataactggcctttctcacaagactagtggctctatatcctgcagcaggctattgctcaccgaacctctcagatataatgtgtgcatttggggtactgggggcagggagat

SEQ ID NO: 112431 - DNA, 1752 bp, Homo sapiens
gacacgttataaaatatttagcagcctccctgaccttgactcactagatgctaataggattcctataattgtgacatccaaaaagtctccacattgacaaatgtcccctggggggcaaaatcacccctctttgagaaccactgatgtggatgcaacaaagaatcaaccttaaccttacccatttgcatacttttctactataaagttgtctcgcatagattacgtagaattgtccaagtgtattattttataaacgtgcctttcttggttattagtagatatttcttattttcaagatggtgatcatggtgtctgtataatttctgttagaatatcagagttagtgtacctggatactaaggagaaagatagaaaagataaaatatgtatcttcaacattttgtattctgtgatgaccctaaaagctaatgtgggagttctattgactgttataaactattacagaagaaaaagtgaaagtggagagttaggtccactgtgtgtgaacaatgggagggtctatggaatgatgctttcaggtaggcagaggcctcgtggagggtggccccacactcacccccagaatccagaagccattcccacaggaacttcagagggagagcatttacatttacaggaaagaaatgatacttctgagcctacatttgccacatattcattaagtgcatttgttcaggcattacagtaaaatgccatgggctgtgcttttcctcagctacagcctctctccttccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctactggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccattgaagattaactggtactcactttgatcctattgattcctctttgctgtctagataaaaatgtatttgtcacaatgt

SEQ ID NO: 112432 - DNA, 1005 bp, Homo sapiens
gttttggacacactttgatcatatctaatgtgttctacttcctctaattatttttatgttattaggatttttaaaaaatctcttagattaaaatttctcagtgtatctttgtttgcgtgtctttttttctctctccacttatgtaattgaagcatttctgacatatcctcagaacacacagattcttatcaggacttaactacccagggcagggccctccttggatttactgaaaataaacactttgggtactcagtctcagttttaatgacaaaagttgaaatctttgcctaacatgaaggtttttctttgtctctaaattttgattttccatgctatcagaggtcccattgcaacaggtaatttgagtgttgattgtatgttttctcagtttgtaattgtggtgaaatgtatttaaaatgttcacaattttaaagttaagtttacctataaggttctttccaactcagaaattctgtgatggtaaactttttttttgtagtttgaaaatgtgatctttggatgttgtcttctgtgtcctatgcatatgactaggaatcatagaattttagagctggaaaatgagtgagacattatctagtgattctgcaaatgaagaattaaaaggcccaaagaggttaggtgactcacgcagtatcatagcagtacctggtgactagaactctggccacctactgcagcactaaaaattaacccaaatgtttttatctgaaaatttgcagacttcaggctaggcctgtaaataaataaataagaagttaaaacatatttgagaaaggtaagcttaatatgccacatttgggaaaagatgtgcctgacacaaatgtatttggtgtaatagagaacattcttccattataccgaaatgaaaattttgaacattctcaaaattcttgaattttgagacatttatgttaagcacagtttattcagactctctataaactgtgctgtcatccctgttgttttctccaagcggaatca

SEQ ID NO: 112433 - DNA, 1317 bp, Homo sapiens
aatccaaaagaattaagcttttaaataagacatatttattgtgctaaaaaacttgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaaaaaaaaagactctagattgaaggaagaagcttaaattgatttgaaaaattaaagtgtgctttatatgaacttgtttcaacatcctcttgaaagactggcgtgtctcctgttgtatgtcacagtttgttcatcatgtgttgtggaatacccttccaattcctgattgacctaggagagctttgaaatgcaggctaattatcacagttttagactgattgatcacttagtgtttctgcagatttattccagtagggttctgtcagtttgaagtgtttattttctttggtcttgtttaatccctattataatcatatcctttagaggaaattttagatgaagttttctactagtatttattattataaaacctccagtatggtgtctataatttggtgtttctgtggtttgctttagtaatctttcaggattttagaaagaactaatggttatttaaatttgagaccttaaagcgggaatagaagtaaattgtttctaaggaaagtgagggattctttcactcttgtagtgcagtgggttgtgggctcagtagttgggagaactcatcagtcattcactcattcaacaaacattttgagcatctcagctcctgaatttgatcattatgatgtctggttgtagagcagtgagattttctaaccctatataatttcagtgagaaatttaatcaagatgccacttgagagttacaatagactcagtagtcttaacgtttttagtgtttcctatgaaaagtcagtactcactttctaatttgatttttagctgagaaatttttgcttaca

SEQ ID NO: 112434 - DNA, 1735 bp, Homo sapiens
tgagaagcctttcctgaatttcccatccctcagtgaactcctaaaaggttttccccaaactcctagaacactgatctgcaccatgaatttaatgtatgtcctgttatagtgctgtctcactaagtctttcccccactatcttaaaattatgttggagggttcttggcagcaaagacattatgtcatgcttttttttatttccagcatttagctcattgtagatgcataataaatgttaactttttaacatgagttattttgtgtgaccaagcaaaagggtcaataattttttaattcagcatcttcaggatctttttgatggataatcaaatatttcactagttttaacaacactggggacttaagaaactgttgtagagtggatttgggtgtgtactgctctgtggtctctctggagctaactttcagccttcatacccattggaataaatataacgcttcttgaaatttaccatctcttcctctttgagtgctttctatttccctttaagatgtttaaaaataccattagaatcagtggtctttctgtggctagtggtgggaccaaatcaatcttttctcctctggtttctcttcctttaaatacagataaagaagaagtgcagaggaaacgtcagaagctcatgcccaatttttcggatagtttcggcggtggtagtggtgctggagctggaggcggaggcatgtttggtagtggcggtggaggagggggcactggaagtacaggtccaggtacaaaaatacttattcttcctaaaactttttcatattggagagggtagaattttcttttctttggtttctgagcatgtctgtgagttgagtggctatgatattattgagtatattaattaaaatttcctgacaaatgtaaatttatttttcaaagaaatccatgttcattttacaatatgtaggtaatctcaaaagtcattaagaagaaaaaaaagtaccccaaagccagttatttaatgaataccttcctaaagattttggtatatttctcttttacattttttgacatagttgtcttgtttttgtttggaaacattgaaaagattgtatattatcatactacaatatagctatatattaaacatctctatatactacattgtagaaactttgaaaatacataaaatctgccatcaaaggttaactactactatttttatgtatatgttatagtatatatttgtaaattttaccctgaatacagctgtgatcatcattatgcattttattttaatccatttatttgcaatactattttactatcatttgcaccatgactgtgtgtatagagtcataggtgcaacgtttacctgagatgttaacataaacatttcctccagtaatatgaactttaagcataaattttaagcatcattttaatgactcatttcctcaagtgaacaaaccatagtataacttacttacatgtagtttcctgttttctatataaaatgctatactgaacctctgtccacctaacttttcacttattccagattacttttgtaaattagagtctttgtagtaaaattactacgtcagagggcatgacatctaatgccatctgttttcccaaagagttgtaccagtttatgcttccaccaaaaatgcctaagaatgaacagtggtggccatttttccattgaggagtcagtatgtttttctgtgctttgtttgattaagtttttttcctcaaggg

SEQ ID NO: 112435 - DNA, 1108 bp, Homo sapiens
agatacttgggacatactgtgaggatgttattagccaaatgtcagaattagccaaatgctttcacatcttcctgcaatctagtcttgtgtttatgagaatcctttctgaattctcttgactcacagtggacctttttttcccttagaaatcaagtgtagttttccaaccactgtattatctatttcatagctggggaaactgctgaacctcagcaaaataaattggtgacagaagcaagaactaaaaatgagatctctctctgggcctcatatgctattacagcatacattgccttgaaaacatttttggtagcaataaaagtaaaatgattttggtgaaaatgagtctatactggaaaatcaggttgaattccctttgtttataagtgtccttagggatatgaccaagacaaattatttcctatacagtgaggaaggaaacagaagtctaacatacactaatcaaaatgctatcttcttatgtaccaaattccaatattagaatattaagactttaatgccagtggcacgactatcattttggtattgactgatttgtttaatcaaccaatctttatttggtgtctattatgggttacaaactatgcgatatcctaaaaataactacaaattaagggcttaatgcttaggtatttactttttaaaaaaatgttaagtatttgctttttttcttttttaatatctgtgcagaaggagcactgggctgtgactcaggagatctgggttgttttccggcggatacattattcctttctcaagtgcggacaatgacgtctgcccttgctcccctgggaaggccccctggcagggtgagatgggtgctgaaactgagtggcaagaaagagccagccaattaagagctttccagggaatgggaagaaacagtcaaaaggttggtcagactagtgagccaggggagcagagaaaacacttgggaatggaggcgcagtgtggaggaagagcttccacagcaatgtttaagaaagcaaacgagtaaagcagggacacagttttatctttaaaacctcgaacactgctaggcacacagtgtatgctggatcaggatttgctgaatgaatgactgaat

SEQ ID NO: 112436 - DNA, 1036 bp, Homo sapiens
ttggagcaatcttttcatgtgacctccttaacagatatttactgaaggaatctaggttgtattttcagtggacaatgggaataaagcatttctaaagcaccgactggagaggaaggcaacagagacaaggagagaagccgagagacatgtctgcgtgctgccacgcatttgagcgattgctctgtgaagagttgtacactgaacactttcaggggaggctgtttacccaggcaatgtcctcaaacaagcctgtgccggggtgtcctggaatctgtgccaggactgtgtttttagcccttcacctctcagctttagcaggacatgaaccagttataacaagatggccctgcagctggttacaagaatgtgacatggcaggatctatggaaccaaatggaaggttttgaggtgatgtaggtctttcacagctagctttggggaatacggaatactcaaataaagtgctttgttattatttcagagggaatggcgattgaaatgttacaacagagatttcttggtggtagctatttgggtaaaggtatatgggtatttttctgtacatgtgaaattatataaaaataaaagttatataaattacattgacaacttgatatttcatctgtggcttatttaaccgttctataaatattcaattttgcccaatactgtgctggaccctaatttccatttagttctcgttattattctgcttggtaaactgggagagtttgaagaatctaaactaagacatgtgaaaggttttctctggaaacagtcatgtaattggttatagaatggaccagcaaagagtgtttggctttaaaattaagatattattagtggttttggttttaaaaatgagaagcattatgttcagtgactctaaaagtaactacagacaatccagtcttcttcagtatctaagagtatcctcattttatatgtacacacacacacacacacacacacacacacacacacacacacacacaaagccttatcaaggggataaggggacttagggctgggactc

SEQ ID NO: 112437 - DNA, 1050 bp, Homo sapiens
ttaaagcaatcaatagctacctagaatctataagttattatatacagtcatgcaccgtataacatttcagtcaacaacacagttcatatatgatggtggtcccatgagattataatactgtattttcactgtcccatttctatgattagaattacctacagtattcagcacagcaatatgctgtacaggttagtagcctggagcaacaggctataccatatagtctaggtgtgtagtaggctataccatcttggtttgtttaagtacactctatgatcacacaatgatgaaattgcctaacagcatggttcgttaatgcctgccctggttcgttagtgcctgcccagatgttgtgagggtgacatgacataatgtccagagtgctcagagcgcttcacaaacatgggtgccctccactgttgactctccctcacatgctcactcccttagaaccccgatgagccacaaacagctgggccattggacagtgcctctctgactacttgaccttgccgtctcctgacactcttgattattttcagagtacggaggaaagtggaaaatgcttcattactttgctcagaatttctttgctccactgttgccagtaggctttgagaatgaaaacacgttctatatctatggtgtgtcagatcttcactcggattattcgatgacactcagtgtaagttacttggattgttttctaagatcgaaggagacttttagatgatttctttagttgtttggttacattcttttgggaaaataaaagagaaattaatttagagttagaatacatatattcaggctacaaccctgccattaatcatgtgaccataagcaaaacccttcacatcttgttgattcaatttcttctcagtaaaatgataccagtctctcttcttacaggatttctatgagtaggaaataaaataactagatgaaagcaaatcacatatgctataatgtgccccttaaatgcaaggttatttataattgtgagaggctggaaatagtccaaactttataaaaagaaatggttaaaaa

SEQ ID NO: 112438 - DNA, 1046 bp, Homo sapiens
tccctaattttatccaaattgctccaaaaagaaaaaacccaaaacaaaactaaaccctgtatttttctcagatctaggcagtctacatcaaacaataacacctgtgtatgaatgttttcctgaatcaggtgatgcaggcccagtgtgtcaaaacagaaactgaattctaccgccgtagtcgcagcgagatagtggatcagcaagggcacacgatgggggcactttattggcagttgaatgacatctggcaagctccttcctgggcttctcttggtaagcatttcagcgttctttgtgcgagtgagagaaagcaacactgtggggagagggactgagaaagcacagtgctggaggggtcagattagcccaggcagaactatgaccaaaagagtcattctttaaaaagcctgcctaggaactacagccacccaactcaccttagtagcctttccatgagccttagggtcaacctaattatgggttctgtgctgtgcaaagttgcaacagcaggctaagcatgggatagattcctatacaaaagtctcagccatgtgtcttgttattacgcatagaattttgaatttatttaagagggcattccagggctaaagaagcatgaacttaagcatcccttcttctgtgttggagaattcaatcaggtagaagtttggcccgcttatgtgttaaagtttccctttctctgattcacctttaaggacaaataaagatgtcctttaaggacataatgaagatgtctcttaaggccatctttattatgccctgtttagctcttggggaaaagctagtagaggcagaatcccgaatgggaaaggtgaccagttgaaacagttcaactagcaacaggtgagatgactggcatggaacctgcagttcgaattatcccatctattctggtacattaaaaaaaattaaggaataatagtctttgcccttcactagagatgacttgaaacaaagttcagttaataatgtaaagaatagtttggggtcaaaaacgaggcaaggccacaaagtagaaaggttgg

SEQ ID NO: 112439 - DNA, 1068 bp, Homo sapiens
tttccttattcttcatatttcatataattggaataatataatgtgtggtcttttgagactgattctttgactgtgttttcagggttcatccatgttgaccatgtattagtatgttccttttttttattgctgaataacattctgttgcatggatatacactacgttttgtttatctatttatcagttgatggacatttgtgttgtttcctctgtttggctattatgaataatgctgctgggaacatttgtgtacatgttttgtgtgaatacatgttttcaattctactgaatatatatatctaggagtggaattgctgggtcatatggtagctctatctttaacattctaaggaaatgtcaaattgttttctgtagtgattgcaccattttgcatttctaccagcaagggattagggttccaatttttctacatccttgccaacacttgttattttctttttttcttcacatttccctgggaatttacatttacaggaaatttgcatatccttgatggctaatcatgttgagcatttttttttcacgtgcttactggccatttgtatatcttcctttgagaaatgtctgttcaaatcctttagccattttgttttttaaatagagacagggtcttgctttgttgcccaggctggtgtgcagtggagtggtcacggctcactgcagatttgacctctcaggctgaagcaatcctcctgcctcagcatccccaagaagctgggactacaagtgtgtgccaccacacccagctaatttttgtattttttatagagacggagtttcaccaaatcatccaggctggtctggaactcctgagctcaagtgatcttcctacctcgggctcccaaagtgctgggcttacaggtgtgagccactatgcatggcctgatcattttaaaattatttgtctttattttattgaattatgaaaattaaaaaaatatattctggctataagattttatcaggtatatgatttgcaaatattttctcccagtctgtgggttgtcaccttattcactttgatggtatcacttacagcacaaaaa

SEQ ID NO: 112440 - DNA, 1016 bp, Homo sapiens
tttgctttgcttcatttatttcttcacacagaactccaatttgtccaatttgctcttaagaaccaatccccaaaatataatgtctcctgccttttgtatttcctgaaagttttctttgtggcaatccacagagtgaagagtttattcattccccttttctttctctttctaaaaaagggattatattatcttcagtttttatatagcagagaagagaaaccctatgtatcagtgtttataaaatctagttaaaaagaatctcagagatttcttaaaatgtattcctgcagctaacatgactagccattttcaaattaggtttttggcacataagaatttatgtgcagaaatgcaagggctttaattttatgagtaattatagctctgaattttttatgttaactctttgaaaatcattttatgttttcttaattttcagatcaagagactgaaatctcatccttctatcatcatatggagtggcaataatgaaaatgaggaggcgctgatgatgaattggtatcatatcagtttcactgaccggccaatctacatcaaggactatgtgacactctatgtgaaaaacatcagagagctcgtactggcagtaagtaatgatttttaatgcagtagaatttaagaatgtatctttagggctgggcgtggtggctcacgcctgtaatcccagcactttgggaggctgaggcgggcggatcacaaggtcaggagatcgagaccacggtgaaaccccgtctctactaaaaatacaaaaaaaattagctgggcgcggtggcgggcgcctgtagtcccagctactcgggaggctgaggcaggagcatggcgtgaacccggaaggtagagcttgcagtgagccgagatcgcgccactgcactccagcctgggcgacagggcgagactccgtctcaaaaaaaaaaaaaagaatgtatgtttaaagtggataagtttgaatactggtatagtatgttttatgcccctttttagggctgtcttcaaca

SEQ ID NO: 112441 - DNA, 1049 bp, Homo sapiens
aattttttctaattttttatttttaatttgttaaaaattaaaaatgttgcccaggctggagtgcaatggtgcaatctcagcttactgcaccctcctccaccccaggttcaagcgattctcctgcctcaacctccggagcagctgggattacaggcatgtgctaaattttgtatttttagtaaattagcatccagctaatttttgtatttttagtagagatggggtttcaccgtgttgtccaggctggccttgaactcctgacctcaggtgatccacctgcctctgcctcccaaagtggtgagattacaggtgtgagccactgtacctggccctaatattgttattaagtacttttaatgtgttttgcaattgtgaggataaagcaaagaaaatatattctgttagttctattattgttgttctaaaatataaagagtgccaccgaagactaggaattattctaataatgataatgctgatggtcattgtgacgatgacaatattctataatattctctgagtgccaggcattgttctaagtgctctacatattttatcttcatgcccattcaatgatgtagttactattctctatccccatttacagataaggaaactgacacatgaagaggttatatattttatccaaactctaacaactcatttatggtggaatgaaattccgactcagacaggctgctttggggctatgatctttttttttttttttttttttttgatatggagtctggctctgttgcctaggctggaatgcagtggtgcgatcttggttcactgcagccttcacctcctgggttcaagcgattctcctgcctcagcctaccaagtagctgggattacagatgtgtgtcaccacgcccggctaatttttatatttctttcttttttttttgagacggagtcttgctctgtcacccaggctggagtgcagtggcacaatcttggctcactgcaagctctgcctcctgggttcacgccattctcctgcctcagcctcccgagtagctgggaccacaggcgctcaccac

SEQ ID NO: 112442 - DNA, 1073 bp, Homo sapiens
taaattacccattaaacaaagtgattttatggtaatgtgttattaagattgcaaagttgttaagttataacatttgattctaagatgcatgtttggctaccttttaacaacactgaaatgagaatgtgtttttcaaagacagcatttttttctatttttttgaaatagcatgtttttgttttaatttagagatgttatcttcaaattgtcttttttgatgttatcacaaatgcctatttcatgtggaagactacagtagctctttagtggtttctatatttctcttttaaaagagaaataacggatgctagcaataatttatatgtgtatattcctgaaatgtgcatttccacattatgtgcttcatagtaaataggaaaattagcattaaactactgaatgtagtttttcaaaaaggtctgctttttttaaaaaaactattttgcttatgtttaaatttgatattcatcatttaattctgttcattgcaggtttattttaggacagtggaacttatagaagagcctataaaagggtctcctggtttgagtttctatttcaaaattaatggatttcccatatttctaaaaggctcaaactggatcccagcagattcattccaggaccgagtaacctctgagttgtaagttattgtctttcttttcttgttcttcttttaattagcagtcccgcaaagcttgaggtttactcatttttactttctttagtctctgggcaaggaactaagaggtagtatagaattctagacgatggaaacttcagaatggacaggattttaaaaattatatattccattctcctgggttacaggtggtcttacagctaaactatttgagactgttgaagccattcgatttttagaaaactattatatgtttattctggagaaataagaaaatgagtaatttatattttgaatagtctccgaaaaaaatattacattcaactattttcagcttttcaaatgatacgttaaatgttttgagcatggttttgaaagataagaacacatatttaccttttttttttttttgagatggagtcttgctctg

SEQ ID NO: 112443 - DNA, 1032 bp, Homo sapiens
gttctctgttacattaaaattcatttgtctatcttgcactttgtgtgaattctttacccatattatgtgatattgtaatataatgcattggttattggaaaatgtttgtttcttgagagttacagatcttccaaatgttgaaacatttccttttataatatcacatttgttaatatcaccactgatgtcatctaaaaagtttttaagtatttaagtagtatctactaccgtgaggtagtagatacaagttttccctaatcccaatttttacttgaaagtttgaattttatccttggccacaaatactgctagttgtttttcttgaaatgataggctcactccattcattttctagagaatgtctgccaggtatccaagtctgaataaccatcgtttgtctgtcagtccttctttctatcaagtaaaaatggagtgtcgtgaacaaggccaattcagcttacatacaactctattaatggcccagaggcttttcctccagctatctattgtgaatggtgctttatggatattgctcatttcataatgcaggatattaaaatgatgcatactgagggttgggatttaatgaaattaatgtttactgctttatcaaggacagtcttaagtgaaactgtttttttttcattttcctgctgctaatgcatgaaggtgaaagatgtaatgactactagcagtttggagctactgccttgattcctgctaaggcaccagcagtgttaacccaccactgcttttgtaacgtcagtgcaaatgttaacacagtaattacaggatattattcaaaaaattatttagtactttgaatatttcagcacctcttgtatattgttgccaaaaattcacagaaaagaagttttttgatgatttatcgtgctgataacagacaaatacaggcaaactggcaagtccatctatatctggagattcactcatttgtaaagcaaaagtatgattatttcagatgagatatcaggccagtcttcatattgcagtcaaatctcttaattggac

SEQ ID NO: 112444 - DNA, 1776 bp, Homo sapiens
cttattacataactttaaaacccatttacattataaagtaaaatactattactttttactttataaagtatttttacttaattaaaaaggaacaaatgtgtattattcttggaaaatttattttatctttccatttgtcattttctgtttatgctccataaagtttttatgacttacaatcataacatttttagagtggaagtctatgtaaaatataccatttttgttattcttcttcagaatgaaggattaaactgaagattaaaagaaaatttccacgaagttttgattatgacagcattgtggagcacatactgggtttgaagctgctttagtcttaccttcaatgaatcctgagaaatgcagtgataatgcttagcatattatatatatatatatatatttctttttctttttatattttagataagagtgcccaggagtggaatctggaaatagagtctacatttgatgttgtcagctcaaagccagttggtggtcaagtgatcgtagccatccctaagttgcaaacacaacagacatacagcattgaacttcaacctgggaaaaggattgttgagctatttgtgaacattagcaaggtaaatgatggtacttcctgagaagcactggatgaaaagcaatacctgtgctaaagaaatgattagaaaggagggactaagtatgaaagaaaattctactttctctgcttatatttgtcattttcttctctattttagtctctcatatattttctgtgagtatgagctaaagaatgattttcccaaactttaagattaagaaaatagagaatatattattaatttggcaattctttctctcattttatttttatcattgtattttaattttctgtagtatttgtagtatcctaaagccaaaatacattctatggattatatttaaatagcagtggttatttttgatacttgtcaattattttgattattgatacttattctacatgcacaattttaattctaaactcatgatctttcatatatcaaggtagaacggattatttttatcttttctttttcttttttctattcctctaattgataattgtgtactgaaaaaggtggagcaaaataacattcagtagctgttgagataaagtaagaactcaaaatgatttttagtttttggcttgaaagaagagtcaacttcagagtcccattttaagtgttaagaatgtggaataaatgtaagctcggtgttagggatagggagagttgtttttctgaacactcatgttattctgttctttccttttgcttttgatgtattgatccatgctagattcccagcatgctgatttttaaatattatcaatgaattggtctgattgggcataatataggtggggagacttacattgttttagaacctagagttttgtacttgactatttgagaaattgatgtaatgctttgagccttttttgctgaaaatatgacatattagagtgacttttaaattttcttaaaagaatattactgtagaaacttggtggcctcatggacatggaaaccagactgggtacaacatgactgttctttttgaactggatggaggcttaaatattgaaaaatcagctaaggtaagtaagtaatttaaaatattttgtgaaataattttatttcttttaaaaatagtaatacagatcttcatgggaaaagaagaaaccgtcaaaactcttgtgtccccacccatcagagatcatctttagtaacagcattcaaaagcttctct

SEQ ID NO: 112445 - DNA, 3514 bp, Homo sapiens
ccttctgcctctacctaagtcccaaagccattttttcttgtaatatccaggaccaagtaatttcccaaactctaggattcagataaaattgttctagtaaaagcctagttctggccttggtggaaatttctgtggatagatagaatgtgtatactattttaacatttgtccataatgaactgtaaaaatttcttcacgttaaaattagagcatgagctcggtggtagagaaagaaagggtcttttgatttttgttagcctcccaattttcagtgctgctttcttagttgtttttaaaatactactttcagagcatcaggctctcatttcccacattgctttgagtaccagtgctatttctcccttgttggcttttattctaatcatagtcattagagatgacttcatgatgagtctggagatgataaaatggaaatctttcccttccatttaaagtattaggaattctttattttaacttttaaaaataacatctttatttacaggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcata

SEQ ID NO: 112446 - DNA, 1740 bp, Homo sapiens
accatatatggtgactggcacatagcaggcactcaaagtgaatgcgatctatgttccttaatgcttgacatcttatacatcagtatgttgaactggttaaggtaaaaactagagctgatgactcacttagtactaaagagattttggcattgtatttaactagtactcttgggaatatggtttcttgcttacaagttcaaggagacatttagtggagcacttgagggtttttctcagaaattgccaagacaacggctaagaatggatttttcatcatgcctaatggctatgaatatggcatgagtgttacctgcatattcttgctaaagtccccccccccccagccactgagtaccaagaaactcaagttctaatatcatttatgcctatttaaaatatatatattaatatggcatcagttgcctatcttagaaactatttttatggctagtctgcagtgaatttcatgccacaaaaccctgtttttagcacttcttacttaccaggagcttgtcttctgtgaaacaaaatctctgtaaaactgtgtctcattgagataaagatacaaactaataaaagtcttttgaggattgagttttgtaatacacggtttagaaaaatttatttatccaaactcctgaaactgggtaacagatgtttttgttttcttgcagttcttttatccatttgttcactgctatgtgatccaaacccagatgaccccctagtgccagagattgcacggatctataaaacagacagagataagtaagtatgttaaaaagttattataaaagtggttttacttaatgagttaggcttatactttgcttgtgacagtgccaagaagacttgatatttagtaagataatagttaaaatatggagaaagctattgaaatgtggttatttaaaaaaacttaactaggctttagcttatgtgacagtgaatgctcccctctaaaatgttttattgttgttttttttttcctagcgtgttaaacagtatcactttattctcaacttttggggaagaaagcaaatttttctttaccccaagcatgtttttccaaaaatgttagtactattgtaaaaatttggtctaaatttctcaaatatttgaattatatttatgttcaacttaaccattataactttcatatgttataattaatgctaagtgtacttgttcaattaggtacaataggttagcaagagagtggacagagaaatacgctatgttgtagggtaagaggatctgcactctatggtgcgcttattatggtactgccagcacttgagtgctgcatgcgttaaggcactgtattaactaacaaaaggtaacaaatatggcagtcttctgaaaactgtacatttaactgcttggtctctgtttaacgtgaaagtaaatatctggtagccgttattgcttgaaagtactgcatggcaaagcagttacaatagcactagtaagaaatgggaatttatgtagtatcttttttttttttcaaactatcatggtgtttaaattttagcttgagactttgtaccaatcctatacagaatgtggtggtttagttcaaattttgccgggagatagtaatgtaagggaaaaacacttttaagcctaagcatctaaactaaatgttcattactgacaagcatgcattagcgtcagctgtactttgtggctccctgtatgctaaataaagcctttgttttaaagtgctggctttttgag

SEQ ID NO: 112447 - DNA, 1050 bp, Homo sapiens
agaccatgtggaagcttccgccctcatctgtattattgttacacagattctgatttttgggcttttgttgtcttgtaagcatcaaatgtccaacttcaatttatatttgcacgtattgttacagcatatgcttattatgcttatagttttgtatacgtaagtgtaaatttgtgaaaacttagagttgcttagtgcactggtttataggtattaaaagcatattatccttcacttttcagtcattaacataaattcaacctgtatgaataactagaaaaggtaatatacaaaggtcataaacatgtcactataacaatctctagtaatgttataggtgcaatgtgatggtttccatttttgtgattcaagtttatgttttatgtacggtggaaatgcagactcaggtgtacctgtgtaacttaatgaaactttaaatgagatggtctacaaattttggttacatccaaaagttagggcttttataaatgaatgtgttaaatacctttaaattgccctttgattcatgatatggtagggccacagtaacctttagaactttacatcatatgagtaatgaaatttttatccaaaagtttaggtttctgttgtaaaaagaggaggcagggggttgtggtcagattgtaaaaatcagtttctataatatttagaacttctatgctaatagatgacatttttaacattgtggcttgattattttaagttttgctttaaaagatgtttgtttttatttgaataaaatacttaaaagtttttgttttaggttgcatttacaacaagaatttatcatccaaatattaacagtaatggcagcatttgtctcgatattctaagatcacagtggtcgcctgctttaacaatttctaaaggtaaatatttctagtgaaataagctgttctcattgtctaataaagcttcattcttagatctacttatctgagtatttttattatggcagctttttggtaagagatggggaagcaataaagttacttttataatttttgttcttttagtggtgttgattaaaga

SEQ ID NO: 112448 - DNA, 1817 bp, Homo sapiens
aatgttgagctctctctggtctaagctcttaaactatgagaatatctaattatagctatttcggtttgtaagagattggcttttatgtaaataaaaaattttgtatcaatgtgtttgcatatatatttttacgaactctagctaagatgattgtctcagcatatgttcaggcatgttctctctcctaatggaatatattatttatgtgaattgtgatggagtgtgcctttaaaaatagggtgaaagtaactgaaagcagtggactcatttgcttgttttcttaaattaagcttatgtgactcacccattttctgtcttggtgtaggaacttagtgatttggcccgtgaccctccagcacaatgttctgcaggtccagttggggatgatagtaagtaacttgcaagttgatttttatgcctaatttttttttaagcttgtgcatttttagataaccagagttttttttctttttctagtgtttcattggcaagccacaattatgggacctgtaagtattaagaatttttaaatttagttttaagtgaaaatccagcattgatttggttgtaatttttaacttggtctgtaggtttattttatcatatagttaattctattttggatattccatagttgtactgcatttgaaagaaaaaacataatgagttagtcatttgttacgtgtactttgtgtctatccctgtgttcacgttctagagtatagccatctctatgacctaccaaacatctctgtatctcagttcagtttttctacatagcactgtgtaaagcattgtcatggaacttcctgttatttatagagacaaagttactggctctgatatgccatgcgttgtgttactcagagatcttattctgttactgcagctgccaataatctagcttaattgtattttgatatttgattctttatagaacttcagtttatgcaaaatttgaatatatttaggcagaaagtgatattttgaatatagcaaaattcctttctatcctgggtagataagcaactatatgctggataattgaatattcagaattatggataccatctaagaatttcagagaattagagcgcactaaaacatcctggggtaagactgtatcttacacaaatatttaactttttttttttttttaacttgctaaggcgcttaaggatttgttttctaagttacatgtgtatcttcctgaaaactgtcttccctttttggtggttttataagcaacataaagagcaataatgtactaggtgagataatggtcagtaagtaatatttagaattctaaaggaaaaaatgctcttagagttagtagatgagtcgaatcaacaagtatttatttagtaattctgattctaactttagtcatttttctgtctcaaatgtgagtacatactgtgtgccaggtaataaggatacaaattgaacataataaacatccctgtcgatcttatagggaacttacactgtattagaggagacagatacctaaaacaagtgctgaagtgtgacaagatggaaaataagtgattggtgaatgaagtgctgagtaggataaattaatgggaaattgaagcagggaggattaatttagagtaattaaaatgttagtgccctaaaggtagaaaaactaaatcaaagtaagacatggcaggggtgcaaatattaagtttaatactttgaaacgtcctggatcattttaaaacaaagtaacatttaaaacagtaaaaatagtcctgtaataacgaaatgcacaatcctggctttgtagttattaaaagtacttacttttatct

SEQ ID NO: 112449 - DNA, 1160 bp, Homo sapiens
aaattctgtggttagtcatgtccaaataattggttaatgatggctgacccaggactacagtcacatgatttggagtaagggaaaaggaattcatgagtaagatggtttattgagtagacaaaatgtctgctagctacaaagagcatctgctatgacttactcttttctcacttttttttcctacgatactgtcttgctcattctgtgggcatataatgttacaaaaattatttggtagctcaaaggtaagtgcttgtgcatggttttgttactattgggtactaagtggtactttaaatagtaatattagatactatttaaatggcaagaaagaaagtggtgaaataagaacagcatttttatctttaaaaaagacctttgttttgattgttaaaatacttaggtcatttttctatattgaatttaaagtaggtaagtgtattgggctgattttatctctttgattattactaaagagatgtcttggtgatggagaacttcgaaagtaaggcatttagaaatgttaggagagtaacaagaacctgaaattacaggagtgaagagctgaaacccagtgttaactagctgaaattataccttcactctaaaaggatgataatgctagcatttaaaggcttagtgatggataaatatcagtgtgccgaaaactcatttattctataagaaatactttcttactttctttgtaattgaaatgtgtaatgttgaagtagtatggtgtttatattctaggtcaacttcatagttttctgacctttagttttatttataatgaagtattccaacattattgggtattgtgtttagaacaaccatgattacattgatttttattttaaaattaaaatattttatcttaatatttattctggccaggcacggtggctcacgcctgtaatcccagcactttgggaggccaaggtgatcacctgaggtcaggagtttgagaccagtgtggccaacatggtgaaaccccgtctctactaaaaatacaaaaaattagccgggtgtggtggcgcacatctctagttccagttactcggaaggctgaggcaggagaatcacttgaacccaggaggcagaggttgcagtgagccaagattgtgccattgtactccaccatgggcgacaagagtgaa

SEQ ID NO: 112450 - DNA, 1973 bp, Homo sapiens
taaacaggaagttaataccttgtcagtgatgcagtgagatactgtgcagtgcctactgttaaaccttaagataaaaaaggatttctcagaagaaatttcaaattaaaatgtgttttaaagggactatttggagttttgtgaaattgttcatatctttttgccaagcatccttctcttgaaataaccatgtttctgaagtttgttgttccctgccttgatattcgcatctacatattttatacagacatttcataacattaaagttaataaaactttatagtaaaccagatctttatatgaacagttacagtagttactgtctgcctgatggacagctaattgcactgcacttcgacctctattgttggttcgcacctttgtatttttctaggttggttgtaaagtcttcttgaggatgattcttaaaatttcttaaggcacttactccctttgtttcccacctcattttatcatctcttccagtccccaaagcagtgttttgtgttgctcagtataggtttttgaggcaagggctgtttttataatgctgattcacagtcatacaaatcttgtcttttgagtcatgtaaatcttgtctttagttctgaaagaaatagactctcaaatagaatacaagaaattaacctttagtaatggcataagcttttagttttccggaaagtgctgagaggaaatgtatctatactactgcgttctgtcctctgtatgacctttgtgtgatgacgtgcaaaatagatggtagagattgggataacaaatgatttgtggaacatcgtggtgataattttactgtcttaaaggtagaatccatgaacttggccttgccactatataggcttttgaattttgacaagccttggggggatgaaacctagaataagttatttatggcgttacgctttaatagggttgacacttaaaaccttgttttcataaatgctaccttttggttatgttgatctgatgaacagatactggctgtcattgaaagaaagttaaccgaatgttcagatacttattgggctcctggaacatggctgctctgtagcttcatgaatattcataatattcataaatatttgtgaataaatatttttagtatttccaatttataagctctttgaaaggagggaatttttttttttttttttgaggcggagtcttggtcagctgcccaggctagagtgcagtggcgcaactgcggcttactgcaaccaccgtctcctgggttcaagcaattctcctgtctcagcctctcgagtagctgggattacaggcacccgccatcatgcccggctaatttttatattttagtagagatgggatttcacgatgttggccaggctggtcttgaattcctgacctcaggtgatccgcctgccttggcttcccaaagtgctaggattacaagcgtgagccaccacgcccagcaagggaggggacattcttatgtttctcctagcatcctttcaggtctttaatgttttcaataccttggcctactgttctttgtagcctgtggttggtcaccactgctagtaccacttatcattgaatgaggaagatagagaatagagaagcagaaagcatagtttaacatctccaacaatcaactgttaaatcccatatcccatagtgactacagtaaaggtcttcctcaagataaaccatttgcaggctttgtattaaaaatctcatgtaaggaatgtttcagaataaaaaaaaaaatagtgaccaaacccattactgcttaaatcatgtacttccagatgagaacactcaccagtggcttaagctgtacctgttggttgccttttagagagatttttttggtgaaaaaaatcctgccctattttctaccatggtgcccaccaggtcttcaggaaataggcaaacaactcagttgtgtaaagtctgttgctgtctcaaatttctttgtagtgttttaacta

SEQ ID NO: 112451 - DNA, 6737 bp, Homo sapiens
tgagccccgtagggccggggaggcaccagctgccgcgcggggaggaggccgaggccgcagcttgagggaggccccggcccctctgtacgcgtgggtgtggacggctagggcagggaagggaggccggcccagtggccggccgggtaagaggggcagtgcgggacctgggcggcttgagcggccagcctattgggtgcggtgggttagggtgggaaggttggggaagccgcggcctctcctgctggaggaggagggggaatgggcgcgtcctcgcgcctaagccggagcctcagggacagcgcgggcgcgtggtggaggtggctgggcgggcgcgcgcgggagcgcgctggaaggcggagtgagtgtacggtggcgtcaggggtgacacagaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggtaacccgcggggacaagggcatggggtggtaggagaaaaggaaggctcgggccaagaggaaagcgtgggggtgggaaggaagcataattctgaaaatacctcttggatcacttcttccatggggggatggagaacgcagatatacttcttgaagaaatgaagtttaaagctaggaaacggagaacacttgtggcaagtgaggtgttatcctgagtgcttcagtggaatcggtgcaaattaggggtggaggagagtgacttaaggcgcctttattattttatttttttgctgcttaagaaggagtttttttgggggtccgaattgcggagagacgctccagcagatgtcatggcgcttcctattcttggtgcttgaaaacttagtttagttgtgagatcaaggttatctaggccttctaggggtaagaaagaaaactcggaggagagaaaaaaaatctggcgagtcccgaacttgactgagggtcgggtagaagaagtcttgcgtattgaaggtcagtcagtgagtctagtagaaactcttagtcgactctgggcaggttacaccgaataagtgggtttgggaggagatggaatgacacagtgttgccacttcctgtattttgtagttgcagcttttcacccgaagctatttatccgagggacaccgggaactgatgtaaaaggcattctggaagctcccttttccttttggctggagagtgggggtggataaggggtgcgatggcagtaagggaaagctaatgtacctatttttgcctcattctatttaataacacccttgtttcgttacttgaaatgtggtttgatagtatattatcgatttaagttgaaaaaaaactaggatttttcggagctctgggagtgagcggaacctccacctccggtggtttagtctcattttcttgctctaacttctatcccgcattttaagatggcggctgctttaactggttcaggctctttccggcatctcctttcgtaataatgtgaattaatatgatttgttaaatgttaacttttatatcgcgttgtgcactgctctaagatcctctgctcaaaacttacctaaattcaaactcttaaactgtatttcccttttttgtgacttgtatttgtgtgatgtgtttggttgttgcacaatcgaagagggtggagtgtttacagctaacttgaaaaaaatgtcatggaataaattcagccttactagaaaaattgtggagtgtcggtgagtgttagaaactttggttttaatagattacttttttaaaaagagttctgagaggaatggcaagaatttgcctttactaaaatagacctgatactacatttgcctgtatttaattatgactggagtttatttggcaagattggtgtttcatgaaagaggaaggtttaaatcttcactcttagtatgtattgatatgaaatcgtgaattttgttttgggccttcataacatcgtcattttgggttatgcgaaatacaaatttaaatctttgtgaaatgaaagaaaagaggaagaaacgctttttaggagttaaggattaaagtaaaaattattttgaaataattacctctttttgtgaccactttaaaggccaggaacatattggagaagcctagttgtatgttacagtgtggtttacacaaagagcataacattcagtacaaataaaaatcttttctgttggaattagttcaggccactaaaatgtggaatagtaccagatccatagctttttgtgcatgtggaacagaacacgttaaaggaaggcctctgattttttttctcttacaggtcatacccagctgctgtgacaccacttaaatgatttaaaagctttagagagacaatataacagtggttaagagtgtaaacattggagcagaaatgctccagttagaattctagctctgggcaagtttatgtgcctctataagaagggtatctgttgtaatatgaacaataaatgactgtgtgcctaatatgtaccaggcactgttttagacattggggtggcagcagtgaacaaaacaaattttaagttcctagatttgttttgacgattaaatggattaatgtgcaaatttgaacaggctcttggcacatgacactcctagttattactgctattttaatatcacaatttataatttttaaaaatcgtttttgtttaagaactttgatttctagtttagtactcttagttaaccaggttgtctccttttgtaaatattttgaagatttatgtaatatagacacaacataaaaacttggcatattggaaaaaccagtgtttatgtgaacattattgattcaacttacagaaactttgacgtgtgcatgtggtttggtttttcagctgttaatgttaaaatcacatgaggcaactttcaaacattccacatccaacaattttagtgagtggacagctctgaactggaatgctcttcggtttaggcacctcttctagaaatatggggtcaagtagccattgatgtcagtatggtatgcttgtgttacgtacctatttcgaatttattcttgtctgaaggtcccacatttcaagtattatgatatatctgtattcctcgttaatattttactgaaatgattattggaatagttttaacctttagtccatttgatcgagcttttgaatttatactttgcttcagctgtgttcttggagtaagttttttgactgttagaccaatcaacttttttcctgtattctttatttgaacgagctgtaatatggtcttaaatagggctattaaacaacaggagttaaaagtggcactccaagttgattggtattgagagctgtagacaattttaccactcccattaaacagggactacaatatatgtgttttagggacgtttgaagataaatatgtgaaccaagcctaaaagaatagctcatgttttcattgtatacaccctgttaagttttcgtaagggtttttatttctggaagtatgactttagtgtttatatatgattataagcaagcggctagcagggaaaccatgggtaaagggttaaaaaactctcatttgatcttcgtttccctcctaccaccacttccactgagataatttcaagattatctccatctcgaaattgaaaaacttaggcatagaggttaagaagatgacccaggttcatgttgtgacagttgggattagaacctaggcagcctggtccagagtatgtgctcttaacaactacagtttgatatcatcctttagtttttttttgtcattcagaacggtttacttttgcatatagtattatctattacagtagttaagacaatgcagtctcatctaaaccctaactcatttaatcctcaagacaaccatgtgggatagatgtgagaattttatagatgaagtaacaggctcagagaaatagtcgtctagtcacacaactagtaagtgactgggattcaaatcagataggcaccaaaagctcaagctcttttttgaaccatttcaattcctttttttgttgttgttggagacggagtctcactgtgttacccaggctggagtgcagtggcgcgatctcagctcactgcaagctctgccttctgggttcacgccattctcctgcctcagcctcctgagtagctgggactacaggcgcccaccaccacccccggctaatttttttgtttttttagtagaggcagggtttcaccgtgttaaccaggatggtcttgatctcctgacctcgtgatccacccgcctcagcctcccaaagtgctgggattacaggcgtgagccaccacgtggcctggcccttcaattcctgttttataatgtatgtgattttagtttgttacctgaaataagctgctttgctctcccacttatacatctaagtaattgggagttagctttactcttaggttatagctaatttgtgagttaagattttggctaataatattttgaaagtagaagtggatttaattcttttggggtagtctcttcaagcactgaaaactaacatgtgccagttaactgcttaggatgtcttagagtgaacaaaatatatttattgtccccaactagtatataggctgggtaaactgtcttgcatgtgtttcatatatggtcctcaaagcttgttgatagccagctcactttctgtgtaggatagttgtgactgaaggatgctgataataataggacctcagtatttgtttaatttgaaaaaggatgcattactgacactgcatacttttctttcatcatgctcatctgcagtgttgattctagtttttgttatttatacaaataaaaagttgaatgctccatcactgggatgaactactgtgtcactagattgctctgtcaaactttgcccctgagtttaggtgaccctttttatccaagacaggcaatctttgaggattctccacagcatgttgctataatctatctattaaaaaagaaactaggttcgtaacactgagataaaaaaatgtttcagattaaaatctcaaacctaggttggtttttgcattctttttttaaatagcagttttcttgtatctgttagcgtatagaagagcttactgaatattatatattgttgggtgtgacatgaattacatttatattccagaacatttggagtttttaaaaaaattttgtgggtacatagttggtgtatatatttatgggttgcatgaaatattttgatacaggtatgcaatgcataatcacatcagggtaaatggggtatatacctcgagcatttatcctttgtgttacaatccagttatacttgtttacttatttttaaatgtcagattgtttagaatttaaaaaaaaaaatacagctgcatgggggtcttagacttactaaatcattttccctggaaacacataattttgaaaattttctaggtgattctgaagctcctctctgattaagaaccacagatacaagggagtaaaggtcctaatctgcattagacgtagtattctagtcccagggaataaatgaggaagatggtccttatctatggtaatctctgcgttcagtggtgaaaataagcatgtaaacacatgaatagttgtttgtcactttgtaatttacctttcaagaatattagatctagtaggggaggtatttaaaataaattttctatactgtattttttgtactagtattattacaatgtgatttgtcttttattataatgacttaattccccttgccaaaaccagtattttgaaattaatgaaataaaactctccattcttggaaatgttgtggtcttgagcttgctaccatagcagtgttatttcataattaaaaatgaatgcattcaccaaatatcttactgcccagtttctcttattagataagatttattcagaattgtatcctcaaccttgttatgtagggaagggaaaagtttagggaagtatttttatactttgttgaaacatctgatttttatctcctaatgatactttcaacataatctattgtaaaagagaccttcaacttttcatagctgaatttgtcgtatttaaatgtttgtcaattgtgaatcatgatttcttgtacctttttcagtatgaaatacttacattaatcctaaccttgctgtaatttcatggctaatgtgtaattgaatgttttctactactgggcagctg

SEQ ID NO: 112452 - DNA, 1480 bp, Homo sapiens
aagagcagttttgtgcgcttttcctgacggggttccgcctccaaaatgcataagttctcgcgagacgcagtaaggcaccggctcgaactggggcgggccactgccaggaaagcaacgcccctgaatgcttatgccggtggttggtagaggaaatggaattccccagactggtaagagcgcgcgcagacacagccttgtctcacgcgcccaatcaggagcgtgtggtgggaggtgccaaggattaattaccagatacctttagtctagctcgggccgggattttgaggtttccggtggagcaggtgagcagtatttactcgcctgccctcctgggctggttatgctgtgggaggaggcgcccctcgagatgggaatagtagttttaaatagacccaggttggccgctcatcagcgctcccacgtgctgaagtctagtgcacgtctgaccctaagggagcaatactgagaacagcagggagcaggctgagtcaagctcaattgagtggatggggctaggacagagagagttaggggcagggttttcactggtctccgtaatcagtcgctgccgtccgccaaggtgtagatgtgggaacaagcttaaattctcaaactttagcttctgttgctgtgtttcagttcttgagccagaaagtgttgagactaattagttaattaggtagagtttagagtcagaaaaacaatacaatacttcctgaaatatccaagttgggaggtgggatttacctcagtaggattggcctgttttagtcaagggtttaaagtatggagacggcagttatgctctctagtgtatccttcaggcaaaagaaagaccttaatttttatgaggaatttaaaagtgggtaagcactgaccagcttaaggttttttaacattccttaatgaccccagttaccgaagtggagatcttcaattacttggaaaaataaacttgttttaaaaatacacttaatttgaaaactgttgcagaaagttttacctaataaaaacttaacacgtcaacaatgatgaatataagtagtctaatgtatactgttcaagtgaccatgtagtgtcactagtgaagcagtgcttctcaaactagtgtccataggaaccacctggggttttgttgaaaatgcgactttgatttggtagggcagtggtggagcctgagagcctacatttctaactagctcccaggtgatacagatttttctcgtctgaaccaccccgtgagtagcaaagcactgaagtgcttacctcatggcctaactgctcatgaggctcacctcagtaacacctctggcccctccctcctccctgaataatctgtgttctctctcatagctagccagatatactaaaagcacaggactaggcatgaagatggagggaggaacccagattagttattgcttcccatttgcttgatattggcctggttagttatcttctaaccccgtttcttcaccgc

SEQ ID NO: 112453 - DNA, 1061 bp, Homo sapiens
tatatcgcccaggctggatagttgtttttattaatatctctaaaagatttgaagggtaagaggagaaaatttcactcccttgaaataactttcttgctatgactttgtttcatattttggctgaagtcaaaatgtccgaagttgtgcacttgctgattggataatgtgtgtgatatcttaataatatgcctcattatttacagttctacacttaacaacatataataacgaactgctaatggtccagtatttcattgtgtatgacagtgtaacagccagttataataaatactttccatttttccccttggtatttttattttacagtgagaaaaggaaggaattttttaaagcaatctttcattctctggactgtataaatttagtgtttgtgattgtccttcactaaaaaagaatatcagtaatagagttgaccaaaatctagattaaataattttctatcattataattgttcaaaattgttaaagtaaaacttacaatggaaattctacaaacacgtttagatacaggttcatgtttttgagctagggcagtatagaagatggtgtatacaaagtgatgtttaaaaggttgatgggatttcctttagagagagtttggaggtaaaccctggagcttttttatcctgaagatgatggaacttgaatatccttgtcctctggactattctgttaactgttatctttaatctctgtggatctaatgtagaagcacccttgggtacaactagataccctagttgaggtaggggtaggttggaagtggggtacattaggaaaagaaaatctggaaaaggccattacctattcgtttcttctcttagaggatctgtcatcttgacaagggcaagacgtgctgtgttgagtttaatttttccccttggtattttaaagtgagaaaaggaaagaatttttttaaagcaactttacattctctggactgtataaatttaatgtttgtgattgttgtgcattaagaataagacctccaagcagtttttctttaaagaattaaaaaatacatacctcaatttaaagat

SEQ ID NO: 112454 - DNA, 1035 bp, Homo sapiens
cattacttttgtatttctgtaatttccatccaaatttagctgtaacatattgaccaaagagatattcaaatattttttaagaattcattggatatgttatatgaaactggagattttatgggtctcttttcttcttcacttatagtaatactttaaccatattactgatactagtatcagagatatggcagaagatgaaacgtgactaattgcaaattttgttacttggtagtaagtctgctaaaatatatggtgagaaagaaaatcaaaattttagacatttaatataacatttaaagacataatatcagagggtcaaaaatatataatagataatgtcaaatcttatattatatatttaatataaactaatttctaaatatctatctaattctagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaaggtgaatatttttaatatgctatattttaaaagctaaaacaactgaattttttacatatatttaggaaatcccctcattctggttggaaaatgttccaaaaggttttctgtcctcaagaaagtgtatgaatcaatcgaggaaagaaaatatttaggaaaagcacctggaaatatactaatatggaatcagaagttgagttaatcacatcaggcttctctttttcccaagttttatataatattattatattacctttatcaatctaattattttattcattgaaattttaattatacaattaatccatgaaaaatgtttgtaaaaggccggggacggtggctcatgcctgtaatcccagaactttgggaggtggaggcggacagatcgcgtggggtcaggagtttgagaccagtgtggccaacatggtgaaaccccatctctactaaaaatacaaaaattagctgggcatggtggtgtggtggtgggca

SEQ ID NO: 112455 - DNA, 1585 bp, Homo sapiens
taaaattggttttgttatataccattttactcaaagttgccatttccaataacctattgatgatgttaagtgagaacttactgtattcaaatatatctaaatattcagtacagtgggccaggcacggtggctcatgcccataatcccagcactttgggaggccaaggcaggaggaccacctgagcccaggagttcaaaaccagcctgggcaatatagcagaccttgtctttacaaaatattaaaaatttttctgggtctcagctactcaggaggctaaggcaagaggatcacttgagctcaggaggttaagcctacagtgagccatgtttgcatcactgcactcaccttggacaacagaatgagaccctgtcctcaaaaataaatatatattcagtacactgtcagtagagataatctctacatcttatctctgctgtcccttctgtatccacaattttcttacagcaccttctaagtatttattgaatcattttcctcctctccaaactttctcttttgctctagcttaggctatttgtttccaacttttgcgtggactgtggcagagccttcaatttggtctctgtctccagttttatcccaaactaattcaccaagaccctcacataaaaaacgcaagactcattatgttacttcctgcctaaaaccttcccatggtgccttactttgccaaagtggggggagacctttctatgatctggcccacccaagctcattctcctccctcctttccttgccctgtatgttccagcaacactaacttacttgttgaaccccatttaggtgtattgtttcttatcgccattcctttattcatgctgccttctctacttgcttgtaacctgccctttaccaaaataatgagagacatagtgcattagaaaagaaagtaaacatttccgttttctttctcagaaaaatgaactgtcatgtatctttattttctttcttttaagggatgttactggctggttttacgattaggaatgttccattcatcaatgaacatgtccatgttcctaacacatggtcttcaattttaagaagcattgcccttaccattattctaataagagctgggcttggactcgatccacaggtagatttacaattacaaatcgagtaaggttatttcaaatattagaggacggtgagaaagaaaaagaagcaaaaattttattttcctgttccaaatagagtctgtaaacaaacctaagataaagaaaaaaaggccgggcatggcggctcatgcctgtaatctacaaaaattagccgggctggtggcatttacctagtaatcccagctactcgggaggctgaggcaagagaattgcttgaacctgagagacggaggttgcagtgagctgagatagtgccactgcactccagcctgggggacagagcgagactccgtctcaaaaaacaaaacaaaacaaacaaacagaagaaaaaaacagaagaaaaaaagactgtatagaaatattggcaccctaatttctatgtctagccatcattatcactgatatgaagagaattgactgtgttgtaaggtctttattagcg

SEQ ID NO: 112456 - DNA, 1086 bp, Homo sapiens
ggcacgcaccaccacgcctggctaatttttgtatttttagtagagacgggatttcactgtgttggccaggctggcctcaaactcctgaacctcatgtgatccagcctgcctcagcctcccaaagtgctgggattaaggtgtgagccactgcacctggcccacatataggttttaaatatttttaaagtaaaaacactttgtttgaaacctacttcataaattgacaggttatttggaatatatgttaagcagatatctctttcaccaaactagtaagcaatgttgatctataccatgtatcattttataaaactggctattagtatatatgataaaagagaattgatcctttgtttgtatacatctatgtgtatgtagatatatagctgtacacttttttgtatttcaggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttggtaagtatataattagctctcttttctttattattgactatatgcaaatgttgaacattttcttgttgaattagttataattcagaaatatttcaatgtagtatgttttatatagtttcttcatgtatgtatttactgtatgtgtgtgtgtgtgtacagctcctttatagatgcatttatttctctgtctacatatatacacacaagttttatccaaaatttatttttaaaataaatttaatatccttagtacattattcctgttgctttattgtttaatagaatctttaaaaattttagattcacggggtacatatgcaggtttggtacatggatatattgcataatggtgacatttgggctctagtgaacccatcaccaaatagtgaatactatacccaataggtaatttttcaaccttaaccctccaaccctctctccttttggactccccagtgtctattatttccatctttaggtccatatgtacccattgtttagtgccc

SEQ ID NO: 112457 - DNA, 1080 bp, Homo sapiens
gcccaaactgtaggcacctttattcagtatacacaaatgattgaaaatagtggggacccaagtctataaaaggttcaatcaaggtaccttgcaaaatacactgctgttacatccccaaacagctactgatatggagcatgaatcttcttttgtatctgtgattcctcgcattgacagtaataatataaatttaattctaaaatttggtggtttatttcattcataaaattatacagaaagtatggttccttaaagattttcttgttttactacagagtctcattgatcctaataatactgcacaggaagaaactaaaactgtcttatcagatacagaagaaataaaaccacagacaaaaaaggagacatacatttcttgtcctctaagaggagtattgaatgtaattattacaaatggtatgtgaaacaaaaaatgtaaatgaagagaagatgagaaatatgtttgataaatattaaaacatgagacaacaaagacactacttaatcaatatactccagatcagatgatcagctttgttacaagcaatatgtgaacaaagaggaaatattttcttgaatctttcaaagataaaaacaaaaacaaaatattgcctaggaggtgtatgttttaatatttgtcatacttttttatgttaaatttttgggattagaaacatcattgattaaaggattttatttaaaacctactttgacatttagttttaagttagctagaaagaacattataattttggaaataattatgtttcttattaaaattgggccctaagttttaaaacagcagcaaccttgtaaaaagttgtataacacttgctttcccactacaattttaaagcatagtgttgttgtcagcaaatacttataaagagattttcttgtgtatgtttttctaaatattctgtttgattaaacctatgagagaaagagattttggcttccagaagtatatagaattttgttccctatagagaacaaaaaattgattaaaaatgatgaagcacaagtaattgaagttttaaatttttattttcttatttgctgcttgctaactttaaactt

SEQ ID NO: 112458 - DNA, 1061 bp, Homo sapiens
atgttggacctacagatccttcaaatgggccacataaaaagatagtatgtatcagtaacttatagatgtaggtattaatgtagttggtcatatttcatttaaaatttttctggagtgttttatgtaagagcatgacagaagatagattaaatcaacagtggatattaactcaaacacaccagttcagtgcataaaataaatttctgcattttctgatacatgattctatgatatgggccagcattatgaactgttgagaaatattacatttctgtatgataatggtttttaaaacttatgcatatggctttggttaataatgttaaagatgaatatttggatctatgttgactataaagatatctgacttgactgtgatacaactttagaacaaaaaatcctttaaaaaattaatcccacttaaccatgtttgttttcatatggatttatagtcttgtttcttcttttaaagtatttttcttttaaatcttagcatgcataccacagaatcaaaaaatgaacatttggaggatgaaaacttccaaacatctacaactcctcaggtaaaaacttaaaagtatactgtaatatatgatataaaatcaacctgatcttaaaatttattcctaatttacttattagataggtttcttttatatatctggttaaaaatgaaaagtggtaaattttaaaatagctagttgtaatgggtcctaggaaatgagcagaaataatgaaacaaatggaaaggtgtgactatagagcattttggagctaaagagcacagattttaggaataagaagaaatgtcgcttattatttctcaccacattcagggaaaactcagtaacttaaactaacagaggtaaagataagtctagattaattaaaatgttgtgctgtgtgttttgaagagacccaagttttttatttttatagatatatagagcaagtcgttagaccttttgttgatctagttttacttagtaataattgctcataattagaattgtaaatttcgtatttttttaaaatagagatttctacagttcttaagggtc

SEQ ID NO: 112459 - DNA, 1076 bp, Homo sapiens
aggtaattttatttagataagaagaatgattgccataataacaagagaccacagaaaccagttagtacatttttcttaggacagtctgtgaagaagtgctttatgtgtggagaaactttaatataattttctgcacaatgtgctaacaaaaaattttttttaattaaagtttcctaaatcctatatgctatgggggaaaatgtaggttccacttacatatttaagaatatggaaagcagaaactgtctttaaaatgtttcttctttgtaattagatgcttcatgttgatgattgtggaataaaacctgtgtatttgttggatttagagctctaagtttttttaatatatttttcaggctctactgtctttaatgtcctcagaggagttttggaggtggtaattggtgtggcaactggatctgttcttggatttttcattcagtactttccaagccgtgaccaggtgaaagaaataatatgtgggaaagttgtgctctgaaatatcattgggaaaacattctagaacacttccttcaaagacagatgtgaaggacatgtttgagcaaatggttcctcattttaaaattgcttactgctatccatgagatttatgaagtgggctcaatatagaagattttaatgcagtcctgtaatgggttcccgtattatattctgtacatttcaaattccactgtaaaacaaataatatcgttccaaagtaataggatatgcaagttttttaagtgttcataatactcaactaaacccagatatataatagcttttttgtgcccttttttagtatcaaaataccttagattctagccaggcctggtagtcccagccactcaggaggctgaggcaaaaggatccctctgggagtttgagtccagtctgggcaacacagcaagagcccatatctaatacatacatgcatacacacatacataaatcagtcaatcatcatctagtgccactttgttcagtacagtagccactagctacacgtggctatagcagatacagaacatttccatcatcactaaacattctattggaaaacactgctctagtac

SEQ ID NO: 112460 - DNA, 1031 bp, Homo sapiens
tattacctctcagtttaactatggtttgtctaatagttcattttaggacaaaatggggagtaaacttctccaactctgaggtgaaatacaccatcttcatgaccaaacacggtgaatcacgttgccatttttcattcttcacatctctcctgtcttaacctcctttccacttccagctgtgcttggtttttgtgtatttttgtaataggatgaatgttgttttcattttctttctcagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcaccgctcttctatataatgttaatggtttcttggtgaggtagtctctcttgttgactcagtattttgctatgaaaatatacacaagttttctggatctggatttaaattcttaaaggatagcagaggctatgtcctcttaactttccagttctaatattccttttactgtaataaccacagaagttctttctcacatttctggtaacctacctatcccaatccctatacaaactctctaaattggttggtttattatagactttgtttttcattgcccctcactc

SEQ ID NO: 112461 - DNA, 1047 bp, Homo sapiens
ttacagtaagaaaggtacatcaaagattcatctatccaggagactaatttgtcaaattattgtggcaaagcatcaatagataagccactctggattatatcattgattcatttgaaaacctaatgttgtacttagagctttcttttcaagactccatgatcatggaaacttactatattattcaatttatatagatccattttgttttctgaactttgaaaatagtcaaaacaggaagcatgaggttgaaattaaaatgtaaatgtgataaaatgtacattttatgttatatatatttcatcacaatttatttttaatttttaaatataaatgtgaatacatcttaagaatcaagaagtcttacagtctctcttttcttcccccacatttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccaggtaagtaaatatactggttacttggaaatcagagggtaacagttggaacttatcattaatatgtgatcccaaagggcaagtttagataagagatgatttagttgagtaagctacaatgacaggcttcatttgctgactctgtaagaaagttgatttctccaaggcaccccacacagtgaagtgcaattcacttttaccccaagtgaagtctttagtctaccctttaagcctttagtttcgtccaaagagagacaagcaactttctcaaggacatgaagatactaccctaaaaagcaacttttactgaaaagtcttatcaattcaatggaccaaaatatccaatagcattatatttactttacccaag

SEQ ID NO: 112462 - DNA, 4575 bp, Homo sapiens
atgcgtaaactaacaactcataaaatgtctctttctactggagaacagtgatcagaatttgacctttgtagcaccttagaccagagctgcagtcagggtttgctttcctgaccatacagaaataaagctgcactttctctttcatgctccttataccttcaaatatttctaggaccccatggtaaaaaataattaggtaattataattttgttcaatatacaatgaattaggcctccagaagctttaaaagaactggggtttctcaatataagaaaatcggactgtccctgcacccaagcagaatgcttctagtttgatggcattaatgccataaggcacatggcaccagagaggtatcacgagggcttatctactgccacttacaggcattatgtcaatgtgatgtgttagaaaatccttcacagcagttctgtttattctcctgtaaaaaatcagttgctgagctttttacatatttttattgtttttgttagaatcagtgctacaaaagccactgtagaatatcaaaaggaagttataaggctattgagagaaaatctcagaagaagtcaacaggcccaagatacctcaggtaagtagaaaatgcagatattttcagatgaaattttacttctcaacacacaacagactttgaagactaatattatgtagtatgtgacagtcgagagtaaacagaagttggccactaatctatttttaaatgaatttattggaaccatatttccagatatcttgtgacatcgtttgttgtaatcttagatgcttatccattatagattcttgaaaaatacgaactctgcttttgtattgtcaaatctttacctattagtgaagataccttcaggcaataaaggaatgacttatactatatcaacatggaattatgcttcccaataaaacgaaacacatgtcttcgtagattttaattgtatgcatctaataagttataattggtgtacagtaaaaataaatactattctgtttgttcttgaaactaaaaataccaagttaatatttacttgcaaaggtctttgaaatttatctgagatactttttagatctgttggtcaaatttctcaatatacatgcattcctcaaactacctttattcatattctgtctgtcatgttccatttgaaaagaaagaatgcttgaacagtacttgagatagctttacgcagtagaacaagtactgaactaagatgcagatctcaatggctatatgaaatcgtggggttagcacctgaccttctaacttataagcatatatgtatgcttatatatatacttattataagtatatatacacttataagtatatatacacttattatacatatataagtatacataataaatatataagtatatatagtataagtgtataatatataagtaatatatctattacttctttattacttacatgagtaatatataagtaatataaaatatatattacttatatattatatattatatataagttatatattatatataatatatattataatatatataagtataacatatataagtaatatataagttatatattatatataagtaatatgtaagtaatatatataagtaatatataagtatatatagtaaatacttatataattagaagtattatacttataagtctatagaagtatatatacgagtatatgtacttatatactcatacatacttttttacaggagaataaacagaactgctgtgaaggattttctaatatatacatatatatgtatacacttatatatacttataagtatatatacacatatacttaaaagtatatatatacacttatatacttataagtatatatacacttatatacttataagtatatatacacttatatacttataagtatatatacacatatacttataagtatatatatacacttatatatacacttatatacttataagtatatatatacacttatatacttataagtatatatatacacttatatacttataagtatatatatacacttatatacttataagtatatatatacacttatatacttataagtatatatatacacttatatacttataagtatatatgtacacttatatacttataagtatatatgtacacttatatacttataagtatatatgtacacttatatacttataagtatatatatacacttatatacttataagtatatatatacacttatatacttataagtatatatatacacttatatacttataagtatatatatacacttatatacttataagtatatatatacacttatatacttataagtatatatatacacttatatatacttacaagtatatatgcagacttatatatacttataagtatatatccacttatatatacttacaagtatatatacagacttatatatacttataagtatgtatacatttataagtatatatacatacatacacatatatacttataagtgtatatatgtatatgtatatgtgtatatatacatgtatacataagtatacttagtatatataagtatatatgtatagatatgtatatataagtatatgtatgtataagtatataagtatatacatatatatgtaagtgtatatttgtgcgtgcacatgtatatatgtgtatatacttacatatatatacttatatataagtgtatatatatatacacttataagtatatagtacaagcaaatatcttatgttttgcttagtatttggaattttcaatatgcaatatatattatatataatacttatatatttacagaatatatagaattctgtatattatatgttacaggatacatataagtgtatacacatatatatgcatgtgcacacatatatatagttatgctcacacatatatatggacatggtatatgcacatattttttgcaggtagtaacacttcagtcatggggaaagtaatttttagagctcatgtaataagtgtcttttttaaaaaagtgtatatacatatacacttatttatatacatgcacacgcacacacacgtacataaagatcaaaccgaaagttgtgggtaaaaacacattgaaaattccaaatactaagcaaaacataagatgatatttgcttgtattatagtccacttgtttccaaaaatagatggtgctaaaggtgttaaggtgttacctagtacctgttgtagcttaaacttccctagtgtctgttacaggataaccacagcacctaccgagaaaacttaaaggggtaaaaatagaagtgaggattctttgtttcagaaggttgaggatatttattcttgatttgtagatgactttcaggtacatagtgtagatgaattcaaaataaaatagacatcaagaatcacccccaacacacacactatccctcttttgtgaattcccagtgacctaatggattaatccacttcataactatctcacattttgtgcaactttgcctacaatttacaaaacacagtctctttacacacatagtgtagaatatttaatatgtgctttaatattattgtaacatatatttagttaataatatgtattgaatacatataatgcactgaatgacggggtggccctcccaccctacctcacctccccgccacacacgcagtgtgttgtaacaagcccttcaggggaaaactgatgtagaaaatatagatcaataaaggacagcagtaagtggagaggattgctattgctgcagtcagggtgaaagagcttggtgatcaggatcaggatatgttagtggaattggttgagggggattctagaggcatagaattaatggttggtcaaataagcagagggagtaaggtagaaggcagaagtcaagggtgacttccagggaaataagacttgagctgtttgggtctctataatggcttattgtacttggtagtatttcctttattttgaactttggagacaattaaaattatcacctatttgtatattttcctcccacagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaaggtaagatctgcttacatgatacggatattatgcttacggctattacatatatgtagggacatggtatatgcacgtattttttgcaggtggtaacacttcagtcattatggggaaagtaatttttagagctcaggtaataagtatcttttttaaaaaatgagaatatggtagcactattccaatgtttgctgtctatcaactgaccaattcttaaccaaggcaagaaataggaaagaaacaaagacctttgagggggcagctgaaatacaccacaagtccatatacccaagccagtgaggctttacttagagaggaactccttacgtccattattgtaggctttttactttataaa

SEQ ID NO: 112463 - DNA, 1032 bp, Homo sapiens
cctcaatatatgattttttttcttattaagttgagaacttttaccttctcacttacaagaagcacttgacagcttcacggtggcatatctaaattgccagcattactactcttgtgctttggggccattattaattaaaataagggttacttggacacaagtactgcaatacagcagcaatcggataatcagggtggctatcaagtgaacaagtagtgtatgctggacaagaggatgatttacatcccaggcaggactgagcaggatgactcaaaatttcactgtgctactcagaatgatgtgcaattcaaaacctgtgaattgtttatttctggaatttcccatttaatattttcagaccacttttgactgagggtaactgaaaccatggaaaataaaattgcaggtaagtggggactactataaatcgttttagagctataatggtattttactgttcaataggccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagaggtatataatttcttataaaatgttcttcagtttgcagcttcatcacagagtttagagcaaaattatagtatttacttattactgaacatgaacacatttatttttgtaagtgatgggcttgatttttactagtagttctactatggctatcgttcaactaaactaattataaagctagacattatgtaagatattattataaaacataaattgtagcttcatttgattattacattcataaactatagtttaagttactaccagttaacgtacaattaccacaaaagttttccaaattatgtgactttctgttgaactgtgatctatgtccgtatgcagaacaaatat

SEQ ID NO: 112464 - DNA, 1227 bp, Homo sapiens
aaaacagattgtaggcagatagtaggattgtgtgaagtatctgtaccaagctgacaaataggtggtttgattcttaatcacttgttttatctgctaactcagactgcctactataaacataaaccagcactcaaccatgaactacaatacatacttaattgaatttactcaaatttctcatcagactttgtcaatgttgattcatatcatggatattcaaaaaactaaaagaaaatgcatcaaaatgttaagaatggttggtcctggctttctttgttatatttgcttaaattttttaaattgccataataattatctattatttctgttatccaaaatgacaacaagagtttccttttgtttttagacacaaaggtctttatttctctcctacagaaaatgttaaagcataagttttgttacaattctagagttgtaactacttattgtgatattagaatgaattgttataaattgagtgaattctcatttcctttaggagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaaggtaccatcttttttagtaatatccttttaaatatttcagttataaacatcaatgtatttaagtcctgcttcaggtgccggcatatttgctatttagtattcttactaccaaattaaagattatgtgggtctgagcatagtaatatgtaggatatcagcaacacctgaactctgcctgtgggcctagacattatgtcaggatgttcaggaggcagatgtgagttaacatctcaaagatctcatagtctggggtgagacagacatataaacaagtattaagtgcaatgatagaagtgtatgcaagttatatgacgtactaaataaaattacagaagatgaaactgtagtagaagccagactcaataacaaagcttggagttctttttgtagatggggaatcattagactattgttttaagtggtggtggtaacaggatctgattaccacttaggtactaaactaaagaatacagaagaaatgagtttgagggagataagcctagtagcaga

SEQ ID NO: 112465 - DNA, 1558 bp, Homo sapiens
gctcttattggtgaagttaaaaggaaaaaagggaagataaatataaaaattaagttcctctggtatgactatttatagatattcagaatcatatatcttaaaatatctaattaaatcctctttttgaaagtaacagagttcagacaagtttattaaaatctgtaaaaatcttttttattctcatatttctttatgtgggcctgaactaaatttatagagagatttaattcattcatcaaatattcttctaggtactgtagtgaacaagataagtgggagaaaatgtttttgtttcactttatactttttaatcagaaatgcaaaatgtacacaggatatgaacttttccaaggtgctgggaagaatatatgactagggtttgaaacaccatagacagtacaggtggttttgccagtatatttggttggcgccaataaagtgcattaggataaaagcaagtgccactgttaaaactacaagtgaataatgcagagatttggaagagtaggaatcagaaattaaaatctaatttatttgttttcctggttgtttatttatttatttatttatttttatagagacagggtctcactatgttgctgaggctggttttgagctcctgagctcaagtgatcctcctgcctcgatctcctaaagtgctaggattacaggcgtgagctaccatgcctggccctaaaacctaatttgtagctatgaaaaacaaatcctgtctccaaaaattagatgatttttctacttttttaccaatgagttaaggtcactccctataaaacttactgatactattattcattttctgatcattttaacattgcttttgagtgacaagtataatatttaattccattattgaaatgtcatgtaatttagaagtgtgcgattagacattatatgtgaatatagtcatgacaaaagccctgtttattttctttttaccaaagcaggaccgacagaaccaccaagtaaaacctgaaaaaaggttactaagtgatggacaacagcaccttacggaaagcctgagagaaaagtgctctagaataaaagtaagtaccccctgttaaaactacaaatgattattggttgtcttccaaaggcttaccgaaacctgaagtgggattgaaggaacctctggaataaatagatagtgctcagtatttttctaaacattgtaatctagtacaggtgtgtgggtataatgcatatatacacacatacacaaacaacaatgggagcttgtgaatttaagtcctcaccagaaaagtgatacttgagcaaatacctgaacgaggtaaagggtcaggccatacagatgtctgaaaagaccattataggcaaagggaacagcgagtacaaagttcctgaggcagaagactctgtggtggttcaaggaatatcgaaaagagggcaagctgctaatgaatgagatcagagagttagcagggaagaggcaagctgtgggacatgaaaaaagactgagttttattaagtgaggtggagatccattggggaatttttaccgcaagagaaacataatctg

SEQ ID NO: 112466 - DNA, 2530 bp, Homo sapiens
cctacatatatactgttaaaggagtgtgtgtgtatatacaaacacaacgtatacatatgccacaggttatttattgtagtgattttaattaaaaatctgaaacaatctaaatgttcctcagaaggaaacagtaaatatgaacaatatatcgaaatactatgcaacacttaaaaaaagtaatatatgtgtaatgtgtttgcctctggaaagcagaagtagagtgtgaagagaggaggacagggaagagaaagcctgtaccttaaaaacaacagcaaagatatagagtaacagtgttattatttttactaagaaaatatatcactttattttttaaaaactaatattaagatatgtcactgtttttaaaatttctctaatggtaaaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaaggtatttttatggggggattgtttgattggatatctaatttgtttgtgcctaaaattgttggggatataaaatggttcaaccacactggaaaacaccttggcagtatttactaatgctggatgtagcctgcctgaggcccaacatttccacttcttgggtatgtacataagagaaaagagtacgtacatacttctataaaaagacacaagaatgtttatagcagccttattcaaaataacaaaaaactgaaaactcaaatgtctatcagcaggaaaatggatacatacattgtgatatataggttcaaaagcaggcaaaactgaaccaggatgataaaggtcagaatagtggctgtctctaggaaggagcacacagaaactttatgaagtgctagaaatattctctgttttaatctgggttgtagtttcatagatttacacctgtgtcaagaataattaagttatacattgaagatgagcatgctttatatatattatacctcaaaagaaagtaaaattctgtgtggaattgtgcaggatatcagtgagagtaacatgggtagacagttgtcttaatcaatttagaaactattatttatctgtccctaaaaagccacctaacatattattttatgattatcttaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagtgagttgtgttctctctttaccctaccattatattcacatatttgggcaaaaatacagtgttcactgcagcgttgtgtctggtgactaaaacctagaaataatctaagtgtccaccaataataaggcactatctgtataatggaaaactaagcataagaatggggtattctttttgtgatattgatttagaaagatgtccaagtggtatgaaaggagaaggctatgggtgaggctaccagcagaaaattttactttactcttctaatttaggaggttgtataatggttgtttttaactgtgagtgtataatttttaagattttgtttaaactcaatcattaagtaaaggtaacgtgcctttatatcattacatttcttgatttcttctaaccataaaggatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaaggtatgtgttgttttgttcttcttttggaagtaactgtgcccaaaattatttgtggaattaaaaagatatagatacagatatgtagatagatatgtgcatatagaacacaagtagacactatttgccttccttgaagaaactgcttacattctaacttgttttacaattatctcaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagtgagttcagagtcttcctttgtgt

SEQ ID NO: 112467 - DNA, 1026 bp, Homo sapiens
gcacaactgtataaagatatttgtaggatattctttgcaacaagttgcaataatgaaataacacaaacaaaaacagggaaaattctaaccatccattggtaagggactggttaaataagtgcagcacattcacgtcatggaattctatgccacaaataaaaaatgtggtagagctatagtgctgatttgaagggtgaagtgtcctgttagggaacagggtaagttcaggaatagtgtatctagaatgtattgacatctaaaagtagcttagagggtgagaactaggaggcctcagaagagggtggaagatttttacctcctgccctatacctttctatagcatgtggatggtactactctcaatgtattatttttatttttctattgataaaggacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggtattttatttttaagttatctcagttactgagagtttgaatcaaactttttgtgtaatgaaacaagatatgaattaccctaaaattgaaggcaagtgaagacttacttgcctactcaatttagaaactatcattgatctttttatatctactgataatcctaacttattgtatgattatctcaagatccaagaacttcaggagaaagaacatcaacttcttttttttttttttttttttttttgagacagagtctcgctctgtcgcctggagtgcaacggcatgatctcggctcactgcaatgtctgcctcccgggttcaagcgattctcctgcctcaagtctcccaagtaactaggattacagatgcatgtcatcacacccagctaatttttgtatttttagtagagaggaggtttcaccgtgttgaccagggtggtctcgatctcctgacctcatgatccacccgcctcgg

SEQ ID NO: 112468 - DNA, 2211 bp, Homo sapiens
aagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaagtaggtttcatctttcaccatgtttttaaaaaatattttgtaaccaaatattattataaaccctaaatatttggaaaggggagttaattacaacaaaatagttataatgtttctataaatttattggaatttcctctaataataaagcacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaaggtaaattggggatgaagaaacagtgggaggaaatgggtgggtttggagtagctaactgaattatgaagactactatttggcatgcttaattgttttgggaagcaaccttttcctcttaagttgtgtatgtgtgtgtgtgtgtttacatatttttatgactattaacttattttataattatgtttaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaagtaagttcccatcttattttttttttttttggatacagaaatagtgttaaggtgataatgacggtgttcatgttaagttttattaattttcctctaatcataaagggaccggaaataaaagaggaatcaaaaactgcttatattcaactgagtaccagtaaactgttagtagacagaatatttcagagaagacagctcaagtagcaaatattcattgggatttaggaaattctgatggtgaattacaggaaaaagtgggacttgttaaattggaaaatgacatctaattattgttactcatatcccttatgaaagaaagtactacatacattagattacaatgtaaaaatgattgccttattttaggaacagttcttccttttcctaaaaaaattctgcctatgttgtaacttactttataattttctcagatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagtgagttaccatctctctacacctctagtaactatgacattgagtcctaagagaaaaatctgccatagggttggtgggagtataaaattggtccaggccgggcgcggtggctcgagccggtaatcccagcactttgggaggccagggcgggcagatcacgaggtcaggagatcaagaccatcctggctaacatggtgaaacgccatctctactaaaaacataaaaaattaggcaggcgtggtggtgggcgcctgtagtcccagctacttgggaggctgagacaggagaatggcgtgaacccaggaggcggaggttgcagtgagccaagatcgcaccactgcactccagcctgggcgacagagcaagactccatctcaaaaagtaaaataaaataaaaaataataaaataagataaaattggtccaatattgaggaaagttggtgagggtatatttg

SEQ ID NO: 112469 - DNA, 3527 bp, Homo sapiens
tatctccttaatcagtttatctccttaatcagcctgtatcagtttcctagggctgccatagcaaattgctgtaaacttgatggcttacaatagagacatattctgtcacagttctgagtcctagaagtccaaatttaagtgtcagcaataccatattccctctgaaggctctaaggaagaatcattccttacttcttcctagcttccagtgtctcccagctacccttcgcattccttggcttgtaactgcttcacatgacctccttctctgtgcctctctatgtgcttttatgtctcttataaatacactcattggaatgaagacctactccagtaggatcacgtctcaatcctaatccaattacatctgcaaagactctatttccaaataagttcacattctgaggttcctgggagacatgaattttgggtgggacaatattcaaaccactgcagacatttatgcctgtgagtttcatttacttttaatgctacttacctatttatatgctgataggaggcaaggctgttaatgattttgtgtaagaattttgagaatataagtaaaatggtaattataaaaattgtgcattttaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacagtaagttatacccttttccttcatctattaagtgtttcttttaaaatctgagccacttggaaagaggggagcaatgttggaagaatattacaatattctttaaatttcactcgccaagggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagaggtatgtcttttattcctttcatcctttgtcacttcttccttcctttctcctttgaaggaaagataagcagtaagaagtagctaggatgtggttcattaattgactgggtaagtatttgtcgagtgtttaatgtggcaggcacactcctaggttatagaaatgcaatgagaacaaggtggacaaaacccctaaaatccctctgatccatttgtagtgaaagaaagtagctgataaataagcaatcaaatgaacaagaaaacattaaatagtggtaaatgctatggagaaagtgaaacattgggattactgggccaacctgtattaaaagcctactccatgccagacattgagactgtagatataaataagacattgttctttccccccattataaactagaaagaaaatcccttaattccaatatggtaaatgcagaaatacgcaaaattacatggtaccactaatttatcatggaaagagaaatcaatctatacacatagaaaaattgagacatagcattggagcccatctgaaaatggagatcatacatttattgggatatagtttgctcagctatggtttttctcttatagcttggaaactagtggagaaataagtatgaaacagactgctagcaaagtataattggttcactttgggtctaagctacaaagaaagaaaagtatgacagaatgtgacccagaaaagtcatgaatagctttagcaggaattgagggaaaatgaataatgagcagtttgtgatccaaggtaggcctgagggttcaagatgactttccttgctgtgaaaagtatcctgatcttttccctttaaaaatttatgataatggccagtgggatgcggtggctcacacctgtaatcccagcactttgggaggccaaggcaggcagatcacctgaggtcaggagtttgagaccagcctggccaacatggtgaaaccccgtctctactaaaaatacaaaaattagccaggcatggtagcacacacctgtaatcccagctactcaggagactgagacaggagaatctcttgaacccaggaggcagaagttgcagtgaactgagattgcgccactgcactcccacctgggcaacagagtgagatgccgtctcaaaaaaaaaaaaattatgatcataatctcctgatagtaaccttggtattttatgaatgtcctaagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaagtaagtttcgtattttcctcccattttaacaagtgtcttataagaatcaaggcttgtgtttgtgttatagttataatgtttgtattataattatgttaccagtttttttaatgtctcttaatcatgaaatgactagaaacagaacaattaaaaattgctcttgaataccaagaaggtattgaaacagagagaagatgtttcagagaaaagaactgttttcttaaatattcaaaaaataatttagaaaaaataattctaaattacaagaaagggtgaaaccaaatatgagattgttttattttcttttttaaacctgttcctttaatgtttcataaagcactactgtgctttctcattgttttagtcagaaatctgggagctatccctactaatatgcctccttctctgcttattctgtaatccagtcaccaaatcttattgatttgagtgtgtattttaaaagtcatcctgcttttctctccacactgccaccaccctaatccaagtcaacatcatttctttccctggctatctgcagtagtctcctaactggtcttcccacactcattcttagacttctctaatccagtttctatactaagcctaagttatcctttcttacattcttttaatatcttattgctactttttaaataaagaccaggatcctttatgtggcctatgaggccctaggtgcagatcttgccggtcttatttcaattcattcttcttcctattctttgttctccagcaactctcttccgcagctcatggctttcagattctcaggtctctctacctgcagtacctccatactcctttttgcctaactaatgctcttatccttcagatctcagttaaagctttctcctctag

SEQ ID NO: 112470 - DNA, 1050 bp, Homo sapiens
ctggcttgttatgtttttgtggtcttgatacgtgagaatgtcactgtgtgagcctaataaccaggatcagcccaagtcatgctagcagagggtggctgccattttgagctcgctggcagtgatctgtgctaaaaccaaagccatcccagtgtttgaaaaaactatagctgtagtctcattattactcagtgatagctcagaaaaagtctcttttgacttaaaggtagaaataagctaagctctcatgatagaatgttaaatgcaattctaattctcatggtaggaatgtaaattgagcagtaaagaaacagtataaaaagcagattcttggcatcttatattattaaaataaggactttcttttttgaaatttgtcttttcctatatagttttccctgatttcttcatttgcagactgagagaaatgctgatgttttacctgatttcataaatgttagctaatatttactttaatctcaactttttttttctttctagaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaaggtgaatttttaaagttatttccctggccattttttctaactaaactttttttttggtaatttttatttctgtagacctaaatccagaaatagcacatacctcccaaatgaacatatttcaatgctagtattttggacaattttaacttacactgagatctaaactaacataccttatgaggattatattattccagagtctttaggtgagagagggctttgtatcatttaaacaaatcatatgatgtattcattcatcaaatatttattgagcactgtcatgggccacgcactgttttgggcacttgagatatattagtcaacaaaacaaagattctttccttgcagagatgcattagtcattttgaaatgtaagatttatcactattaccat

SEQ ID NO: 112471 - DNA, 1055 bp, Homo sapiens
aaataagtaaacatgcagaatcatgttaacctatcatacgtgaagacaattattaatatttgtagttgtccatattgttctgattagtgaacagacgtaagagcacaaactttggagccagatcacttggattcaaaacctagctaaacctctgagtgaccttgggcaagtgactttacctctctccagttcagtttcctcatctgtcaaatgaagattatggtaatacctacctcataaagttactgtcaagattaaatgtgttaagatatgagaatagtacctggcacataatagatgtgttggctatttttattattttttaaagttgttgttaactacttaagaaattcttctgtaatgtgtttatgttttagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatggtaggatttagcactgtatacttggcattacctttttgtcttcatttgtttcagatttttatcaactttattgaggtataatttatatacaataaatgtatctggtggaagtgtatggtctgacgacttttaacaaatgtctctacccatttcctcttcaccccagtcaagatagaagatgtttccatcacccccagaaagtttcctcacacctctatcacagaccctcatcacctcctccccgccagattatcagtcctgatatgttcaccttaaatcatttgtctcttctagagctttatacaaatagaatcatacagtatgtagtctcttatgtttgactttctacactcccttttactgccaaggaatagttcattgtattaatacgccataatttttttattctttttcctattgatggaaatttgggttccgttcagtatttggctattttgaataaaactgctgtaa

SEQ ID NO: 112472 - DNA, 1955 bp, Homo sapiens
attgtagctacacgctgtattgcccgtctttactttgtccctcctttatctcttctttttttctcatctctctctgcccttatctttcacagtgattaaactgttaatatacaagatatgggttatttaaattatgtaattatttaaatattacttaagtggtacttctatttttatttttttcatggaccataccacttaagatacttcttaaataacaattttaaatgattaaacattacttaaattattcattgattaagtttttggaaacctgagaggcattcaaagcctttagggaaaaaaatgtcaaattctgagaaatgcctgccacatgataaagttagaaaacactttaaaatgataggtaaggaaataaagacaatctgattatgtgcctttactattttccatgcagaccttactttctagaatacaaagagattagaaaataaaacatcaaaggtagagttaaacaagctgagttagggaaaagtgacaataagagtactactatattgcctttccacagtcaaatttttgctgaatgtaaataacttctctttttgcagagaaagctttttttcctaaaaattgcttcagtgaatcatatgttgctaacatccctaaattttatttcttttccatagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgaggttggtacaagatgctattttgagaaatgctccttagtcttctggggttttggtttctgtatatatgtatgcctcagactgctctgcttttactgtgtgacatttactttttcttttttaaagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatggtaaggttttgattgattaaactttgaaaaattggagactcttaaaaacattgcagaggccatcatttattatttatgattatgttatgtagtagctacaaaataattttgtttcatattctaatggaaattgtttttatatttttctaacaaagaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaaggtaaagggtgtttattttcagagttttcatatgcttgtatatatactctttaacctcaaatacttaaatgcataatattctcaatttcatttgttactcacaatggtaataactaacaataattttacaagcttatccctaatgcctttgaaataacttatgatagaatatgtttataatcaattagaaagggaaagggcccaaaaatgtattagtccaaattttgcatagctgatacttattttatgtcaaatttactatactaaacttgcttagagtt

SEQ ID NO: 112473 - DNA, 1799 bp, Homo sapiens
tttagaaatgaggttgtagatttttttcatgtatttttcatttgcattttctcatctgtaagtttcttgttcatatcatttctctatttttctattagatcatttgtctttttccttttcaatttgtgggttaatatctttaatttaactgttagccacttacctatcatgtgctgaagagaataactcaaaataaaaatacatagaaaacttcatcagccttgccgaacaacagttgttttaacctttaaacaaaacagatctaaattatgatacattgcttatataatttgatatattgcttatataatttgaaaaatatgaccagaatttttaaaaattatttttattaggaaaacattatttctttttatatatttggtaactagcatatttgtacgctttttgattagctagagttaacatttatatacatgttctcttaagaattttccaactctgtgaaaattagatttcagtgaaccccttttgtcatctgtctaggaaagcattgaagacccaaaacaaatgaagcagactctgtttgatgctgaaactgtagcccttgatgccaagagagaatcagcctttcttagaagtgaaaatctggagctgaaggagaaaatggtaagtattttttgtaatatttataataaagtagttgtaatgatcagtgtatttttgtgcatttgcaatgtttttctcaatagaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaaggtattttgtaattttaaacatcttttttcaaatctgacttcttctagaaatgtacctaaacaatttgacaagcatatttcaatgattaaaaattcattatactctgactttttaaaaactcaatattacgttttagtttcatttggtattaatatttataaagatttccatgggtttcaaatcataagggattatttttcaaataaactttacctgatcctgaaaaaggtgattcaaggacaattaaaaattaaattacctgtttggcaacattggatctttatacaatttaccaaaactttctagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagaggtaaacacatttataagcacttatcccttattttgaaataaaaacctttgcgataatagtgccttaaatattttggtatagtttattttaaactagcagacaagagagatactgtaaacgttttgactagttagaaatagaaatgaatatagttcatcttctaatttgttcttatgctactagattaaaaaatatattttttcaaggtgtatttaacagaatacttagtaatataatccatgtagcagccatttctgtagtcctcaaatgttgcatttatacagtattacggcccacccttagtctttaccattttttttggtagtagtagtatcattatgttgaataaaagacagtaatgagggaaaagaggttgcactgataaagttttagaggttaatgcaaaccttgcaggctggtgaatgtttctgtaaatccatggcctgccagtttttctttcta

SEQ ID NO: 112474 - DNA, 1038 bp, Homo sapiens
gtatttttaaataatgaggtgctttgttgcgatagcttgaacaattgatctcagtcctttctaactgttgggtgattctgaagcagtgaaccagtgcccttttttttctttttctttttttttttttttttgctttgctttattaactattggtttgctctgttacctgttcacatgctcttacagatgcaactaattcatgaaatttcgaacttaaagaatttagttaagcatgcagaagtatataatcaagatcttgaggtgagcattcatgttggtatttctattgataagcaattagaactataaaacatgcaacatatgtaactgaacatgatgtcagaaataagggaattatgtttttaaaatattagtgactttgaattttactatgaatttaaactaatatatataagttctgttttaatcccttagacttcaaatcagattctaaattgttactctctcctttgattcttttagaatgaactcagttcaaaagtagagctgcttagagaaaaggaagaccagattaagaagctacaggaatacatagactctcaaaagctagaaaatataaaaatggacttgtcatactcattggtaaaaatcaggcgtattttgttgtgtaatcacataaatatatatagcataccatcatcttagcaaatgcttatactggacctactttgtgctgtgtattgttgtaataaatttatatatatttcattaaatctgtcaataaccctatgagatagggactgttagtatatttgccattttagagataaagtcacatttgtggaaagttgatcatgtcatcctttgagtaaatataaggaagttaaggacaggctcccattaaaaatcagtaagttttaggccagggcacagtggctcatccctgtgatgccagtactttgggaggccgaagtgggagatcacttgagcccaggagttcaagaccagcctgggcaacatagtgagacctggtctgtacaaaatatacaaaaataagcctggcaggtactgccagct

SEQ ID NO: 112475 - DNA, 1118 bp, Homo sapiens
tgtaaaaaagtatttttttaactcatggtttatctcttctcttataataatatagaaaatagaaataggcctctttatagtaaaacacagttgtcattagctttagaagtcaataaataatatctctgtttccattcttgaattcagaaccatctgagacataaaataagagttagttagattggggaattcaattatcagttttattactgaggagcttgaggacttatggtcaaaattccctgtcaggcacaggcaaacatacactttattgatatatttttaaaattctccttctttcaaaataatctattctaagttagctagtttgccaaaatgtagaactttagaaagatatcaaatcaaagttaaagtagttatttaaataattcaaattttattaaggaaacaaaaaatatttgaattttctgattggaaaatctgttcttgtttataataggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagaggtaagagagacagaaatgtaaaactaaactaaaagcatacttttaaaagaagtattctcttttttctataatgtaagcttttttaattttttttaaatgtacagataacattttatgtgtttattgtatacaacatgatgtatgatgttttgaagtatatatacattgtggaatggttaaatctagctaacaaatgtactacctcacatagttattgtttttgtggtgatagcacatagtatccacaaattttatgttttttaagaatacaataaattgtcattaactatagtcaccttgctgtacaatagagctgttgaaatttattcctgctatctaactgtcattatgtcatctgaccaagatttccccattttcttctccctgaaaaacaccccagcctccaataaccaccattatactttgtacttctaagagatcagctttttaagattctgcatgtgagtgagatcatgcagtatttgtcttt

SEQ ID NO: 112476 - DNA, 1063 bp, Homo sapiens
tccctggcttaacagaattaatgaattctgtgacaaggcacataacacttgtcttgcaacataattgcctttgattagtagttaagtggttaataactagtatagagtttaaaggaaggagagatatttttggctagaagcaaaacttcagagtagaggaggcgttagcactggaccttgaggggtaaatgagattccaataagctgatgtttttaagttctctcaatatatcttttttattctcccgaagactatcacccaggataagttacagagcattgttataaggacatagaatgttccctttgttcaaaagtattaagccaactagaaagagtattgatttttttaatcttgaatataagaaagctaaatattattaattaaattcgaatttttttaagtgttgaacacttagcactttcgtattttttttccagtttgccagtactgctaaatatatgaagaatactccttatgttaatgaggtatcaactgatgaagctctcctgaaaaggtatagaaaagaaataatggatcttaaaaaacaattagaggaggtatgtatgaatcatttatttcattaaattgaaagaaccaatttagaatggagacctgcccaaatgctcagagactcttcattcctgaatatctgagttgctacaacttaggtttttaatcacttttaaagaagaagaaatccactcataaaaattttagtttaatttactataaattgtaagatttggttcttgaaattattttagattttgttttttattttcaacgggcaaaatctgagattatcaaatgggccaagtagagacatttcttaaaatttttcacaaatacatatgaattcgattaaaaagagaaactacagagttacttagaaccaccttctgtgttttcatgttatcctgaattcctcttctaacccttagatagcaatctaataatatagcataattacttatcattttagtttgttttaaccatcatggtcccatattttgtaaaaaatcacgcattaaggatcttttttaaaatgagctaaaatat

SEQ ID NO: 112477 - DNA, 1033 bp, Homo sapiens
ggaagggagctttttcaaagtgtactttttttttaaactttttgaaccgtgtgagcatattaacaatttaaaaataagaaattagaggctaatttggttgtaagttcatagttgcctatatttagatgttggaaaaaaattgatttgaactgaagagctagagaagctctttcaggaaacaggttttttttccctgcattcttccctccctcttcatttttttctttttactatttttctcaggtaataacctttctgattcacttgaagtgggaccaatagggagagagctctttctaccactgatattaaagatgggctcatgtctaaaccagagcatagactttagcatctgccctctaatttctctcattaacttagtgataaataagtttatcatctagaaaaggagtcaagtttagttttcatatttgtttaataaattcaggtgtgcggctcaaggaaggctgtaatataaatcgaagcttatttattttgggacaagtgatcaagaaacttagtgatggacaagttgggtaagtttatcccgttgtgcacttacctactgattcttatatttttcattaggttgaacattgcaacatttcgatgacactcaaatgtactgatttcttccatatattcaaaaacttatacatatgattataatctactgaatttactttctgttttaaatattttttagtagttttaatctgcctcatataacttgtaaactaatttttgaaactctggctgatttaagagttctgcattaaaaaccaactactttattatataaacgttctcaatctttttctcctgtaaacttattccttgctaagtggtttcataaattatcgagatagcaagttaacacgaattctccagaattccttgggaggaaatgcaaagacacgtattatctgcacaattactccagtatcttttgatgaaacacttactgctctccaggtgagtttgatttttatctcagcttaatataggggaagatcagcttgaagaagaaaac

SEQ ID NO: 112478 - DNA, 1008 bp, Homo sapiens
tgcctggttcttgaataaagaataaggacagaatagaacattagaactaactgaataaaggaaatagcaaaaagctggtgcttggaggtgtagaagtacatggggtgtttggggaatagtgagtagttcagctagaggtaagaataagggatggataaatacaaagttggagcagtgcaagtgccagcttataaagaattatatttgccatagtaagtttttggaccttgtataggaaacagaacctatactggtggcattatggaagatataaagaaaggaacagatagagaacagtttgactcagagaaaaaagggaatgcctaaacagtagcatgggagacatggatacagatcgaatattcagatataccatgtattaaaaatgttctttcagtagtttgaattttattatttcaaattatctgccctaaggatttatttttatctatcttacagaatttggttgatcttgcaggcagtgaaagagctgctcaaacaggcgctgcaggtaattaaaactcatgaaatatgttagtcttaatgtcttcctattttacaggtttaaaaagtactaccaggcatttttagaaattgataaagtaattatattcattattaataataatgaatcattaattgtgattttctgataaaagtttaacatagaaatcagcatctgtatctgcttaatttttattttagtctacaatagcatcaattaaaaaatgaaaattatacaattgatgggattgtacagcaggaaagcccatgagaattccataaaaaccatttaaactttcaaaataaggaaattaagaaagataatgtggtacaaaattaatatgcagatattaatttttaaaagttaaaatattaataaaaacaagttaaaatatttagtagacaaaaagactccatttataataacctaaaagatgtgatatctaggaagaaactcaacaaagatttgtacaagactgatataaagaaaactttttttttttt

SEQ ID NO: 112479 - DNA, 1847 bp, Homo sapiens
tcttgaaagaacatagaaaagttgacttgtagtgtattttttgtgtgtgaaaatgaactcattttaccttagggaagggtattttcagagaaccaaaaagttgaaaaaaatactgtgtcttaaatagttgatcatcctacattctgacagttttacttttgggaataattactaatttggaatgaaaacacagtggactcatttgatttaacttctgtgttgttgttgttgttgttgttgtttagatcgtgtctttcatggtaatgaaactaccaaaaatgtgtatgaagaaatagcagcaccaatcatcgattctgccatacaaggctacaatggtttgtattcactcaatgctgcagaaacattttagtcttgggcgtctgtgcaacaagcatgcatagttttacccattataggtttgtttttaatctttgcgtatgtgtgttttgttttttgcaggtactatatttgcctatggacagactgcttcaggaaaaacatataccatgatgggttcagaagatcatttgggagttatacccagggcaattcatgacattttccaaaaaattaagaaggtaagtaacttaactggatttctagtacgtacaggtaaaactagtaaaaactgggtaccagtcttagtgtatttctcttgtaaagatgaaaggaagtagatttacagttattgtttgattatccatggggaaagaagaaaggcatagcatagattcacttttatctccacaacttactttataaagcttaaagttcttttattctttctcttgaattctgcaacaataatactctcaacaaaaagtaggcattaaggaacaagaaaatgttatcagaatggttagctccacctaaccatttaactatcagtgattataaaggaacagtagaaagtggatgtaggtaaaaaaagaagggaagcagaaagccagaataggcaaccgagttagttggtttcaaattagcatttttattaaaataagaacatcttttgagagggttttattttgagcctagagtttgagcctagagttggtgttctcccagctttatggtacttcacttttcattatttctgtaacgatgcttttatatttttgtgttcattattttgtcaacagtagaaccaaggggtttcttagtttgttttacatacattttacctctttaagcacatgagcatttagcattaggttttcacaattggatgcttcctggtgtttttatataattttttttcttctagtttcctgatagggaatttctcttacgtgtatcttacatggaaatatacaatgaaaccattacagatttactctgtggcactcaaaaaatgaaacctttaattattcgagaagatgtcaatgtgagtagcagacttaagggagctttaaaattgactgacttattgagattattgttcttgaatgtttacctttaatttctatagtttttaaagtgtctcctatttctatagtatgtgagggtttttttgaagtatttatattcatcttttaaacaatatgaatagttttaaaatactgacagctctaatattttggtttaagtgtaaaaatagcaagttggaagtatcaggttagaatttgttgtgctttggtatgtgaaataaattgtgggtattcatagaattatttgttacattcctacagaattatggttccatttgccacttttaactttcacaaatgaattctataatagtttgcaccttcttttgaaaagcaaacttgtgacttctatttctctaatctttccataattaaacttgtttcagaggaatgtgtatgttgctgatctcacagaagaag

SEQ ID NO: 112480 - DNA, 1164 bp, Homo sapiens
gcactgctgccagagattccgaccaggcaggagggaatttgcattgctcttgcagtgcctgtgttggtgtagattagaaattgatctctgtgagcagaagcataatgtgatttataaacacaagcacaactgttggtatcaccaccattgctgcagtaggctgtgtttgagagtgccgcatccccaggtgttttccctttatgatggagcctgacttgccctcaaggcaggactcctcagtgggcagtaaacagatctccttcttgtggtgtcttatatatgctctactgctgccaggagtgaaacagtcccagctggctgcactcatcaacagaaatccatttccctaccaaaggcagcaaatgccaccacctcccaccttcagtccttgaccctgtgcattttacacatctcttcatttcttagttgtagtagtgaagaaggattaataaatagggaagccagtagcaaaataacttctgtgagtgacccttctacgaagttaataaacaggatttgtcatagggaaggacggggtgcatagatgatctgcaggggccctaggagctggcatagacttgacatggggcaaatgagcaagtgagaaggtggccatcctccagtaggcgtttgtccagtgcaaggatgagtttgtcccatttagtctattaaatcgtgatggtgatgacacaagagaggaactaacttgaagtagtggtatgccatgctttgcctgtatttcacatagtgcttcccaagaccaacgacccagagattattatcatctcctatgaataaagtgatgtatgaggaacattatattctcacaggtgtaactgctaaaactgagacttaggctcagccaggacctggccaaggtctttaaccccatgtctatctatctgaccttaccttcctggtagtaccctcctaaccatagcctcggggtcctccctacccagccttgacctgggaatcatacttagctggttttacccacctggcctcaatctcctggccctacccgtgtggccctgcccaccttgtatgaatcacatagctttattcggtagaccgttaccttaccccttggccacattaaccacctggccgtatcactcagtcttaacttcctggccttaaccacctggccacacatacttg

SEQ ID NO: 112481 - DNA, 1050 bp, Homo sapiens
cctgctgtaaaatcatgtatctttgcaaagtacatatctatacttcattttcaaatatatgtgtttcagtactgtaaactgtacagatagcagcttgtattttgtgtgtttagacacaaggagacaatcatgtctgagcatctatggagattaacagtttgtacacaacagtatggttctgcaagttaaatctggagcaataaattttagctttaactattttttgccagtggtttagaagcagcaacagcactggcaccattttgccatgcatctttccatagagacttgatgccaagttttacaagactaaaagattatgatgcatccaccaattaccttcagttttattgttataagaggggaagatgttatgaaagtttcaattaatcttttgagcactatattagagtagtggttatgcacttgcattgcttacaaacgagctgtacagaagggtatacctcccaaatacttagtgtagttgacttgtcttgggttgcactgtaaggcagagtactcagagtagttggaaaatgcagaatcagttgtataatttttttttataaaaacggtgttttttaggctaaagaataaagtatcatatcttaggaggggaaaatttataactgacattttttccccagcccaatatgggctgtatacgttttattgtttcttaatttttttcttattttttctgtaggaaaaaatcttaataaaaactaccccaatgttttaacttcatgtatgatattaaatgggtagttttaacacttgaatatgttgagggcttctgccttgaggcagggcttgatatatttttaatttacaaagaattaaacatattcataaaagtgaggcattttatctctttttattttcttttctcatagccacccagttggactagtggtcttcccctggtccttcagtaaaatgctccattgctgccatttccattgttgttacttgatgctttcattcctgagaaggcagggctacagtctctggaatttcataaatgcatgacatacccctccccccaca

SEQ ID NO: 112482 - DNA, 1046 bp, Homo sapiens
caccacccgcaccagctgcacttcacgtgacaccgcccttctgatagagagagtgccctcctttttatccctgggggaaaaataatgtaattgaagaatcagaagtttcacattcaatatgctcaatattttcccttggtggtttaaaatgccccctcctcctcattaaaaagggtggggcatcttgcccaaaggactggacacatcacatcctatacaagtttactggctaagttagtggcccatttataacagtgaggacacagtttgtggtacacaagcctgttctcattaaaaaaccggtaacaaaccacacagcagtattcaatgaagttgaaacacctggattcagaaggggatttcctacccttttctagaatcatttttctactcatcaaggcagaatgttttctattttattttctgcgtatctgatatttttggagaaagctgaaactgtgtaggaagcggatttctacctgcaaattttgaggagatgtgacttagaataaagggatacaattagttaatttcagggcagataagagtgattttgtttaaaaattattttatgtggttttagaatgaataatttctaaaactcagttacaaaaaaagtatttcccctgggctctgcattggacaaagtaaccattttgtggttacaaagttggtgtatacaccaagcacagttttggttgataccttatatggtcaataatagtttcttttacctataggtctttaaaacagatattgtacagatgctcactaaagtaattgttaaattaggttatgaattatgctaaatacagagattgatacctttgataaaaattttgtattgtgtcctgatcaaaacaaaaatggggaaaaatgaaaaatcacaggtaaatgactttggtggtatattaaacaaagaaatctggacaagtacttatagttagtctcgataaaatttacagggtagataattagatgttcatatatacatgagactgtaggtggtgggtttagcattctgtgctttaacattttaatattct

SEQ ID NO: 112483 - DNA, 1013 bp, Homo sapiens
tccgcgctggtccgggcgcaccactccccccgcgccactgcacggcgtgagggcagcccaggtctccactgcgcgccccgctgtacggccccaggtgccgccggcctttgtgctggacgcccggtgcggggggctaattccctgggagccggggctgagggccccagggcggcggcgcaggccggggcggagcgggaggaggccggggcggagcaggaggaggcccgggcggaggaggagagccggcggtagcggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggtcagagcgcttctcttatgccgcgaaactctccctttcttctccccttcgctttttctcgggcttccagggactggggagcaaaccctgtagtgtcacccacaaataccaagagggaagagggaagcttcacaaattactggagcctcttcaacatggctgacaaatatagttttaattccctctaccccttttaaacctgtagttctgtgttctcttctctcctcctaatgctcgtcccctcatctcccagaaaacttacctttgtgcctccgacgagccggtttcccggccttttttaatcctcagaaaagtgatttttaaatttgctttcctttctaaaatagttcagctttgggggcactacttttccctttaatcctcttcccctgtttctttcgtgtaagtgaaacgagtctcccgtttatcctgaacaacctcagagagaacactgatagggtgttt

SEQ ID NO: 112484 - DNA, 2546 bp, Homo sapiens
caagactgcaaggtcaggggcgcctaaagaaatgaaacccaatcccagcaaagaagtgaagagcagatttataacagtcccatccaaatttctctttggcttctctctttggtctttcatctctctgcctttctctctgtgtctcctctctactctttcttctctctctctcatacacatacacacacacacacacacacacacctcactcgcatcttgctgaatcttttcactgggactgcttgtctagttttattaagctaatagggtttgtatggagagttttctacctatgacataatgaagtgtggcctggatagactcctggaaaggccgaaaatgaaatataagtgttatttgctggttattcccctcatgatatacttttaattacattgagggagttctcccttcttcatctaatgtttaagaattgagaaaaggcttattttccagcggtaaaatttagtgcataaaatttagtgaaatatttatatatttacgtgtctagggagtggaatacattcatgaatttaatatctcaaatcacacattgtgctttttccccttcagtcagggattataatgggaaacccaaattcaaagatattcatcaacaaatgatccatcataggaataagattgtatcttaagggaagttgggattcacagagaaaagacattggtttggtttggtgtgatactgtgggtattgttgcctggctaatgaaatcattacatttgcattttaatggaaagttgaaatactaaggggagttatgttcttttacatgtttgtatgtgtgcttaataatgtttggaatagaatataaatttaaacacaataaatattgatttttttaaatgttaataagcagagaacggttaatgaagtgttggataatcaaactgaagtttagaagacaatttataggattaaaaaatggatagaaggaaaaacacaataatagatatttctccataagtcgaatttccaaaactatttgtcctcgatagttcactttgtaactttctattttgatctttgttaatttaatgtagtttgctttaatcattgatacgtggggttctttcacatgattacaagggagaagcattactcatctctgtggaatagaaacggttcattggttagttcttatttgccctaaaattaaaacaaaaattaggattttaccattaatgctgttcatggtaaactatcgagaaaactatggttaattattccagcaattcagaattaaaaacaattccttttgctaacaaactaatatttactttttggggacaacttttcaaatgttgtggtatatactgtcttcaggctactcaactaataatagatacaacattttccactcaataaataagaataactacattggttaataattttgaatacaactatgaaggcttgttttttcctgtcatcaaatttagattcttgttattttgtgcatcctacttttatactgaaaatagctgctaattaatactgtataaagtatttcagtgattataaggaagagatgtgtatgttagtcactttatcctttgttggaaaagagaaattattttaataagtatggggtagtttacaataaaagacataacctcagttctttctttaccatatatgtgatcatactacctaggtgctccaaaaattccataggactgtcttgggttattgaattttaggaacatgataatggacaataacaagatagatagcttttcttaactatgacattgttttgcttattttcttattgaactaatcatcaatgagaaattaagttgcagtgagagaaatcccttgctttgtttaaattgtcatatttgccaaactcttcttaaggctttaattaggtctgatgtgccagtttatgccagaagccggaggaattgatatgattttgaggcagtggcacatggtcctactagacattggcaagtgaatatcacttccagaacaagtgaagtgcacctgccaaggagttgttatgaaagaattccaaagtccttattgggcactggtcttgtattaggtaacaacaactggagttaatgttttagtttcacttgttgaagttaaaagttccctatcaattcttctaagactccacccccaaacaatgttgtaagtcaaatgtcactattgaaatgtatttccttaattactgacctcattaagaagcccttcttatgattcataggcacacctcacagaaactctattttccatcctgcccaaagtctgagtaggtaaattcttatgaattcttatgaaattaccttgaaataaaatatcttcaaaagttacggatgctagacattgtataatgtcaatattttagaatatctaatatttagaaaatcttagatctactttttatgctttaattgcttctaatgcaagttaaattgtttttgttgttattgttttaatagaatttcatagtcttatctagcaatttcaaatcgctggaaagagtcatctttgttatataaataaccatgta

SEQ ID NO: 112485 - DNA, 1051 bp, Homo sapiens
ttttttttttgagacggtatcttgctctgtcacctaggctggagtgcagtggtgtgatctcggctcactgcaacctctgccttccaggttcaagtgattctctttctcagcccccagagtagctgggactaggagcgtgccccaccacacctggctaatttttctatttttattagagacagggtttcaccatgttggccaggctgatctcgtactcctggtctcaggtgatctgcctgcccgggtctcccaaagtgctgggattacaggcatgagccactgcacctggtctaatctattttcaatgtataagagaaaaatagtgttaagtgtcttggtgatggtgatgatggtaggagtaatggtgtgttttccttacatttaatttctacaggctatggcaattgccctataaaagccacccattttaagcacaaaagtgaatggtttttagtaaacttatatgggatcatatatttttaattgaaatattttttgagttaattatagattcatatgccattgtatgaaataatacagagagattccacgtatacttgctcaatttcccccagtggcaacactttgcaaaactataatatcatatcacatcacatgcaaaactataatatcatatcacaaccatgatactgacattgatgtggcctactaatcttattcagatgtcctcagtttaacttgtactcatttgtgtgtgttttgttttataccatttagtcacatgatcacatatttttaaacctttttttctcaaaacagagaagtttagcacaaaagtttagcaatttatcaatcttgtgattgtgctgttatgccatattaaaatgtgtgtcagaatgtaagtttttgttttcttaaaagtcctttttttgatagaatggcctttatgttaaaaatattttaagttgttttgtgacagtgtaagtcgatgtcatttaattctcatcacaaccctagagataggtattattcttatccctatttatgagtgaggaaactgaagcccagtgaggttaaataacttccttaa

SEQ ID NO: 112486 - DNA, 1036 bp, Homo sapiens
atttgttgtttatttttagctttgctttttataagtaatttatacagaaggtacaccatattcaaaagaagaaaaatgggctgtgaatttttgctgatgtactactctcttcaaagggaattgcctatgttcaggcatagaaatgcaggcagtctgacatttaggtatgccatacagagtattgatatttttaatttgctacttttaacattttgagatttgtcacagtttgttctgtgggtgggtaaaagtaatggtaattttaattacagttgtcgtgcctcattagccattgctaaaacctgccttaccaaatcacttattttcttgatgcagtgttaaatctagcttctatgtccaggttatacattaatgagaacattcacccatctctcaaatgggttattatagtattttctcctgaaatagatgatgcataaaaaaaagtaaaaaagcttcaatagggataatgaaagccagataacatagcatggtatatgagttattcctcccgtttttcttacctgtctgcactaagaagggcacccattaaataccataattattagttgtgctgcctctgaagtagagcaccagaatgtgagagtaatacaatgagaccacacccagattctatccataacatactgtcctggtcttattaatttttttaacctgtttgttcttttagcacttttcctgcttttgtttgaagtctcttgctttgaagttatagaatttttatatttgccattggctgtaaagttatctcagctcttttataacttttcattatatttgcattaaaaggatcactttgagcaccctgtaattaattcagatgattattagcttttttgtttgttctactgtgcactctcctatatacattataacagaagaaaaaaccatttctacaaatacagtgtctgatagttcatcaaatcagaatgagcatcttaaaaagtgaattattaaaatattaattcatttacattcctattttaatgtaccaaatgtaactgatgaaaagaag

SEQ ID NO: 112487 - DNA, 1006 bp, Homo sapiens
gatcatcctggccaacacggtgaaaacccgtctctgctaaaaatacaaaaattagctgggcgtggtggcgggcgcctgtaatcccagctacttgggagactgtggcaggagaatcgcttgaccccgggaggcggaggttgcagtgagccgagatcgcgccactgcactccagcctggcgacagaacgagactccgtctcagaaaaaaaaaaaatcttgatatttgtatgcatcttaaaaagcaagagaattcatgattgacttcccaaactaaacggtctgaccagaaaacactcaagaaaactcttggttaatcatgctccttagtataccattatacctgcctctcccctttccccatcctctgtaaattctctcaaccttctctcatttttaatttcataccaagacctagagctaaaacaacaacaacaaagctttaagtctctatatttagggaatgtgcctcctatcccaaattgatttttagagcttttcatttatttttatcaatacaaagcaagttgaaataaaaaaaaaggcatcaaaaatttaaatgtctaaccacgtatatttggtatatgtatactggtgctatgtattagctgtaagcagactggtttgaatatttaaaatatgaacagaatttgagttctttttgtattgcatctaaggatcatttgagatggatgtcatcatttatcatccaaaatagaagccttcttgcctaacaaagaattgtaattagatcatcaaagatgaaatttatagtaattgaaaagttagctcatttgactgcttctttcatagactgtgtttttgtaattacactacctttctaaagataggaaaaatcagagtctctgaaatgtaatactataagtgaaatatgtattttttaaaataaaggatcttttcccaagagctaaaccaagcaccaaatctgttttttgggggttttttggtttgttggtttgtttgtttgtttgtttttgacagagtctccc

SEQ ID NO: 112488 - DNA, 1051 bp, Homo sapiens
tttttatttcttttatcaaattttccctatcatttgttctctggctacaaccaaagttaatagttacatttttttccagtgacaaatggtaatttgcaaagacttgtaacagttgcttaatacttttttatcccttatttaagaatcatgcaaacaaccagagctgataggcagcaggtgcacatgagtgtggctgtgctgatggttactgaaagatttccaaggtagctagtaattctgctaccctaagccactatagctccttccccattactccctgggtctacccaccatcctgcagctagaataataaatggcatgtaggttcctctaggatcctcctccagcactatgtctcatgcctggacatatgagctgttaaatattttgattatcactcctgtgtggtaagggagacgtctacttgtcgtaacttgatgtttactaaactacttttaagattaccttatgataaaagtagacacttgcaattttgcagaatgcatagtttgtttttaacaaaccaggtaaacataactgcagagttttcctatacgttttgaaatctttaaaaaagtattttttatttgcctttctattagaaatagattagataaaaatttccttgtttcaatttttagaatgaacattagagaatattgttactgaaggaatttttttaaaaatagtgactgatcaaatgtcagcagctttatactatagtgtaaaattttattttgtagtttgccatcccattaagcattagaatttttataattgatcctttgatgtttatattcatgatattaatgtaatgtctttaaaccttagctcatataggtcatatgacttaaagcatccttagatgaagatatttgggctataaataatttatgacataagtgatttaaaaattcattctttccatccattttgaagaaattgtaaggtagggttcatgtatacctaatacttatccccccaaaatacgaaaaataaaatcatttttaaaatatctgggttaatgctatagattggaagcagtttttaa

SEQ ID NO: 112489 - DNA, 1035 bp, Homo sapiens
gcggggatctctaaaatgcctggatgttaggaatggtaagtctattgtagagaattatattttctattttagtggatgaaaaataaaccatacccttaagaggcttttcaaagttaagattttgagcacatccttcattggcccagtctctgaccagtgaggtcaagtattagccagtgtcagaatgtcgtgaaaagtttgtgtttcagatgcagaatttttttttgcattttctgtgtgatgtttatagggtattttcttctgaaatgttttccatcttggtttttaaaaatatctattattttaaaaaatattccctcataacttctttttattttcggaaactatataaattgatctgataatctatacacaatgccttgtgaatttatacctgtacctctcatgttccagtgtttggttcttaaataatcactttgtataatggaaatactatgttaaattgtttataactggtggttgatatttcagccttgtttggctatcgtagttatataaagactgttaattagaaacaacctcatatggtgtatgcttgtttttatcttcatggaatttgttctgcaaacactgagttctttactgggagtcaccactttgtctatgttaggaggagcaggaagtgaatacatttaaggtctttaattttcttcttaaaactttgactactgtagtggttttttaaagcattaacaggagaatagccatcactgccaagtagctgacattctgaaatagcacttccctttaggcactgtacagttggaatcatttacttgcagagaggtgtgtgtgtgtgtgtgtgtatttatgtgtgtactcatgtgtataagaataggagaaacactttgtgggcatatcctgctgaggtgagtaacgtgctgattagtgaactccagtctcatcccatttaaacctggaggagaaccacatcaagcacagaagcagccaaagcagcatttcaacaggaaggaaacatctattactggggctttgaagaaacatgccatgaag

SEQ ID NO: 112490 - DNA, 1030 bp, Homo sapiens
gattctcaatcctgacttcatcttacagtcacctggagaataaagtttcctcttagctcaacaagtcagaatctctgagcaaaatcctcaacttcttacctaggtgatactcttgtaagccacactgtgaaccactggattcaacagatgaagtaatataagccactggctcttaagcctcattgattattgcggtgaagatgtgaagactaaagatgctttgggcatggcaaagtgttctacagatattagaattgttattatggtacatttgagagtgtcattgctttgagaaagattctctaagttttttaacagccacactgtaatggaaatatccaattataggtatccaaaaccttttaaactctttatatcaggtgtatataccctgttcctttttgctaacttaaaaatgttcaaactctgtcttctctaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctggtaagacagtggagacagttgacacttgtttgtcaagtatgaatttattcctaatgtaatggtaatctctctcccaaacttcaacttcaagttaccctgcaccctctcaaatacttttctttattgtctatgcttaggacacatggattagattgttaagatttgtgaatttactaaagttgtgtactgacttatgtatagctgtatttttctggagaaagatagatttttatcaattctcaatgtctatggagtttttaaaaagaggtaaggattattcaaatgtaactataaacataagaaaatgtgatatctataaccagttgttagagtatttatcgcctccattttgcttcacttgtagccacttcgtctcaatcttgttaaggaccaaataaatggtatttgtggttacttgctgatctgaaaagtgagtacctcctgc

SEQ ID NO: 112491 - DNA, 1582 bp, Homo sapiens
aatcactttctcccacctttagtcattgttgaagtttcctgatttacaatgttatctttttatcttttcagtagtataaggaggaatgatatttctactgttgtactatttttctgtttatctttcagaagaaaaatagcttttcttattggcccaaaaaaccatcaccctacaggaaataaatcacactctttgcttgattttcctgatctggctactgatttctcttcaaatttaagccaatacttagactttaagacttcattgttacttccttacaggtcattcttatgaactaaaatccatagtcattgttctagcaagcctgagcagtttattctttgagtcacaggattataaaagaaaaaatagaccttagagatcataatacagtgctcttcaaactgtactcttcaatttttctactacttatcagttgttttttattctaataaaatataattacctagcaagtgagcagacatgtatttacagtagctttacaattctttatacacttctttactctctccattacacatgccacatggtatgatacaagtcataactcaactatgtgaaagcaaaaccactcttatacatggtgtcttgcatatatattaaggcccagagtggtatcagtagtctctgtgtcccaagagactgaattaaacaagactgttgaccttcttgtggcatttatctgacaaccttggcaatccctaaattcacaaatagctgtatagcattttttgcatttaatgcatatccacatatgatgtgtcctttgattttagaacaagtaaagcatgctaaaatagactgcaccttatgaaagtcattttcactattcttgtgtttcagtttcctcatcaaaaggtgaaatatcagctgcctctgttgatctcaggatcttttaagtagaaatggaagagtcttagtgaaaacagtttgtattctgaaagaaaattgcaatgtaaatacaggcactaaaaacgtttattcatctttacagatgttaatctgaccagacatttttctcaaaatgtgaaaatagtatggattttcttagctcatttaatattgaaagactagaaaaacaagtaatgatgttctagaagaatctatgatcatataattacagttgtccttcagtatctgtgggagattggttccaggaccccccatggatatcaaaatctgtggatcctcaagtctcttatataaaatagtgcagtatttgcacatgatttacatataccctcccatatacttcgaatcatctctcgattatttataatactacaatgtccatgctatgtaagtagttattacactgtattgtttagggaatagtgacaagaaaattaatctgtacatgttcattacaaacacagcaatccattttttttctgagtattttgatctgtgattgattgaatccacagatgctggaatccatgaatacccatggggggctgactataatgttgtctatgtgcgtagcaattttgtaattctcaaccaaggacacgtatagtccttgaatcttggtaggagtcttggggacttttcttaaaat

SEQ ID NO: 112492 - DNA, 1050 bp, Homo sapiens
ctgaagtatttaccctcagtaatctgaatgtataaataaacaggattcatgatggtagagtaatttatatatacttgtagtattaggacatgcaaaacttattttatggaaaaaaataatttactaccttatagtatggcaactatacaaatctataaattgactcttttgtccccttgaaaaaaagctgacataaaatttaaatgatgtgtattttttcttagagcaataaaagatatacccccacctagaaaagcaataaaccaaaaaataaaacaaaaacaaaatcaagccctcttcacaaatttgagcatatctacagctttatgtggtgagagatacagctaccattcttgagtaatccgaagagtcaaatggtatggagcaaaattacagtcctaaatgcatattggtgaaatgagatgctgatccatttgcacactaatgtgctatttttaagtcatgcatcatagcatcttcaaagaggcctgtcataattatgatggattagactgcagagtcagtcctagatgcagtaattgtttcacagatgctgccaatgcgactagaatttataataaattattttcagagaggcgggagaaggaacaaaatcaaaggaaaactgctgtggctaaaacctgttttggtcttaggaaaccaaaatgttagctagtagtcaaaaggccagtattttcaactgagataaacatgcttcattaatacatgcctctgacatagaagataaaggttaacataattgacatatcagccagtctctctctctctctctctctctctctctctctctctctctctgtctcgtagcttatgaaaatttattctggggcattagctgaaattattgagtggccatataattgttgcatgtttctatttatgttaaattgcctggttataatttgacctttagaatttctgaaaaaaatggtggtatttatagtaaatagaaatattctttttggttccttggaagcccatgcattacaaagaacattagattattggaataaaaggatagacatacat

SEQ ID NO: 112493 - DNA, 2790 bp, Homo sapiens
gggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaa

SEQ ID NO: 112494 - DNA, 4096 bp, Homo sapiens
cttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatattttgattgcctcttgaattcatttgctaattgtatgtgtgtgtgtttctgtgggtttctttaaggtttggacagaagggtaaagctattaggattgaaagagtcatctatactggtaaagaaggcaaaagttctcagggatgtcctattgctaagtgggtaagtgtgacttgataaagcctttggtcttaaatcttgggcattttgatttgtaaatctgaccctgagaattgggttacccagatcaaagactcatgccagttaaaaagaacattacctgtattttttatcatgtgttatctcttaagaagaggcagattagttctaaaatcaacaaattgtatttaattgaaataatttagtgatgaggaagaggtccattctagtgcctgctaaatgtataatccttcttagaatgtgaagttgtccttaaacttttaaataccttcagttaatctttatattgtcatttatgaaaaccttgaactaagacttatgtatctttcatctagctctggttttaatgcaggtagcatttaattgtccccactgtactgggtatagtctgctaaacattaaggagtagttttgcatctctccttgttctgatactagggtcaaagcccactttttatagatgggcagcaaaaggcacattggacatgctgataaatgttgccctaattgtgatctaaacatgataaaatatacatacataagtgcccttatctgctgcaagtgacccttgttttgttttggttggggtggggggtgtttgggatggaatggtgatccacgcaggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagtaagtgaagcccagggcctctcccctctttgcggccactgataggaaagcccaatctttggttgaaaggaagagagttcagcgtgcacttttacatttataaaatgggcatcaaaatgcctgtttggcagtcatgcgataagaagttgtatttgctaatgtgaataacttgagatgatttcattatctgaattgtacagtttagccattaattaggagcagtcagagtgtctgtaaccacatggcctcagttataccataaacttgaaattgtttatgtgctcacatgctacaagtgacggctcctgtgtgcctggccactatattagtatgtattgactccacttccatgttgcagtatctgaaacagaaagtaagtctaatgagaaactttgggattcccaggtcaaataccttccatatgtatgtagcaaaaacaaaatacaaagcctagaagttctgtagaaatagaactgatttttactttcattcaaactattcattatttccacaatagtaatcaaaactgcttctacttttactgctgctaaatgatcagcaaattactggatatggatatatattattttccaggaatataagaatttagaatagaactgcaagagtatgcacttaaatatatttagtgcatccagttgctaatgttttgttttaaacaccatccactttgcatgaagtctaaaccttcagttggaaaaagcctcatttttaatattcctctactgtgctgataatcctgtataacactaaaagaatagatgaatgttcacggtgctacacagaaatgttttttttttttttttttttttttttgagatggagtttcgctcttgttgcccaggctggagtgcaatggcgcgatcttggttcaccgcgacctccacctcccaggttcaagagattctcctgcctcagcctccctagtagctgggattacaggcatgtgccaccacacccggctaattttgtatttttagtagagacagggtttctccatgttggtca

SEQ ID NO: 112495 - DNA, 1409 bp, Homo sapiens
aactcccgacctcaggtgattgcccacctcggcctcccaaagtgccttacaggcatgagccgccgcgcctggccagaaatcttacaagttattttgcccacgattggttttaaaataattttaattttgcactatttcctttagtgtctttttctctgcatccaccaaactatagaatcatttgctgagcttataagaaatgctcatactgctcattgcaacagctagccaaatttgtcctttgctgtttaaaactctaactagcatggttttactaaatttatgttaacacagtttctctctctgggttgtggggagacaaatcaattataaataatctctttagaaaagttactctttctatatgaaagtgtgacttgactttctatgataattatgatccaaaaattttatggtgtgtacctgaccacttttacaaatgattaattggaaggtagaaattgctgattcataacatgtaacttataaacttatgatggactactttaagcataaattttttttttttttttaagacagagtttcactctgtcacccaggctggagtgcaatggtgcgatctcggctcactgcaacctccatctcctgggttcaagcaattctcctgcctcagcctcccgaatagctgggattacaggcatgcactaccacacccagctaattttgtatttttagtagagacagggtttctccatgttgatcaggctggtctggaactcctgacctcgggtgatccgcccgcctcggcctcccagagtgctgggattacaggcatgagccactgtgcccagcctgaaatatttttttaatctaccctgactcctcttgctctttctgaagaaaaatttttaaaaatgtatgtaggtgcctttaattagaaaaaaaattaaaaattaaggcaacttgtgctcatattggtaatagcatttctttcaagaactcagtaatactgcattgtctttaaagcataatatctcttagacttgacggtttgagattctaaatcactgaagaacctcttgtgaaaatgatagttttaaaatttcttttcaaaaatagtcctattgcaaaatgtttgattttcttgaagtttcctggaaactatatttcattcattgtaatgaatttaattttcattaacatagatctctaatatttttctcagctcaccacaacctccacctcccgggttcaagtgattctcatgccacagcctcccgagtagctagaattacaggcacccacccggctcatttttgtatttttagtagagacagggtttcaccatgttggccagattgatctcgaactcctggcttcaggtaacccacccaccctggcctcccaaagtgctgggattacaggtgtaggccaccatgcccagccag

SEQ ID NO: 112496 - DNA, 1003 bp, Homo sapiens
gtgataaatgtttatcactttcacgaggtttcatgtaaaccaaatccagaggataccaagtaacttattgcctctgttgggtaggagagctctgttcagaaacctcctcaccttctaaaatttacatctctgccaggtggttatgtctcacaactttttttttttagagaaatatcaatctgaaatgaagacttctaagtataaatggagcagctaaatatgatcacctaccattttttaacagtatattacttggaaaatctgttcttcatgagcagggcaggtgggggtgtaactgagcatttcccctttcaagtaaattctgcaaaggttttcatgtatcctgcattctagttctgaagcattttatccatatttgaagtgtccagtaaattttagttgctctatggagagatcattccaaattatttaaatactatctttataaacataaaatgtaaagattagaaatagacaaattaagctaaagaagttcttttaatagttcatcttccttggtagctaaaaaatgtgacctctttaagaccatacggcttaattcccctaaccctactcctggcacaggcttgtgtgtataaaatgcaaaatatctgcatgcagttagaaaatcaatcttatgaaaaaaacaaatagctagatatttactagcacatatgaaattaaatgatagtcatgttttaaagatgctttatttagtaataaaggcaccatatattgtgtttgggattcaaaatgtaaggggaataatctaactgatagtctcttttacatagagaaaatggacttagaatttaatatgtagaattattcactttatacaggaagagaaactggagtctcatttgcaaaacctgtccactcttatggcaccaacatataagaaacttgcacctgatgcatataataatcaggtaagtttaaataatcattggcagcaattgtaacaacttacttgttactaatgacctatgtccaaaaatat

SEQ ID NO: 112497 - DNA, 2065 bp, Homo sapiens
tatatttttacttcagttatcttatggaaatttcttaaacagagagagttaggtgtcaggtatgtgaaaagacatgaaatttgtgttcagaagtatgagatgaggcaaatgtgatactaccaaaaacagaggaagtcatttcgtagaaaaaacttttagcctgtttttgaagaggcttcacatctagcacatctatttttgaagtgtgaaaagcaagagagtgcttcattttgggggagtgttgcttcttcccatagacagaaacatatgtgaagaacaagggtcaccacagctaactgttcctgatagactcagagaaagggtgggtgggcaatgtcaatttgtcttatctccctgtaccattttgttgctattttcattaataacaggtaggatggttttatggtaatatatatgtcactgatctggatcaactaggccaccaacacaaatctgaatactgagaggagaaagatacacacacacacacacgttttctttgggacctgtagttgaggctgtaatgtcttacttccctaccaggtatgcactctcactagagaagacaatcgagaatttggaggaaaacctgaggatgagcagcttcacgttctgcctttatacaaagtctctgacgtggatgagtttgggagtgtggaagctcaggaggagaaaaaacggagtggtgccattcaggtactgagttcttttcggcgaaaagtcaggatgttagcagagccagtcaagacttgccgacaaaggaaactagaagccaagaaagctgcagctgaaaagctttcctccctggagaacagctcaaataaaaatgaaaaggaaaagtcagccccatcacgtacaaaacaaactgaaaacgcaagccaggctaaacagttggcaggtaaatttaatgtaaagcatttgtagataaatgtgttgtgtggtatattaaaaatgaaaattattttggttttgcccccatcaacttgtaagttctggggtacacatgcaggatgtgcaggtttgttatacaggtaaacatgtgccatggtgatttgctgcacagatcaacccattacctaggtattaagcccagcatcttcctgatgcacccctaccaataggcgccagtgtgtgttgtccccactcccccaccatgtgtccatgtgctcttattgtaaaatgaacattgttaattttggaaagttatatcaatcatggtcttagttctgtgccagagtcttctctaaagtagcaagggccaggctttgttctcagagatggtaatgagatattgcaccatcaacatggaaaacatggaaaagtctggattttattctataataaacagcaactttttttaacaggtaagtgatacgatgaaattcattgtaatttggcagtaggccaaattagtagaggagctaatagtttggagataaacacagtaaaccagaactgaggtaacaagaccttgaattttgttggttagtagcaaagatatagcaaaatgatgcaaatgagctcttccaaaatgggaaaaagaaaatacattggtgacaaaacactggaatgaaagagaagaaaagtttaaagatgaccccaaagttttaaacctaaacttaacctactgttttaggtttctaaaacagtactatttattgaaataagtaagtttgaaaatatgattgagagagagagaggggagaatgaaacatttttccttagacatgttgagtctgtggtttaggaggggttctacatgtagattatgctacaaaacttttacccatcaaaatagattacagctgtagtaataacaatagaacattattcatgaatactaagttattgtctttccatagcctcctgctttatgtctgcagtttgtaaaaagaaaaaaaatccaaaatttgggatggtattggcctggccattaacaaaagcaaaccagtttgcttaaaactagccatctttgctgcttcatgaagtcaaatttctctactgattcatttccaagctcagaggaactaagttaaataatttagaatatgctaaagatgcttga

SEQ ID NO: 112498 - DNA, 2876 bp, Homo sapiens
tcttacctacatttaagtatcctcactagccttcataaaataatcatcaacatcaaagatacctgtttctgttctctcttaccctgtccacagaacttttgcgactttcaggaccagtcatgcagcagtcccagcagccccagcctctacagaagcagccaccacagccccagcagcagcagagaccccagcagcagcagccacatcaccctcagacagagtctgtcaactcttattctgcttctggatccaccaatccatacatgagacggcccaatccagttagtccttatccaaactcttcacacacttcagatatctatggaagcaccagccctatgaacttctattccacctcatctcaagctgcaggttcatatttgaattcttctaatcccatgaacccttaccctgggcttttgaatcagaatacccaatatccatcatatcaatgcaatggaaacctatcagtggacaactgctccccatatctgggttcctattctccccagtctcagccgatggatctgtataggtatccaagccaagaccctctgtctaagctcagtctaccacccatccatacactttaccagccaaggtttggaaatagccagagttttacatctaaatacttaggttatggaaaccaaaatatgcagggagatggtttcagcagttgtaccattagaccaaatgtacatcatgtagggaaattgcctccttatcccactcatgagatggatggccacttcatgggagccacctctagattaccacccaatctgagcaatccaaacatggactataaaaatggtgaacatcattcaccttctcacataatccataactacagtgcagctccgggcatgttcaacagctctcttcatgccctgcatctccaaaacaaggagaatgacatgctttcccacacagctaatgggttatcaaagatgcttccagctcttaaccatgatagaactgcttgtgtccaaggaggcttacacaaattaagtgatgctaatggtcaggaaaagcagccattggcactagtccagggtgtggcttctggtgcagaggacaacgatgaggtctggtcagacagcgagcagagctttctggatcctgacattgggggagtggccgtggctccaactcatgggtcaattctcattgagtgtgcaaagcgtgagctgcatgccacaacccctttaaagaatcccaataggaatcaccccaccaggatctccctcgtcttttaccagcataagagcatgaatgagccaaaacatggcttggctctttgggaagccaaaatggctgaaaaagcccgtgagaaagaggaagagtgtgaaaagtatggcccagactatgtgcctcagaaatcccatggcaaaaaagtgaaacgggagcctgctgagccacatgaaacttcagagcccacttacctgcgtttcatcaagtctcttgccgaaaggaccatgtccgtgaccacagactccacagtaactacatctccatatgccttcactcgggtcacagggccttacaacagatatatatgatatcacccccttttgttggttacctcacttgaaaagaccacaaccaacctgtcagtagtatagttctcatgacgtgggcagtggggaaaggtcacagtattcatgacaaatgtggtgggaaaaacctcagctcaccagcaacaaaagaggttatcttaccatagcacttaattttcactggctcccaagtggtcacagatggcatctaggaaaagaccaaagcattctatgcaaaaagaaggtggggaagaaagtgttccgcaatttacatttttaaacactggttctattattggacgagatgatatgtaaatgtgatcccccccccccgcttacaactctacacatctgtgaccacttttaataatatcaagtttgcatagtcatggaacacaaatcaaacaagtactgtagtattacagtgacaggaatcttaaaataccatctggtgctgaatatatgatgtactgaaatactggaattatggctttttgaaatgcagtttttactgtaatcttaacttttatttatcaaaatagctacaggaaacatgaatagcaggaaaacactgaatttgtttggatgttctaagaaatggtgctaagaaaatggtgtctttaatagctaaaaatttaatgcctttatatcatcaagatgctatcagtgtactccagtgcccttgaataataggggtaccttttcattcaagtttttatcataattacctattcttacacaagcttagtttttaaaatgtggacattttaaaggcctctggattttgctcatccagtgaagtccttgtaggacaataaacgtatatatgtacatatatacacaaacatgtatatgtgcacacacatgtatatgtataaatattttaaatggtgttttagaagcactttgtctacctaagctttgacaacttgaacaatgctaaggtactgagatgtttaaaaaacaagtttactttcattttagaatgcaaagttgatttttttaaggaaacaaagaaagcttttaaaatatttttgcttttagccatgcatctgctgatgagcaattgtgtccatttttaacacagccagttaaatccaccatggggcttactggattcaagggaatacgttagtccacaaaacatgttttctggtgctcatctcacatgctatactgtaaaacagttttatacaaaattgtatgacaagttcattgctcaaaaatgtacagttttaagaattttctattaactgcaggtaataattagctgcatgctgcagactcaacaaagctagttcactgaagcctatg

SEQ ID NO: 112499 - DNA, 1872 bp, Homo sapiens
cattgtgtaccatcatttttttccaagtccttttttttattgttaaaaaaaaaagcataccttttttcaatacttgatttcttagcaagtataacttgaacttcaacctttttgttctaaaaattcagggatatttcagctcatgctctccctatgccaacatgtcacctgtgtttatgtaaaattgttgtaggttaataaatatattctttgtcagggatttaacccttttattttgaatcccttctattttacttgtacatgtgctgatgtaactaaaactaattttgtaaatctgttggctctttttattgtaaagaaaagcattttaaaagtttgaggaatcttttgactgtttcaagcaggaaaaaaaaattacatgaaaatagaatgcactgagttgataaagggaaaaattgtaaggcaggagtttggcaagtggctgttggccagagacttacttgtaactctctaaatgaagtttttttgatcctgtaatcactgaaggtacatactccatgtggacttcccttaaacaggcaaacacctacaggtatggtgtgcaacagattgtacaattacattttggcctaaatacatttttgcttactagtatttaaaataaattcttaatcagaggaggcctttgggttttattggtcaaatctttgtaagctggcttttgtctttttaaaaaatttcttgaatttgtggttgtgtccaatttgcaaacatttccaaaaatgtttgctttgcttacaaaccacatgattttaatgttttttgtataccataatatctagccccaaacatttgattactacatgtgcattggtgattttgatcatccattcttaatatttgatttctgtgtcacctactgtcatttgttaaactgctggccaacaagaacaggaagtatagtttggggggttggggagagtttacataaggaagagaagaaattgagtggcatattgtaaatatcagatctataattgtaaatataaaacctgcctcagttagaatgaatggaaagcagatctacaatttgctaatataggaatatcaggttgactatatagccatacttgaaaatgcttctgagtggtgtcaactttacttgaatgaatttttcatcttgattgacgcacagtgatgtacagttcacttctgaagctagtggttaacttgtgtaggaaacttttgcagtttgacactaagataacttctgtgtgcatttttctatgcttttttaaaaactagtttcatttcattttcatgagatgtttggtttataagatctgaggatggttataaatactgtaagtattgtaatgttatgaatgcaggttatttgaaagctgtttattattatatcattcctgataatgctatgtgagtgtttttaataaaatttatatttatttaatgcactctaagtgttgtcttcctgaagtttttttagtgcttgaatgactgccacctcaatgaagaaaagggaataaaaaataatttttaaagacacttttaagatagatagttagtcttatgttaaactatatctaagataatacccaaataattaaggccgaagtatttctctggttaaatggtgtagatattcactcacttttccttccaactaacttgttagtgtattcactttgcatgtgtagacagtgtaaatcagatagagagtaaagcacctctaatcttagattgccccctccagtgttttgtgaagggtttcagtgatatagcaggtgcactaaggttgaattcatattgcttagaactaaggccaactctgttttcagactctcaccttccacttcttgcctactcttcttaagggaagatacttcttcc

SEQ ID NO: 112500 - DNA, 1024 bp, Homo sapiens
agaaatatgagaactatttactgtgagtcaagtatgacatgtttagaaaggagtaaatccatagacatgatttcatgggaaagcaaactgtattccttatatggtaagctaacaaattgtttctttgcgatactatcccatttggggcattttttgtgtagtcaaattttacaatacaagctttatctaaacctttcatattatagcacttctatgttgtctgctagagactaaaatgacccagaaagatacaagaaataaagtaggaaggctctagaatttttaatgtagctttatataaggcttgggccaaatgagagaacttgggacgaaagtttgaagggaaatagctttaaatagagaaatgcaactttagatagcttatgactgtttgtatctgcctaaatacttcctaaaagtcgaaattaaatttgattaatcactcccttctccctcctcttatcccttccctaataccctctttccccattttaaatgcagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaa

SEQ ID NO: 112501 - DNA, 1023 bp, Homo sapiens
tgtttcttcaaacttgtctgttctcagaatcttggcccagccatcagaataaatagaaacaataatttaaagttctagaagacagataaattttttagcaagtgtgtgttttatagcaagcatgaacaaacatatatttaaatatgtgtgtgtgtgtgcttgattttaactttcaagacattagctgcggaagccattgaaagaaaacctctcttctcattcctagctgcaagaccttcagtggattccatgggttaagataaaaaatattttcaagtatttttattttactctaagtctgttgtttgtttatctgaaagaatgaacaatgataatgaaaagcaaaggggaatatttacctttttcaggttagagatccattgtgtgtaaactttcttctataatttcgtgaaaaaacttctggatgcgctttccacatataaatatttattgtaacagagattctttctctgtttttatttccaggtatcatcttcaccaaataaagaaagtaatgaagaaggtatagtatattttgattcattaagagtaacatgtataaatttatttgtttacagtagtggaagccaaaaactaaaactaaaaataaaatagataaattgaaaagctgtataagctaagtgaaatatttttaaaatagtcgctaaaatttcagatgaaatattttctaactcagaaaataaggagaatgcatttaactacttttctaggttagaaaatgatttgattgtacggtgactttttttttcgctgaagtactgagatattccagccagttctgatacatttaattttaaaagatttaattaaaaaaaaactcttacatttagatatttatctttttttaatgaatcacttattttagctgaagatcttaaaatctatagttatagaattaaaaataaatataatatttttattaccattatttgaagctgttttaataaacaagtaaaaatgctctgtagtgaattttcagaatttaagcatgtgcacacatca

SEQ ID NO: 112502 - DNA, 1073 bp, Homo sapiens
tctggaattttccatttaatatttctggattcagttgactgtaggtaactgaaactgcagaaaacaaaaccgtggataaagggagattgctgtgtatatgatcctcagtgactggcttttcctaggtgtctcctccctctcccctgcctcctaacagtgatgttctatccatgcagaaccatctttgtatattctaaaatatagtcccttgcttttatgtgtgctgttccttctaccttttcccctcttgtccagttagtgatgtacttctcacttttataatgctttcttttactccctcttctatgacattaccattgcttctgtttatctctgttaaaacctcattgcattttaattgcagtttatctatttgtctctttccctgagttaaaaactgagtatcttgatgaaaagaactttgttgtatccatccatttattccccatacatagcacattgtctgaagatgctttgtaaatgtttgtagagtgcaggaatagtattatacatatgaaaacacaaaagtctgaaggtgatatacatatcaatgatgatgctgctctaggtatcacaatcaattgtgcttctggttagactgggccccatgtttcctggctccctcagtccaatgctctgccactaaagggaattaattttggttcttaacaaaacatctttttgtttttttctttacagatattgatgatgttaagaagttcaaaccgggttacctggaagctactcttaattggtttagattatataaggtaccagatggaaaaccagaaaaccagtttgcttttaatggagaattcaaaaacaaggtgaagatgagaatctttattttaaaatgtacctcctgatacctgtacaatattcgtttcacttgggaagtttcttatgtgaatatgtatatatagcatggttaaaaaagtgctttttactaacttacatatttaaaaacattattttattatttaaattctgtttcagaagatctaagtgaatcaacaaggctgaaaaatatatatttccatctatgtgtctatagctcctacgtcttggaaaat

SEQ ID NO: 112503 - DNA, 1079 bp, Homo sapiens
tcttactgggttcctttctctctgctgtggtttggaatgtgtattgagcagaaaaccagggcaatcacatctcttctcatttgtttacttctctctgggatcacagtcctgtactgcctgttgtttaatgtctgaaacgagtgatttcatatattttgtccagttttttagttgtttgcaatgggagggcaagttgtttatctgtaaaataattcagtcattggtgaaagtggaaattttgagaaagttaactctaaagggacattgcaaggcagactttggctattttcatattatttttaattattgaggctttgttacatttcagtctgtagttcttttaatcttttatatggattttgtgatatgtgagtaaactctccaaagccttgcaaatagtgaatttcttttttctttaaagattctttcttgtggagaagttattcatgtgaagatccttggaattttggctcttattgatgaaggtgaaacagattggaaattaattgctatcaatgcgaatgatcctgaagcctcaaagtttcatggtaagactgttactttccagaaagtgaaagcaaattagtgtgtcattggaattctgagaacttaaaagaagttcacataggggagttaaatgtactttttaaaaaagagagaggaaaagatgtagatagacaaattatattttaaatgaagaaagtacattctactggtttccctctattccctttttcttccctctcctgtcacctctctttcactttcttcctcttcctttcactccttccttccctcctttcttctttccttacttccatgattttgatggtccaactgctgttgggaactgttttgaaagcatcctttgactaggaataaaagcatacgatactggcatttttaccctgaaatctcttttgttcatatgactaacaagaagaaactaaggaaggagtgttcatcgatgacaaaagctatttctgcacctagtttttgtctcttcttgtacaaatgaagggaaaagtaactgccctctaacgaaattttgatgtcctagaaattttaagttctggaaa

SEQ ID NO: 112504 - DNA, 1460 bp, Homo sapiens
tttcatgcctggctatgagatgagtggttgaatcagctgtaagaaacatagtggtaggaagtcacttttaacaccgcattgttaatgggcagagggaaagaagcagagtcctggaagttggtaacagacttagaaccacagatatagaaaacttgaatgttctaagtcccttgagggattttgtattgttcatttggtgtctaagaaaactaaatgttatactttcagcacagatttgttgaattgatttagattgaattgaagcgtggtggttttgtaagaattctaccatttattcctaagcatctagtttttggtttgattgagttttcctttccagtttttaacggtgttacagcaaaacactgctttgtttgaaataaaactgtgcctttctgttgcatgtgaagtcaaagagtgtgtctcattctgaggcaacttggtaatctgggcatgcttccttgcttgctttataacctatacatgtcttatctgttcttatgttgtttgaaattttaaaataaattttgtgaataaaaatagataaaacaatttagaatgtgctttttaaaagctatatgtgatttccaggaattcttataccctgctgccagagtcatctacaggatttcttaactttgacactattgatattacagatggataattctttatgagagaggactgtcttctgcagcatcctttgccttttcctactagatgctagtaatacctcctccccagttgtggcaacccaaaatgtcttaggatattgccaaatatcccctagagggcaaaattgcctttggttgagaaactctcatttagtgtatccagtgtgaattaaccagtatagccaactttaaactggcaattatgtgataacttcaaatttgaacatttttgttttataaaggatcttacacatcttttggtccaatgtgccataccctcctgaagacttctgttctcaaggctttttattctagttgttccttatctgacagtttctagattattttccactctggttccttttcactagatcatctctgttaatgcccatgttagaatggagcagtctgggtgcagtggctcatgcctgtaatcccagcactttgggaggcgagctaagaggatctcctgaacccaagagttcaagaccagcctgggcaacatggtaagactgagtctcaaaaaaataataataaataaatagaataccatactaccacagctaaacgcccttctctaaatatgatccagcctgtataagttagcaattacatatgcagttgtaaaatttttctatggagtactttagttttgatgtatattcagagctgcaaatatcatccatatctttataatcacttgtcatatgttccttttgggcttgagaatctagaatttaagcaaccagagtccaaacttgaggacatgtatcagaaatactttgt

SEQ ID NO: 112505 - DNA, 2551 bp, Homo sapiens
taataattcttattacctttattgcatttgtcacaaatgccataccatttattaacatgacactctccatggtattgactgtttcctataaatctctgttactggcccaaagtaggtactcaataaatgttttactgtatgaatgaatgcctgttaatagaaaaaaagaagcagtaacgggaagactgggaaagaacagaacctctctaggaaagttacttaggagattgctcagagtaagagaaggtatttgaaagaagagaaccgtgaagtagatggggttatatttgaaaataaatgccattcaattgttatcataatttgcacataaaaaatgattagtagcatgagttctaatacaatctttaccatatagaaaccatgagtttgtgcaagtttaaactctgtgtttcaatttacttatctataaaatggaattcgttatggtatattattcatgtggtatgtatgtatatatgtgtatgttgtgtgtgtatatattagctagaaagtgtttgtcacctatgaccagtatgtaagattaacaattgtggttattcttatattttcttagtagtattagtatttggggcagtgaaatgttgttggacttcatttattgatttttttttttaagataaagttaggccaggttatttctgaataaactaattagtactagaaggaaaatattggaatttctctaatgcttagctgtaaataagtttgtttgtaattatctatataaaattaaaggaaataagcttagataacctgaaatcttagataataatgataatctgattcttgggatgacggtctctgtatcccttttagtttgaatttaaagcaaataattttagggaacttctacagttccatttagaatcaggcaattctgaggctttttgggagagatagtgcctaagggatctttaatcttactagcaaatttctattacagtcttcatttataaaaattcctatgtgtatattttgtaaccaacagggtataatcttgccagtaaactaaagaattgatgtcttttcatgtttttatcaaggtccttgagatttgacaggtagaggattttttaatggaatgaataagacaaaataggtttttattttctttagtagtgttttgtcctttcatttataaagggaaaactggattccttttagtaatttagatccatgtgctgttaccgggtcaaaggaagcggtgaatgacggaagccacagttgaggcagtcagcggaaacacagaaacaagggcacagacagtgggaacatccactgaaactctaaaagtgaatgtgaatttattccctgactgaacttggaagatgagtatgtctgcatataccacccacttgcagatgcaattataccagcaactgagagatggaggaaatactataaatctgttttaaatattatgatccttagggacatactggcctgttggccttgggcctatgtaatttctgataatgttttctttggattattgttatctataaaactttgtgattatgtggaaagattaaagtacattatagtattaacttacatttctgcttttttttaaaaaaaaaattttagacttgggaagatccccatgaaaaagataagagcacgaactgctttggagataatgatcctattgatgtttgcgaaataggctcaaaggtttgttttatagactgtattaattctaacgtgagttttggtttattcatgccataaaatttcattttagcctctagttcttcaactcttcagagttcaagcctattgatttctctgttatcagtccctccttttatcttcactttcttgtcttaaaccaggggttggtaaattatagccctgtaacaagtcaaagccagcctaacacctgtttttataaataacgcaggtatgcccattcatgtacatactgtctatgactgcttttacactacgacggtagagttgaggacttgtagcagagattgtatagtctacaaagccttttattattattttattattttatgtctaccatctgaccctttatggaaaaatttgccaagtcctgtcttcaccttccttgcctattatttagataaaaacttcaattctcatgaaagtcatctgatactttttcattttttgtgtgcctgcttccaggttgccacatcctactgaataaaaacaaaatccacaatttcagagattgatgctccccatcaattcttctatatgtctttggtcagttctttcttctattttctactacgtttattgttactatttcttgttctctgcagacattcaactcttctcccttttttctcactcctagaagaacatcttacctttaattttgtagagctcagaaaccagcacataaaaactttcaatgtggtttaaatttgtatttctctgatgattagtgatgtagagcatttttcatgtgtttcttggccacttatatttctttttttgagaaatgttggttcgtggcctttgcgcactttttaatgtttttcttgttgagttg

SEQ ID NO: 112506 - DNA, 1017 bp, Homo sapiens
aaataactaaattgaatgatgtttttaagaatgctgaaatcatgccaattgcttatgggatagcttatggaatagctctacctgattttttttttttttttttttctgcttgatggttgatgttcagacatgaccctgttaaaatgaaagccagcccctggtcccatttatctttttaatctcatctccaactctccttctgccttctgcttcttcacttccacactggcactctggtgctcaaagcacactgatgtctcaagccctcaccttcactgtgtcctttcctgggaacactcctttccaggtatgcacatggcttccttaggttgcctttaactcatcttcttcatagtatctgccaatcatcctttaaaacttttaaccctactcccattccccctctcatactttatttcccttttctataacacctgccaaattgtaacctgctgtataatttatttattatgtttattgttaatttctcccagctagaatgcagacttcatgagggcaggtattctgtctcttttgttcactgatacattctgactacccagcttaatgcctgccatggagtaggtgatcaataactgtgaaatgaataaattaatgcattgtgtatgtgtgtcacatttgtttcataggcgtgtgtggatactttagctgttctatgattcgtcttgtaacagcaagaaacttgttcagagcagttactgagccaactgtgtacttagaagaacatttaagcagcagaatactgtttaagtagtagtctatccacttagcttgtgattcatcagtataccatcattattcagaccttcagctgtctagaccgttagcctgaatagcatctcccgcactcctaataatgccttcctcaaagtttgagcttccctgggcaaaaattcatctcgtcttcccaccagtttattcatattgcccacatgtaatgggttatttcagtgttacatctcattgagtgaatatttagaatacctgtctggaaaa

SEQ ID NO: 112507 - DNA, 1051 bp, Homo sapiens
ctttttcaaaagtgatgtttttttttttaatatgtattttgggttttagtctattgtagatattttctgctttggatattttaagccacagggataagtaaattatttcagcaacccaaatatggtttagccggtatatatttcttttcggtccttagatggtggcaagttttaaaagttgaattaactttaagttgggagttaaagttagctttgtaaaaaatgcgtaagtttaaaagtggataaggatgtttattattgctgtatagaacaatgtgtctattgctttaattctgttttgttttgtttgtttgtgtctttgcagagaatgtaactggtcactacatttccccctttcatgatattcctctgaaggtgaactctaaagaggtattgttttgacttgttttgggaatgaaaacgtgtactgccagtatcaccattagatgctttttggaagcaccttgaaaggaaaaagtgttgttggaagtcaggaggacaaacaggagttactataacagggtcataagcctcctatatgaattaaaagttgtatgagaataggattcttccatgaggaattgggagaaaggggtgttactggtacataaaacttagaattcggtaggaaataaagatttaagggtagtaatttaggaaattaccaagaggtttatttacaataatcagctaacgtttgtggattattttttatttgctagccactatgtgaacatgatgttatttaattgttatgagttgctatttttctttccaaggacactgaggctcaaggcatttttatagacttgtctaagatctggtaagtgccagagctagttttggaattagcttctgaccacaaagcttatgctctttaaccactctatgaaacaggtgttagagaaataaagcaggggtaaaaatggtggtgtttgaatagctgttctcttagaactgaaaatcacttgacagttgtcagggtgtgaaagatgccaggagaactgatgctatcaaatcaaaattgttggggtgtttcgagatctctcat

SEQ ID NO: 112508 - DNA, 1049 bp, Homo sapiens
cttcgtgactcattgttccgtgtaccccattgtttcactgtgtacgttaaccgtaacagaaaatagcgatgtcggtcgcttgccttcactccccactgactgcagagccttggagtggtagtatcaaagtgggccttgcattatcgctccccttttcggagcactggctctggaggctttcagttctaagcaggccctcgagttcttcacgtcttaactctgtgaccccggacgagtttaagttgctaagccttgttttttctcatccgtaaaatagggctgcaagtattacatgacattatatatgtaaactgattagtcacagggcctaaaatataaattactattgttaataccgataatcattatagatatttgtaatttatgagagatttgcagttatgctacatgagtttagggtcgaggattattttgtgggaaagaagagtttgcctaaagtcgtgtgattataatgcaactagtactagaatttctattttcttcaaaattggttgcagttttcaccctatgccacatattttcttctatctttggttaagactgatcaggtgaacaggaagtctcaaatttctgaatggattatgttctaaaaggttaccatgtgatgattaatgggaatagtcagaaaaaattatgaagtggcagttcgctttttaagcagattgaaaaaaggcctgtctactgcaagtattctagatttgcaataagtacggtaattaatagatacccaaataataaatatttatgaagtgtgctagacactgttaggcatagtacagagattcacaatattactataattatggaaaaagtaaatacactggttgagcaaaaacaggcttgagaagccaggagcgcacagagtagttgacccagtaccggatttggaatggggagtcctaggccataatcttggctctgccgttaactcgctgtgtgctgttgggtgggtggttacttcagttctttctcacagagccagtttcttcagctgtaaaatgaagcttttgaccttgaaacgatgatcc

SEQ ID NO: 112509 - DNA, 1048 bp, Homo sapiens
tacttgcctcgggtaaggtctgacttctgctgtataagcagtaaactattctaaatccttacacactagtacatatcctcatagagggcagttaataccaattaggcccaaatcttcccattctggttcttataggaatatatagatgtatgtttgatacaaaacatattcaaaatttttttaaaaagacagaagtaacagatgcatcatcccaatttcttggaaaaaaaaactgcactctagaattcctaaataagaatgttaacagaaatggttaatggagacagcatgcgctggcatttaaaatgcttactgtttaggaggagaaaacatcctaaatacagtgcttctccatcagctcaatgttttttgtttcttcagactgataggctggatgtggatagcttgtttagcaacattgagtccgtgcatcagatatcagccaagctgctgtcattgttggaagaggccacaacagacgtggaaccggccatgcaagtaattggtatgtttattctcttctcgagttctacaatacaacaggaaataattttttaataacctccctttgctttggttttttgttcctgactcaccatgcttcccaggagatatataaatgctaaacccatctttgggctcattgtgattatgcagactctgtgtttattttcaaatgggtttatatccatttgctgaagtccctcagtagcacaaaacataccatttgctttttaatttccaatctttcaatctctttgctttccagatgttctgtaattttttttaatggctaacacttacttgatccttaaagaattaattatttaaatattctaatagctttactgatttctcattacaatgttttttagatcttatgcccatcaatcaatttttttagattataaacttcttacctgaggaatgtaaaactattaaaggaatgtaagttattaaaaatttacacaagttctactttttttcatgctctctttttttctgtattatttaccttccaaatatgtttttactgtcaatcagatat

SEQ ID NO: 112510 - DNA, 1031 bp, Homo sapiens
ttttcagagtatgtggacaaatatctggattccttctcttataaatcgaatatctcagaactctatttttgttacttttcacattgattaaaaatgtatgcatgcagacaatattgaaggctaccttgatttcaagagctaaaaatgttttatcaactatttcagagtaaagttctaaattataactggatatattttaggtataataactaccattttttaagtaggatgttattttgtaaaattttatcttttacctatatgtgaatgtaatgcttttgtgaatcttcttaagagtataaaggtagaaaaggtgtcaataagaagttcaattcaaaattaatttgaatacgtacatttgtgcctaatatgaaagtgaaaaaatatattcttgtgtgaacaagagcaatatgtatttatatagtggcattggtaccattgtgagcttctgattagccaggaaagttaatcagagaagttgaagtgttatacccttatgaaatatatcagagaatgagatcagtcctacccaaaatgtcactgtgcagcctaatgaggcaattgataaaatccttattaaaggagcaggagactcttacatgatagtttaaccggaatcatgggcaaattgtgaaactaaaatcatgagaactttttaacacatcataaaaattgtacacttccaagtaattaactttgcatatattttgtactcctgtaactgttgctcaaaatttaggaggacatttttttttaatgggtttagaatctatacagctgtcttctttctctcacacagtcactcagtaaataaatattgactgaatctcttcatcttggatatgttctcctgaatattctgggtatgggcatttttgctattaagagtgaattaaatttttgaaatgatccctagttatttggagaaaagtctaaaagaattagatgtttaactaaggtcgataatactttgttgggtaaaaactatgttaaagcactaaatctggttttcagatatagcttagaattga

SEQ ID NO: 112511 - DNA, 1115 bp, Homo sapiens
taatctctaccaccgagattgtcataaaccccaggtgacagacaaggaagcgaatgaccctcgcctggtgtggtattgtgcccgatgtaccagacaaatgaaaagaatggtaggaatcatatttttctttattttaaacagtctgtcaatgtttttgttggtatgtgctttcaaaacaaagatttgaatatttaagatattgaaaaaataaataatataagctgattatttatttatatgtatagtatgtacatgtgattaatatttctattgctaaagaccagaccatgttatgtgcatttttctctttttagttttatctaattctaatatagataaaacaagattggtgacacacaaattatgaatattccttactagtctgtcaatgtattgacaaacattttaaaataccatgcagcactgagaagtggtgagatacaaagccccactctttgttgagatctggtaaggaaatatagaaaatttctgagtgagcttaaaccaccgcatggataagatgtgtacagaggcgatatttatatgtgcatatctgtctttccagctgcatttctctgttgcttagtctttccttctcattgtcctcaagtgaccattacctcattcttcctatgtactttctctttttactgttgactaacatacctgcctttaatatcatagtgaaatatcttttcatttgttatattggatagttttctaacttttattcacttataaaatagataaatgataaatgaatttcataatttttcttttaaagaaaacaagaaattgccataatgtcttattctccacctctccctcccacttccatctctcttcccctgccttaaattagtgattctcaattgcagagttctcatgtctgttaatcaaatgaatttctatataaatttgtctaaccaatatatcttttaaaggtcagaagtacttagttaaaagtaaaaactcgggatacccattttactttttaatcagttaaatcagaaataggaagtgtttttatttattcctatgaaataaaaagtagtaaatgaaaagtgtgtatatcaatagtgtgtatatttcttacttgtaacaggaaatttcta

SEQ ID NO: 112512 - DNA, 1097 bp, Homo sapiens
ttacaccacatagaaaaatcagctgggggtgcaggatattctgttctactactttatgtgtatatgaattcacttgtttacgacttactttaatttccgattctttgtgatcagaattttttttaagctgctgaatgtaaccacaacttacttctaattattgcctaatattttaaggattaaaaaaaatcaagtaaaaggacagatctttcaacaaaataaattgaatatgggtaggataatttaagagaaaaggaggtatggatgaactctgagaactgtgtagctcctgtcttgataataacaaagcagccaatggcagctttatgtgaaaagaatatatgttttgataccaaacacacctgttttaaatcccacttaaatcttataattgtgtgatgataatagacaacgtatcttgatgtcccaggcacttttctgagtagtttatgtgaataattaattttaattatgataatgatcctttaagatagataactgttttcttcattttacataaggaaactgaggtacatagaaacttcatttcacttagtctgtttattggtaaaatggggataataagaactactttgcagagttgtaaaaattgaaggagatccagtaaatgagttacctagtgtagtacctgcctggtacataataggctgtcactgaatgacaactcttattatattccctaatacctactaagacattctatcaaatccttctaagctctgaccctcaaactccaaatcactcaggtctgtggacttagatcccaaactgagaaggagaaaatagaacatgactagctcaagtctaaccagaatctgaagctcaagagaggatctagtcccaggctcagagcccaagtaaacactggcattttgtccccagccttctttcaatactaggtctagtactccgaagcctttttattgtattttgaatagcagaaccattgtgacttcatttcttctatccattctcattgcagtaggttcagtgagttcagatcgaccaaatcaatatggctctacaaaacatactaccaaattcattccactgtgggtgttggtattgtccagata

SEQ ID NO: 112513 - DNA, 1052 bp, Homo sapiens
tggagaagtatgcttgtttttaatatgtttactgtttatctctcattctctgtgttttatcaaggctaagatatattcattagaatgaaagtgaaaaaaaaaaaccagatctgaatgcctaaatattaaacctatgactaattccaccatttaaaaatatattagaacattcctgagtaatgaaatcaaagacataatcttttctttttacccatttattcattcggcaagattcccaagcaaattggcacgtccaggaaagagatgcacactctatttaatatcctgaagtttgtggttttgtctgctactttctcactccctctctgcagagtggcacctgtcaaagctgagaaagagtaaattactctatttctgtgcttggcaggaatgtaatatggagtaacaagagctgtgccgcagaagccctggagacagaagttgattctatagtacctaccttcttaaagctcgtgacagaaaattagcgaactaaggcattctgaagctagaaaagaaaaaagaggaaggatttttttttttttgcctgtgatatttgcatacttggagcaaatactggttctactctctaaaaaggcacagtgcaagccaaaaacatcacatttgtacaggtttacaaatatttaatatttattttaaaaattatattagtacataatagggagacattattcaaggagagtaatttttttttttattctaagatcattaagtaacatttttaatctcccagggggaaaaccaacatctatattaaaaaaaatacgttaagaatcaacagtactttgttgcattttctctcaggcatctcattaatttttagatatcaccatgggcaggttattgctattctgttttgctgacatttagcattttattaagtgctaacagtgagaagagtttatagaatatgtctaaaatcctattttcatattcttatgtgccttacaacgtggcaaatataggcatactttttaaaagaatatttctacatatcttaaaagctattaaatagcatggctttgtttcca

SEQ ID NO: 112514 - DNA, 1030 bp, Homo sapiens
gggtttgctcattttaaaggagctgggtgtaatatttcctctaatgctagttaattgcacagggtggaatttttttcttttggaagtcatttagtcagtcttcagaaacaaaccttatagcattattatctactgcaaatttttactgatttctagaacaggcttttgaaacattcatcttttattttagcttctaaatgattatattctaagaccataatcacttcaatttatactttaggtgacccaatgaaagaagaaaatgaaagccataaagaaaagtcttacagaagaagaatacctgtacctggacttttctcaccaaacagaaggatgcatctttcctcttcatacatctgtaactttatttctgttatcttactgtgactgtaaaatctttaaaatttgcttagttgtcaccaaagaggtgagtagagatagttcactactaagagatgacctgatccaggatgttgaaatacagattatttcaaggcaggagctcccaccaatagtccaaaattgctgtttgcctgcagtagtagaacgatcagacaatttttgtagagcaggacttgctgttgtattgagacacataatccagaaatcctatgaagcagaccccttaaagaaggaacttttggaacttctgggctttaaaaagacttgcttgaaagcctgtgctgaagtaagtataatgtcttttttctgttatttgaagctacacagtgataacataattacctgaccatttaatattttaacttcctattaggaataaaagtttatttattttaaaaaaccccagtaaccaatgaaataaagtagccctttgatatagtttgaatatttatcccctccaaatttcatgttgaaatgtgatccccaatgttgttggaggtgggacctggtaggaggtgtttgggtcgtgggggcagatgcctcgtaaatggcttggtgctctcactggggtaatgagtgagttcttgctctattagttcatgagagatctagctgttgaaaagcgcct

SEQ ID NO: 112515 - DNA, 1057 bp, Homo sapiens
tgtctcctgatacaacataaaagcctagcccagggatgattgagctcaaaacttatttcccaataagacagttattttttctaaagttatattgaaattaaaaaatcttttcatttcttgttttgtttttgttttgtaggttagtcagtggaccaggctatgtgaactcaccatccctttggctattgagaattttctcagagaatcttctgaccagcccccaactatacctgtagaaatactacagctagagaaaaagcttagtgagcctgttagagtgcataatgatgataaactccgcaggcagaagctcaagcaacagaaggctgatggagttgggcctccccttactaagggaaaggcaaagagcaaggtccacacacaggaaacatctgaagggttggattcttcatccaagagtctggaactgaaagtggcattctcaaagctcacagtacaggaagaaccagctactaccaacagagagccttctcacatcagaaaagcaaaagcctccgaccttccacctctggagcatgtgtttgcagaagggctttacttcactctggcagatattgtgctcttgccctgtatccatcatttcttggtaaggtttcatctggactgtacacattactatgagtttcagtctatgaaattgcctaggtttgaatttctgttttactttttattgtcaatatgctgctaggaaagttattaatatctttctccattttcttatctgtaaaatggtgataataatagtacctatctaaaaggaaaaatgtaaggaacaaattaaagtttgtgtgaagtatggagaacagtgcttggcacatagtaagctctcaatcaaagttagtaattactatgacttttaatgtgaagttgctaaaatgttaacaattgttattattaatttcaagtttctgttgtgattactttctaatagtagaaggtccaagtcggctctgtggtgcaatggatactccgttggacgtctactattagagggtgcagttaaaaaaaaaaaaactaaaaatcttgtcagctaaat

SEQ ID NO: 112516 - DNA, 1008 bp, Homo sapiens
ctctcaaagaagcaagaacactctaaattttcaagaaaatagaatttggtggtagtgctagggagaaagcatctgaccaagagaaaacaaaaatatatgagtttgtatcaggaagaacaatttaaaatttttctaatttgaaaaaataaaagtcttactttaagtgctgctttataaaaaaaaaattctatagtgctagttatcttttttagttttaaatatttacaattttctcttttatctttttactattttctttagtaaaatgttctccttacctcattgtgtaatttttaaaaatatggttctgaaagatgcttcttacattattggtaaggaatatcatttagattatgcctaatagttcacacatacagagaaggtagtttcacaaacacaaaaaaatggaactttagatcattattaatagtacaagctctccatttttacacttctgcagtgagctacaaaatttctatgagacccctcaaaatacatcaatgattgcagactacagatattaaattgtgataatttaaacgtgttacattatttgtgttgaggaatttaatacttattttaattctttccccattaaacagttaaactaatttgcataagtatatattaaggattttaggtttttgatataatgttgtccaattaactctctatatgcagtgtgttaagaacttatcaagtatatagagggtcaggaacagaggaatgtgttcatggccatgaattatagatgaaagggtttccagattggaatgcagttgattatagaggagttcttagagaggggtaaaaacatactaccaatgaaagatgtagacaattgaatataagatgtaaagttttccaaaatgattttcagttgtactgtttatagacatttgcaaatgccattgttatttatattgattctttttggaattattgtattcttctttttctattgatggttgttttccattgtatagctgtaccacagtttatccattc

SEQ ID NO: 112517 - DNA, 1008 bp, Homo sapiens
ataatggaaagtaatctcataaactgatacaaagcattcgatgctagagtctcacagatttttatttgaataggttattcctaaagataaaaataacagagccatggagatatctagatatagatatatagatatagatatagatatagatatagatatagactgtgtacctggaatgtgattggaaggggtctgtgaatccatgtgtatgccatgccactgtacgtagatcaaataaacaaatgtacagcttctaagatggagaaggatcctgaaaatgttttaatatattgaaaagtggtcctaattcttgaaaatattgggaaccatttggttacaccagaggaatttttctctagtgacattaaaggcacttataaaagactagtatgagtggtattttggggtatgtgttaaagtggtagcttttaggctgtggcgattttcatatatgtaaagggagactttgatggacatatgcagagttctttttttattatttctatgtggattgtttttgataacattttcatcctcagctgaactttctctttgatatccaatatatttctaggtagcttattgcttctatggattttctagtaataattttaaaatagcattactttttattatcacaatattaaaaaataggaaagtaattgtgatgtcaaaatactcaacacatggtatttttatttaattaaaatatgtattttggggaatagctgatgattattactatttatcctcctccttaccaatatacaaatataattttttagccttcaataatataataagactatattaattccttaatttagaaagaggctatttccttttctaggaaaagggcattgaagtgatgttttctccccacccttgccctacttggactcttgattggaatgttctccctgcagcagtcagcccaaaggaaggtgagttttcttttttctttaagttttattcatactttggatactgtcttcagatatgtcttct

SEQ ID NO: 112518 - DNA, 1019 bp, Homo sapiens
atttcaaaggctgaaataattgagattttttagtttgaagaaaagagaactgaggatttaatgtacattattattatatttttaatggactgtttgggagtaagttgcagacattgttcactttcactcctaaatacttaaatatttcctaaaaacaggacattcttttttttttttttttttttttttttatggagtctggctctgtcgtccaggctggagtgcggtggcacgatcttggcttactgcaagctccccctcccagattcacgctgttctcctgcctcagcctctcgagtagctgggactacaggcgcccgccaccacgcccggctaattttttttgtatttttagtagagatggggtttcaccgtgctagccaggatggtctcaatctcctgacctcgtgatcgcccgccttggcctcccaaagtgttgggattacaggcgtgagccaccatgcctcgccaaaacaggacattcttttacatcgttatagtatagttatcaaacaggatatttaatttagtacacattattatgtaacctatagtctggcagattttggcacatttagttgcattaaggtgaaacagtttacagcctttgtctttcataacatggtcatttttggaatagttcaggccatatttttatagaatgtctctcaatttggatttgtctgatgttccctcatgagtagattccagttatgcattttgggcaggaatatcacagatgcgatgttttatccttttcagtgcagcctatcaggaggcacattatgtcagattgcacacagtgctatttggttaagctttattgaattaataagtaatttgtagagagatactttcagactgtgtaataccttgtttcttttcaaccttgcactcactagtttatattcattggatgcttcttgcctatgatagttacaaaatggtgattttcaagtctgtcatccttctatatttattagttgccactcttctgtaagaaagttttttcttctctt

SEQ ID NO: 112519 - DNA, 2993 bp, Homo sapiens
tatgttcatggagaaggagaagtaggggaaattctttcatactgaaagcttaatagtatccaatttcaattatacatctccattcaaaataactgaaaactgaaactaagtatcttattttgagtgtaaaaaatgactgagtgaatgagatcattttgaactttaaatttagcttagatatgtgaaaggcacagttgtataacatactattacctaaatcccgtgggactactttgctgtaagcaaggcctgaaagagtagcaagattaaattcaagttttatactttagagtcctcaacaaaaataagcacatgccctgtatctaacatagagacagcagttctttagctaggacagctttggtaaaatgggctcacagctttagtgcctcattgccacataatgtatggcttactgggtttctctctctctttttctgtttgtgagccgtgaaaccagattgtcttcttaggaaaatacaatgccttttttaaaactgtactaactgtagcatgtgattaaaagagaaaggttaaaagtcttttttcttcttggaattagatttgctgtaattcttctcattattatgttatgctttgttctcctctgtagggttagacttcaagaaccctatttatagaccatgtttttaagtactttacaaacagagaccataatgactgattatcaataaaggttttaatggccaatatcaagggtgtattatatacaatcttctagaagtattgctttttaaaacaaaatgcaattatttgatgcgaggaaacatctatgtgatcatacaaatttatctgaggtttattttatttaggtcatatgtagggtataaaaattgtctgggtttttttgtgtctataggaaatgaatgaattgaatgtttattgaataatcaaggagatttgggtttggttttgacttcactaagttgtttgtcatagcactaggcaagtttgaaaattaccatggtttattttagaaatattatgagtttactagtaagaaacttcaaattatccattcaaaggtatacttaagtattaataatactatttttaagtattaatatgtttcagagatcattttgcttcaaaggctaaaacaggatttatgtgaataatgaaatactggtttctgaaaacctttaccagccaagggttcaattctctcgtcaattagtattgaaatgtagttgtgtggggccattttaatttagcaagacttcctggtgaatttttctggagcacttcccagttccactatatttctagcagcatctgcattatcttagggtagaaatatgtacccatttcaagataagacttttcctaagcactttatatttttttctttatgagtttttccattgatcacaaatcctggataccataataaaaggctgtgatgttttagaatgaggcagctttacatgaaaatttgtaaatatttgacataaattattaatgggtaaatttttagcaagaaaccactttaagtagaacaaaacttactgttgagagtcatccagaagcaatgagggacaggaaaaaataatgttttctctgaaacaaagatagttgcaataaagcatttagttccagctttcagcatgatttctaataaagataaaagaatgaacaatggaaaacattcacagagttatttgtagttatatataaattatatatacagttggatgtattcatgaaccaccctaggattaaaaatatttgaaaaaaatttgcatctgtactgtacatgtacagacttttttcttgtcatgatgccctaaacaacacagtagaacagctatttacatagcatttacattgtattaggtattacaaataatctagagatgacagtatatgggaggatgtgcatagattatgtacaaatattatgccatttgtatcagggacttgagcattcgtagattttagtatctgtgggaggtcatagaatcaatccttcactgatactaagggatgactgtagtttatacataaactatacatacctgctgtgaaagccctgaagttgatttctgtttatagttaatgcaaaactagctctttattaattccattttgtacatctgcaaaaaggcattttcttgaataatttatctcttggattacctttccagacttcttttaaatatctcacggtaagtaatattgtttttaagcttaaaaatcctcgacgttgctaaactttcaagattttttttttttaatcttaaatgcttataggagttggagggaaaactaatgatgtagatccctgtttttctgctaatgggaattaattagtactattcattacgattgaaattggcattctctgtgctattccagacagttatgataaaaatcagctcaactatacaaggaactattttattccatgctttgaaccagctcctcttagcacccaagcccattcattatttttatctaattaggccaacttacattggagagatacctgaagcaaggaaatttccttaatagctatgcaataacaatagctcacaggcacttaaacaatacagttgtctaagattgaatcatcagaagaaggggaaaaaaagttatccttaaccatagggtaaaaatgtagtcataaatagacaaccatcattatttaaatggcataaatatacaatattagttatcaatagtataatgtttatagatgtgaattttgtatgcttatttgtggaaaattgttaaatttatttttatgttgaaatttgtagtcacatttgaaagttgactgtattctgtacacaaaaatgcaaacatgcttcctaggaaaaaatagaaattttgcatatgattacacagcaaatattttctaaaactagggcaaagtcttaattcccaggacaactccttatcttaaaaacaaattattttatatgacacttttactctcacttgtctgttgaaatgagaaaataaaagta

SEQ ID NO: 112520 - DNA, 1048 bp, Homo sapiens
cagctagtaatggtacaatcagaaatctcagaatttgtttagaaaagtctttttaaaatgtcagcctctctacattgtgctaacggaattcccaagaatatttattattattattattattaaaagaataacctacatctaggaggcagcatgaaggtggtgatgatagttcaagtgaacccagtttgagagatgaagctcaagggactaagaggaggctgttggtccatttgtctcttactcctggagggttaaatgttagttgtgtttagtttcaacaaaggagatgcccttaccaactggatcctccttaaacagactgagctacttgagggcatcaactgttcatgtttgtaacttttatgcctagctgagtcaccagcaaaaagaaggcagagatttaatgaatactgaaatgaaataatgaatgaattgtagggaaaaatagtatgggaggtaactggagttataaactataatattgaatgtgaccaccatgagtcatcaaaggaggaaaataatttaaaatttttaattatccctaagatctgatttttacaaatttttaccaaaattagaatatctgtaaatatccatgtggacttaaacaaaaaattgacttttttgattaatataatacaatgatactcattttttaatggaatagctagtgaaatacaatacagtaccttagttcctcaaagccaatgtttcaagataattcagtcttatataattgtgacctaaagcaataaaacattggtagttatttcgcagtcctctttagtaggctggctcactggatctgagaaacagtgcaaagacaggaaacctatgtgttctctaccttcgcaatgtttagaagaccagtccaaaaaactgtgtcttatgcagcttagtaatttggtcagttaatgacatgaacatttggctaagatttgagaaaaaaaaaataggcaaaaaaaaaaaaaaaaaaagagagaattcaagtataaaatacagtgaattccaagttagtaagggctgcctcaaggacaagagagaaagc

SEQ ID NO: 112521 - DNA, 2213 bp, Homo sapiens
cccagcctcccgggttcaagtaattctgctgcttcagcctcccaagtagctgggattataggagcccgccaccatatctggctaatttttgtatttttagtaaatatgaagtttcaccatattggccaggctggtctcgaactcctgacctcaagtgatccagccgcctcagcctcccaaagtgccaggattataggcttcagccaccactcggactcaatatgcttttaaatgtaattttctaaaaacagcttttggagagaacagaggcatcaatactgttacagtctattagttatctggccctatggacattagtaagtaacattctagagtatgagtgtcagagaccagtggtttgtctattaaaatagtagaattatcttacttgataattcttgagaaggctgtgactcagtttactaaatttactatatttattaaatataaagcaatgtttggctccttgattctgcacacctttatttgactctgcctgttttctttcacataaggactacagcattttttactgactcctccttgaccatcatttttttcataatataataaaaacctggcatttccgtgaagttgacttactggcttgtattgctatttacttctgggatgtagtaatatagggatatactatggaaagaaacttaacaaaaaacagagaaaattatctgtagttgtcaagggctcattaacctttctgtgccttaaatcgaagccacatttttgtgtctgtgtagcttgtcatcctcaataaaatctgcttgaatttgaaaattctatttctagagctgctttttatttgctcattactgacatccctcatttactcttctcagggagggactggatattggtgggtctccccacctcaactctcccgaagggagaaaattccctaggtgttttgagtgacacagcaacacattctttggctttgttgtcaaattggaagtgtgtgaatcctcagtccctcaggccagatttcaagtgttttcccaaaggaacttctcatatggaaaatagtcagtcttcctttgcataatttttatacctaataaatgattcagattggggctgtcagccgtatggtgggcaccctaactgaaggaggcatatgagtggcagattataataataggttatatattttggtcatcagcctgaaatcctaaatgaatatattctaactcatttagtttctccccaaagctttgtaaggatattcttagcatttaattatatcaaacaaaactatagtttatttggagtcagttatttgttctgggttaattaacacatctgatttaaaagtgataaacacttaaaataaatggaaaatgattcctgggtagataggtctaagtggatgcagttttgtacctgacctggttcatgtgtctgacctattactacttcaaggaatgtagtagcaggtgttgatatttttccaaacggcagattggtcatgtttggtgggatatgcttagtgcagtgtgaaattgacatttcagagctccaggttgctatttacagtgactggtttctattgatgaactttttgcttcttttatttacagacccacataagcttttaaaagttgattctcagttttaaattgattcatgcttttctttcagataaggtagtttgaatttccctgaatagttttattcttgagtataatatcttttgggggatggtgttcatttcactctttcctacatgtttctgaataaaataaatttagattttgaaaggtcagttagtccagctgctttcaatttgaagagacttaattctccccagacaagcacaatgtatctcacttaaaaaatatattttagagataagtagcttaagaataactgtacctattgaatacctagcatgatatctccctcatttacctaataaacaagacacacattaggaaccaacatcaaaatgtttttgtaccatatgaaagctgtcacagtttctctttttattgtaaatggctcatcaacttggaaatttcacataagtagatcagaatttaagagtgcagaggatattagtatcctcctagaaatttgtctgttatgaacccctttattatttcatatttccaccatgaaagatatctctataaggatgaagcaaagcagaaataagtaaaaaggcaaaggaaataactatacttaaggatatg

SEQ ID NO: 112522 - DNA, 1017 bp, Homo sapiens
tctcatgaagcattttgatccttattaatcttacataataatgttttcttattcatgtacttgaaatataacagtaaaagcacatcttaactgtataagtctgaaaaaggcaaaactatggagacagtgaaaagatcagtggttgccggactactgggaggaggtagagatgaacaggtggagcacagaggatatttagggcaatgaacatccccgtacgatactacaatggtagatatatgtcattatatatttgtccaaacccatagaatgtataccactaagaatgaaccctaatataaactctggactttgagttatgatgtgtcaatgtaggttcatcactattaacaaaggtaccactgtggttcatgatgctgacaatgagaaaggctgtcaaggggaggggagcaagagttaggtggatatatagcaaatttctacagcttctgcttaattttattatgaacctaaaactgctctaaaaaataaagtctataacacactcacatgttttaatatttttggtgttttttttttctgaactgcccaagggtttaacaactctgtggcctataaaatgtcttctattcaacatatcctcaccaagaaagtatattcatatatgaaataaacttactggagtcttttgcatttccaaaatttgagctggatttttctttttatttctaccacgtttgtttttactttttattatttctgcttttatctatctatctatttatctatctatctatctatctatctatctatctatctatctatctatctatctatgagacagagtctcactctgtcgcccaggctggagtgcagtggcgggctcagctcactgcaacctccgcctcccgggttcaagtgattttcctgcctcagcctcctgagtagctgggattacaggcacccgccaccacacccagctaattttttgtatttttggtagagtcagggtttcaccatgttggccaggctggtctcaaactcctgacctcaggt

SEQ ID NO: 112523 - DNA, 1042 bp, Homo sapiens
ctctataacctgagggcattattataatgctatattatttataattgatactcataaatatgacacagtcattaagaaaagatgaaattatgttcaagttttttaaagaaggctaggaaacatgtaactgacaagaaatttcaaagttgtaaaaaatgttttgggttatttgtaatagcagaaaaaattgaaatatcccaaatgactatccacaggagaatggacaaattatatcatagctctaaaatggaatactaagagtagtgaaaaaaaaaatgcaactccatgtgtcaacatggatgcaacttgaaaacataatgttgtatgaaaaatgcaagaattatacatataattccatttatatgaagtttaggaaacttcaaatctgaatgatatattattagaaatacatatctatgtggtaaaactcaaaagaaaaccaacagaatggtaaacacaaaattcagtatagtggttatttcagggctgggaaaggtgagggagatacagttggttagggatatgtacataggacttcaaaaatactactaattttttgtttttgtaaagctggataatggatacttcagtagtttttatcatcaccattattatttataactcatgtagtttaaaatgtatttctatttatgaaccaaaaaaactggttcttaagagtatattttagttatctggtagtatttagttatcagaaattttccaaaaatgtcagattggtgattcattattgttattattacaatgtaaaacataaacagatggctatatcaggaagcttgcttttaaaataatattcatttatttaaataaagaaacttttctattaaatagagtttggataacagtatttattagatagtttttatgaaaaggaattattcaaaatagaataatcccctaaattatagtatgtcttctaaaaattctggtgctttgggttagtgaagagtaaatttcagtaacaaaacattgtgttaaattttagagaaagcgtcacctaattcagaggatttatatgtca

SEQ ID NO: 112524 - DNA, 1049 bp, Homo sapiens
tgcattataacccataattaataatctaatgcagattgacatccatgaataagaaaaaatctattacttttcatttcttgtttatgaataaaaggattcagcttcccttttattaaaactcgagaaggcacatctattttgaaaggttttctaatatatttttcattgagaattttttaatacacaattatttttaatttcatctgtcattttgggagggaatagaatgtaagattctgtttggtttttattgttttttaacaggtggtttgggaacagagtatactctgatgccttgtatcaggatcgctcttttatgcaaaatgctttacttttcctggaaactaatctccttaaaagctaatacccaaatcaaacaatgtacccttttcagtgctgaataaaaatgggtcaggaagggattaaaaaactggcattgcactaaagtgaggcaatgaaagttttacttttcaagctccccttgttatatgagaatttataaattaccagtaatttagcctccattcttctgcctcttcttctttccctccccctatgtaagccattattgttattacatgtatgaaacactgtttttttaagaaattttcccattacatctgttagaaatttagaatgtcaatcagcattgaatccagtttgcatcatctgtatatttaatcagtgaaaaaacttaggctgattttgcattatatttactacttcagtttctgcctgtgtccctttttcattcatctcctttttccttagtgtctgatgatcaacactgtgtccttaataggtgtcaagtttactgaagtgtttgattcaataaacatatctgaaaatctaggtacaaagacttgtaacagttggtatagagttgaataaatataagagtttgcagtcttattgaaaatccctcaaaataagactaacttagatatctccagtacaaatgaaaataggtatctgactgtggagagagtatctaaactttttgagcttcttttattcatatggaaaatggaggacaaatgcagaccttt

SEQ ID NO: 112525 - DNA, 1828 bp, Homo sapiens
caataattttgtgattgagtaggaggaagagagctcacagagtaaaattctgagaagcagagtcagggatgtaatattttttcttcccttattaatatttctggaagtttagaaaggttgaaaccaaaaatgagtaatcttgtctagaataaagtcaggaaagcctttcacaccaagtatagtctaacaggtttttcaaacggattttttcttacagacaagcataagaacaaaataagaactaggaatgatagtgatgaaagtgacttaattcttttcatttttttccattcaaaccatcttctctgcctagattatcactggagtctcctaactggtttctctgccctctggccttgttgccaccaatccataccatacattacagactactaaaacttcttttatcataattgcatgatctggtttcagtttacctctccagcctcattttcaccctttacaccctgtccccccatcactactatcaccatgacacacattgtgccctggaaattgcgtaccaattttctcagttcttcaaacatgccatattctttctcatcttgggccttcatgtgtttctctccctaaaatacccttccattccccccaaaccgatttgtattcattttttaggcctcagttaatatgttacttccccatgaaaatagtcatcaagtttgaatgctcccattaacattgtttgtctttcatttaacgcttatcacactgtattattattatttttgatgttttgtttttggtttttttgtttgcttggttggttgattggttggttggttggttggttggttggttggtttgtttgtttgtttgagacagattctccctgcgatgcccaggctggagtacagtggtgcgatctcagctcactataacctctgcttcctgggttcaagggattctcctgcctctgcctcccgaataactgggactacagatgcacactactatgcccggctaatttttgtatttttagtagagacggggtttcaccatattggccaggctaatctcgagttcctgacctcaagtgatccgcttgcctcggcctcccaaagtgttgggattacaggcgtgagccaccacgcccggcccacgctgtattattattgcttgtttcacttatatcactatgcttcaaagctatatcactatagttcaaagacctttcatttttcctttctgtaccagattatgtgacatacttcctgccacagaatagaggctcaatataatacgttctacattattaaagctatgaaatatagtgataatgctttgcctaatgtctgaattatgttactaaatatactattgttttctgggtaaaatctaggttacattaatagaaaacaaggaattatcattaattcgtgctaagaagagaagtgatgaactgggtttaagcaacatttggttcattcaagcaaatatggaatattttactgggatgtttaatattggagtaagtaatcaagtaatttcaatttctttaattagctaaataagaaaaattacatgccttagagtaaataaaaaagataattttgtgttctttgccaaacaaatttataattttgtatacttatattatctatgaaatatagcatattaatgaatattattatattcatagcacttcatcattacataacagagataacattggctcctctatcagaccagaactttattttcttcactacagaatccccagtagcaagtgctgaaaactggttaataattgaataattgattctgatgaacatgacttgccttggtttattctgcatttttagaa

SEQ ID NO: 112526 - DNA, 1003 bp, Homo sapiens
aaattgttattatttgatattatgaaaaatccctaagatatgtaattctgcctgatcattaaaccccagggttttattattttttgtagactttgagttttatgaacatgttagtgttgctgctatttcttatatttgctttaaataattttttttctgattttgataggaatatacattttgatagtaatacagaaaaatacatagtaatataaagaagaaataacctatatgcctactatcaagtgataaatactatcaaaaatctttagttttttatatttatgcacgcatataaatgcatattttacacatatgtgaacattgttaagaccatactacatagatcctgcattgactgaatactgttaaaaatcttttacctactttttaatcatacttttttttctcattgttataatgcaattattactatgatggatattttatgcatcctttaagaattttgatgcatttgccaaaccactttccaggaaggttcttactgacatcctttctaattacatatgttcatataaacatgtggttgtctaggtagaacttttatcaacttaactaattcagaccttttatagtatttctgatttttacccagtgaaatttatttcttaaatattgactactgcaaatttgggggtttattgtaatttttttccaacctaaaaaatatgctattcgtttcctttgcagacacgatctacagtttacttctctttttataagcctggctgttaataaggaaattcaggaaaatgtagacatgtaatctagaaaattcaaattaaaaaatacctgtgcagctttaactttacataaatgttgaggtaaagtttagcgcttctcccatgaaacaagccattaaaccagtccagatattaccagtacaccagacagaatggtagcaagtaaatgtggactgctacccatttatttacctcacaaagcatggaatttccagcctatgtctgttccatccgtctct

SEQ ID NO: 112527 - DNA, 1702 bp, Homo sapiens
ccagcctggccaacatggtgaaaccccgtttctattgaaaaaaaaatacaaaaaatacaaaaaattagccagatgtggtggcatgtgcctgtagtcccaactacacggaggctgaggcatgagaatcactgggagtctgggagacgaaggttgcagtgagccaagattgcgccactgcactccagcctgggcgacggcgagactgtctcaaaacaaaacaaaaaaatacagtgtacttgaagggaagaaattattaagtaccatcttctgaaagtttacttttttcaaaaatactatttgtgcagtactttattcagttaaacaatgttgaactccagaaaaatgaggtagtttttttggtggttgtttttataactttgaagcagaagataaaaataaacccacattctattgctttttcttttaggaacacatgattctgtgcagatttgcagaccagacagctgtccagctcccaccccaacgaaggctcataggtatgtgttttcacagagcagctgttgagtgtattatgcacaatatgactgggaatgattggaccaagtctatatgggaaaaatttagcaacatgaagtctatttttcaatgagaaactaaatatgttcttcccaaaaaaacttaattcatattgaaaagggtattgtaactataacattttatcctattttggttaactttaatacttttaaatgtattttgaatgtttgtacattgagtagaattcttacattaaatctcttactgttatgaacaaactgcaagatctatcaaaagccataaaagaaaataataaagattaaaaagtcaactatatataccaaaattgatgcattataaaatgtatacacagggatgataatgttttctttctcaggaaaaaggatacttgtgtattatttatcatagatgaatttgtttgacaatattaaatattacctaaattggaagaccacagaaacatttcaagtttaataagtaattgatttattgaagacatcactttagaaaaaacaatcacatttaaaagaataatagcagttaatagttatacatttaagcactgagctaaatgctcttgactgttatcttggtaaattcttacaaatatacatatggggtaggtactattatttacattttaatgataagaaaactgagacaaaagctttcctggggtccctcatctggtagatgatggagctatactatgaacccaacttatttgattctggacatgaagttcttgtccaccttagttactgcttcccagcatactggtgtcatatcagggtttaagataagtgggttcagtcaaaactaatcttaaaattattcagagaaacccaacattggacaccattatattttttctctaaatttacaatgtagccccttttcctccatgatatactagaaaacagattgttgtttctttggctgagcaccagatgaagctgttagcttacattcagagaccaagtcgtatgagaaatccttatctttaaactctaaaatcaaaggcagcatagcaagatgctcacacttggagacctgagacctgagactcaaggagtaagtgattccttctctttctcactctctgcagcataaacatttggaaagaactcattctctcttgcctgcaacctctttgtctttcaatgcctttccttcttgctcc

SEQ ID NO: 112528 - DNA, 1017 bp, Homo sapiens
agcaatccaatgaagacataattagtatggtggatggatgggtacatggtagatgtgtgttttaggtatcaaactaaaggggagtatctggcagggaagttgctagagtggtgggggtgggggtgggcatttggcaatgggaagaacggggggaatcacattgagagaaagctgtcacgtctacatctctgctttacacaggccattcctccccaggcccacaaaggtagactatcagcagctaaatttcagttgtagagacacttcaacatgtgaaaacatgaaattcttctacataatggaaaaggaaaaattaactggactgggatcaaagccaagggtagatgagctcaatgtaaaccctgggtgggtacttaaggaatgtagagcatcccattctgacacagaatgtttcattttaagctaaaaagtagatgggagaaacatttacagatgtcttaaaggaaagacaatattttaagggaaaaaaaagaatgtcggccataaggctgttaatgaagaagggatgattttgcctaaatggaattctggacatctctttttatatcatttctaacccagtttattctttgtgggatgggctcttttaaggaaaatgtacaaaataaacattttaaatgtgagtctctcattgctaattcttacctactgatttcaccttccactgtttttttctgtgaggattctgttgttcatagaacttttctattttggtgatctgtcttcatttctgaagttgttttagtttatcagtttccactgtcattcaatgtttagccattattataattgtttaggaaaaatataatgaagttctgcatagtcagtaatctttttccagggggttgaagaagcttatatattgaatttaaagcaattgaaagtataaaagtaaatcatggctttgaatatattcagccccaaatcatttttcccaagctacttttgaagtttgtgtttgccaaaggaaaacaaattaactgcttttcttgccag

SEQ ID NO: 112529 - DNA, 1054 bp, Homo sapiens
tatcccatagaaggtgtgtttgtaggtagggaaaggtggtggtaccctcattatattatttaacagaccttatgccttagtgcagtgaccctttggtgagtgtttattccgtttggttgagcatttgtgagatgtttgacttaatattcatgtgagtcaaatgtacgtatctgtacaaaacatgctgcccttcattttcacttgctatcttcctatccatggtcttgtttggagaaaccgactaatgttgcaggatgctaaagctggtagacctctccttctggctcactatgtctaagcagagccagatatagctgggaaactttatatccttccctctaggactcaggaaggaaggatcagagatgctactcaaatgggcatagaacctgtcctgctgcttcctgcctgtaccacccaacattctatcccaacattcctgcctgctagggaaagcatgacccgttccagaaataggcaggttgtgttttcatagttcttttgtaggtcatacccttggttgttttttttttttttttttttgattctttgttttgtgttcttgactcttaaacagatctctagcatattgaaaattcaacatttgattttctaactgtcatgggctttacttttattgactattgatgtggctgtttattgtcaggtgaaaattttttaatatgttcacacactgatgattgcatatttgcagcacacagcatcttaaaccactcagaggtttgtcacaaaatgtgtgtttcttgctctgtaatttttttgtcattttgatggcatattttaattatgcttttatttctctccttctaccaagtggagacctctgtaacaaagatttttcagggttgcatatttcatctttaaaagctgtgtacactgtggaaacaattgttaaccaaaagcactagataatttaggataactgagttcaagttctgacttttgtacctgaataggtgtctaacatttctcagctacagttttcttattacacaagcatatttccaaggtatgttgaagctctaaactgcaa

SEQ ID NO: 112530 - DNA, 1048 bp, Homo sapiens
acaacttattatacagtggtggcagcaatcataacattaaattaattttgtctttcaaattctgagaaaaaacatgaggttggagatgtcttctgtatatcctctaaaaattttgcctctttttttttccagtttgcagctcaccttgtgaagatgaaatatccaagaatctgtattctagatggtggcattaataaaataaagccaacaggcctcctcaccatcccatctcctcaaatatgaagaaccaagagtgtgactgccaaaacttagtgtggcatcagcaccaacagcacagttcttcatatccacgccactctcagacaaaactagatgtccagattgttgcatttccgtaaagtttgtcacgagacattttttaaaatctcataacccacatgttcagttatccatgcaagaaacttgactctacatgtattgctgaaagaattttcttaacagtgaaatctgatcatatatttttaccacactgccacataaagcccaagaaattcagctgacaagacagatttagcattatcaagaaatcccatttgccctgaaaaagctgtcctccattgtactgaacagacagtcctgtcgattgtgttatttagaaacatacactgaatgtgggctgaaatcatcatctttccataatgaaaactgagaaactattcacaatgcattccttataaataaatgctacatttagtaactcatttcacccaaacaagggggatgtgtgtgtgtgtgtgtgtataggaagtggagtttatcccattgcagaaagtggtaatacttactcccagaaaaatgaaatttagaaaccatttatatttgatagaatatttggtcagttcctgtagcaaagacgaatggcttaaacaaattttctagtttctttatcacatgaaagtctgtacagtcagtccagggctagtctactggtttcctgatcattaagaactcattaccttctctcattgctttacaaacctcaatatgtggcatccatctcatggatgaaaatggctcctcagcttct

SEQ ID NO: 112531 - DNA, 1002 bp, Homo sapiens
attcagcatatgtgttgtccctgtattaaacttctctagctccagatagtatctatctagttcttcagattaatatgatacttctagaacttctaaacgtgtcatgggtctttttacctgttctaaaatttattagacctctttataccttaagcatttagttaaagaatgagaagtgaatatcctttatcagcttcaagtatgcaaggaattctttcttgatcttgttatacctataagcactggctatggttaaacttggctttcttcctgacatttttcttgccttgctcgtcagcaaatgttttagtctgtaggtttatattagattataagaaaatagtttatatattaatgcaccttgaacatgctggacatcatataaaagttgggagtaacagtggaaactcttctacataactctgatttgttaagtgataaaagattacttcgaaagactcatgaactaaaaactcctgttgagtccttattcttatagcttttcataagttttgtgtagtaaaaagcaaagtagtagtgaagagggccttaatacacctaatccagacattggttttcttggttttttaacatgtttactagaaatattatatggtaaaatataagcagtttttaaaaagagagagcaagcttttttccaatttccaggaaaaactgcaaagtcatcatcttaatcttgtgatctttggcactcacatttgtgacctgacacaggatgaaagttatcttgtctcaatatgtgttattctacatacccaccctgtactccacagcccaccatttaattactccttaccacaggaatgtctgtggctgaataagaaactaaccatagttgccctcccatttgacccacagaggttggaacttggctgtgatccatcatagtcctaactgttttttgaatctcagtttttattgtatacattcttttcagggcatagcgtactttgtgtaatatgaccagtggcttgaacacag

SEQ ID NO: 112532 - DNA, 1441 bp, Homo sapiens
ccatatatcagtaatgtattgcatttcctatttatttctcatttcattgtaggtattaaacaacagaaatgatagatgcttaggaaaatgtgccagtaattgcatgcacatataccagagttgaaaggctgggtgaattatatctggagcccggtaacatattgtaccatccttttctccttagacattaactaagaagattgtgttttaaaattatattcatttatttaaatatctgttgacttctaggagtgggtgtatctatatatataaaacacatgtatctctatatatgtatacgactagtcttattggtggtttattatttctttgtaccagaacagaatattcatgcataattatttaaagatgatccagtggtaatctgtaagtgtgactgatacttctaacttgggttatcttaattattaatacatagggtattactcccttgtcctggtaagtcacttgactgccttgtgtattagttctctaatattttcagttagataattcaacttcccttttagaatttctctatagaatctccagtggaatgtttagtgtatggaagtattccttatattttaatcaaggtgggtaatgggaacatattaggaaatgagtgagcatggtactgacaaagatagtgagttaagttttagatacatgcttaagatattacggggcagctagatttagaagctgaggcactgttagagatttttagtgacaaaatgacaagtataatttcaagatcttacttgtcagagtctaaagtttcctgtagtcagttaggctttggtgaagccctagtaagttaggctgtcataaaaatatttcacttattagggagaattataatgctcttggcatatttagaatggctctttttttcctcaatacctgctaggagcataaagggattttttgtgatcttgatgatgtttgaagcatgaatcagctaaatacatgagaaggatcataacaaggacaaataatgcaaaaatgttgtatagattactaatggtgtcagtgagactaaactgcagtaagtgggacttgtgaaaaatactatgtttggaacaaaaaagcaaagcaagattgtaattacttttggaaaacatccaataatgtttagcaataagaaaactcaccaactttctttagtgtttttgagatgtgaagcatacaaattgtgtgaactgctggtcaggaaattgtgtccactttctatgagacctatgtaagtttactcactgattacatgtttaataaatactatatgacaggcacagtattatgcactggggccataaaaataaataagacatagtgtagctctgtagtaggatggagagaaagcattggcagcttagaaaatagtataaggataacacagatatgtgaggctcatggctgtcttattgtaaataggatg

SEQ ID NO: 112533 - DNA, 1048 bp, Homo sapiens
ggggaaaatttaaaaacagatattacaatacatcacctccaagctaataaatggtcatgaaaatagcagccaggagcatgactgatgaagactctgaaattgtaacgtgattctaggaagctgaaagaattcacataacactaacctaattgttgctcttgaagcatacaactaattttgcaacatgtaaatactttataaagtttaaaagaaatatttcgtacgtattgggaactgtaatgaaaaataatgttagaggtgatcagaatttttacttatcttgaaaatttagagtagatctgagttcttatacatcttaaacctggtcccaaattgtcaagaatctgataggaaggcctttctctatagcagagctgcttgttttatggttgataagggtttctggtttgtgaaaggattcctgctttctgaattttttgagcagtccaaaaattatcttatagtttagatcagtgttattaagcatattttgtttcaagataccaatgatggcattaggtttatatttgctttactattgaatgtttatatgtgccttagatttgcaaaacaaaatatatagagcatttttcacttttgaagtagattaaaagtaattaacctcaaaaacctttaaaagtcagaaactgtttaaaatatccctacatatactgctgatagatattgcaataagaatgtaaggaccaaaatgtattaaatttaagagagagatttaaggcatcaaaagaatataccttgaaataataagagccatctgtgagaaaccaacagccagcatgaggctgaatgggcaaaaactggatgcatattccccttgagaatttaaacaagacaagtatgcccactctcaccactcctattccacatagtactggaagtcctagttacaacagtcaggcaagataaagaaattaaaggcatccgaataggaagaaaagaaatcaaactgtctcttttcacaagtggtatgattttatgcctagaaatccccatagcctctgctcaagagctcctagatttgatgaaa

SEQ ID NO: 112534 - DNA, 1033 bp, Homo sapiens
aaaggaagttacaaaaaataggaagttgctcataggatttttggtgggaatttattaaaacagttgtttagagaatataatagatacgttattttactgtacctaaaacaacactaaagttcatctagataaatctgtgagaataatataactggaaagttctgggaagaaatattatgaatggttaatagggttaaaaatattatctgtttgattatcaattttttaagatgccttaggaagctataaattttcaaagccaaataaacatttcataaaaagagtttggtagtattagctctgaagtaatagttttgaccataaggtaataattatagaactagtaaagtaagttgttattgttttaattgttattttggttttttaatttatttgtatttttatcgttttacagatgtatttccactacacaaaattttccacctctgggataccttactacttgggaattcctctttcccattctgtattggagtagcaattcttcagcagctgcgggaccggcttttggctaatggctttaatgagtgtattcttctcttctccgatttaccaggtatagatctaaataaatggagccattaaatgaaatttgactatgaaataatgacacattcttaagccattggcaaaaataaccatccaggccttcagcatctcttctgtttgggcctcatcatcctctctggattctttctctcatatactgcttcttctgctgacccagcattgtaaatacaaatctgggtcatacccgctcactgtgatttacttccatcttggtaatgctactaaatgggtaaaatgccaggaagttgggggcaatatcatatttgctcttttgcttaggacaggggctgtttctcttcagtgatggaaagtatagaaaggccacttgggaaggtgtttaagaatctgtgtttataaaaagatacaattcacaaaactttgttgcctcccagccaaagctgcttgctaacaattttacgatttgacaaaaggaaatactgcc

SEQ ID NO: 112535 - DNA, 1054 bp, Homo sapiens
tgacctcatattctagagtaaatagacaataatgaagataaatatattatatggtaggtagtggtaagttctaatttaaaaaaaaaagctaaagcagaggtatggatgttatgtgctcaggtaaagaagagattgaattttcattatttatttctgagacagggtcttgctctgtcacctaggctggagtgcagtggtgtgattatggctcattgcagtctcaacctcttgggctcaagtaatcctccctcctcagcctcccaagtagctgggaccacaggcatgcgccaccagacccatctactttttaaattttttgtagacatgaggtctccctatgttacccaggctggtcttggattcttggctcaagcagtcctcccgctttggcctcccaaagtgctgagattgtgggaatgagccactgcacctggccatgaattttgaaataagtaaggtaaccaagaaaacctcacagaaaagttgacttatgaataaatgctttaagaaagcaaaggaaagagcaaaccaagcgaaagcagcagcagttgctacagccctgatgtggaagcatatcagagatgtggaggagcagccagtagaccattgtaactagagcacagtgaacaagaagataaggtcaaataggtaatagagggccatattacatagttttgttgatcatcattaggactttggcttttattgttagaggtggaaagccactgatgcttttgagcagaggagtgatgtctcatgtaaagattttaacaaggtcattctggctgctatgctgagaaaaatcgaaggatgggcaagaatggaatctaggaaactagtcatggactattgcaatagtctaggcaagagataatgttggctcgaatcaagatattagcagtggaagtagtgggaagtttttatatgctgcatatcttttgaaggtagagccagcaggactactggtgacaaatatacagtgtgtgaggaagagaggagtcaagtacctgagcaattgaaaggggatagagttgcttctaactgagatttggaa

SEQ ID NO: 112536 - DNA, 1046 bp, Homo sapiens
tgtcaataatttagtactatttgttcaaatattaaaagctaaaaactttaaaaatttaacaaataacaaggcagacattattttttgaagattattttcaccaaataatcggttttaaaaatagatgttactttactgtaggagaaagttgtgattatgaagggaaaagttttatgatgttattgtcatttcaatttcaaaaaaatgaggttgtcacctgtaatctcagcactttgggtggccaatacaggaggattgcttgagcccaggagtttgagaccagcctagacaacatagcaaaacccagtctatatttaaaaaaaaaaaagttgagctcattgaaatatgtattaatcttggttttttaattagtaaaaatataatagttacttgcccttgagtagattgttagcactatcttgtttagattagtgcatagtgagtaaactggcaagaatagtaactttggaagaatgaaaaaaatgaacatattcctcatatttcaactgaactctatgaattctaatagaattagaatcaacaaaatatatttttaattgcctaccgtatctctactttctgattaaacatggtattcttatgtctttttttatacttttaatttttatttttatttattttttatttttttatttttttattattatactttaagttttagggtacatgtgcacattgtgcgggttagttacatacgtatacatgtgccatgctggtgtgctgcacccactaactcgtcatctagcattaggtatatctcccagtgctatccctcccccctccccccaccccacaacaggccccagagtgtgatgttccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattatttatggctgcatagtattccatggtgtatatgtgccacattttcttaatccagtct

SEQ ID NO: 112537 - DNA, 1002 bp, Homo sapiens
ggggcagaggtgatgggtggacaaagttatatatacataaatatgtatggatgacaggggtgtagagataggagttttacttttcaatttgtatcttttttatagcattaacattcttactactaaaaataaatacttttttaaaagataaaatgcactttaaatattaattcagcgttaagggaagataggcaataagaaggaaggaaaaacacttggaagcctagaggactgtgttaaaaacacagagagaagcaaataaaggagctaatgctggagggagacatgaaggttttaaaactatttcagacttgtgtatattttctcttgattccttgacattaaagttctgtattatgatggttagtttagaatgctttctagcaacagttgttaatttaattgcatgagacttttacatagatcttaccacattgattgtaaaaatgtactatcgcttctttccctgttgtaatttttcattattttaatgtatcattacaggtatccctcgtacttggcccctgaggtaattgcacagggaattttcaaaaccactgatcacatgccaagtaaaaaaccattgccttctggccccaaatcagatgtatggtctcttggaatcattttatttgagctttgtgtggtatgtataaagaaatattaatataataaaaggaaattgtgcatttattggaataatcttttggagaggaaagttaataatagtatgtttttgctgtacaaattaattacatatgaggagaaaaggcttaatttgacttaatcatgtttgataatttcacatattttttggcatctctggaaacatacttttactaagtgtgaatgtaaatgttaccagatatatattattttgatatctctataatgtgtatatttttacaaagttaagatgtttatattaagttatataagatatatggagtaccattaaaagtttaacaagatattgaaatgaaaactacgtttttagaagat

SEQ ID NO: 112538 - DNA, 1036 bp, Homo sapiens
tgttttatgtttaattcccttttctctaagatatatattaagattcaagttgagtcattgtggatattagagatagagataaattccatacctgaaagtctatgtttaagttcagaaaggtttatttaatcacttctgttatggaattgcagatgtatgttgccctccacaaaagaaatggaaggttgtttcatgcatattcaagtagatgtttttgatacggatttctgtgttatatttgtgtggttgcttttagacattttcattattattttcttttctgaagattaagttgagattgttttagataaaatagttacaaaaatagtataaagaattcctctctacccttcatcagtttctccaaatgttaacatttcactacatttgctttttctctgttttttctccgagcatatatgtgtgtatgtgtataatgattgttttttataatcacttaagagtaattaattacataatagcactttaacctgtaagtacttcagtttgtattttctaaaagaaggactttgtttttttacatgacctcagaacagttgtcaaaacaaggaaactaaacttgatgcagtattattatctaacctagagacattaatcatattttttcaattgtaatgtgactgtttttgatagtatccatttgtgttttcctctttgggcttcctaaaatcagttctatcacaccgttactgagaattgtgatatggagtcatggagtgtgtttttcaaacagaatgttactcaaaaacttaatttgattttttttttaaagccagcctcatatataacttgcccttttttctttataactcaaattacaggtttcttaactaaattttttaagtttatgactgtgtcttattattaagacatagataataatcttaaactttattcagtgaggaaacatttattgagcaatttctcttatgcctgttggttttacaaaaataaataagatagctttctgtcctcaagaagctcattgtttagtgggagaattttctgttttgat

SEQ ID NO: 112539 - DNA, 1194 bp, Homo sapiens
gtgtaataataaaaattaaaacatgttccaaatcctacttactactgctaagtagcagtatttacccaaatacagtacctgtttcctgataatttgcatgagtagacttgcaaattggaaaaaaaattagggagatggttggtgagagagacaaggagggaaaaggagaaggaaactggaggatatctgtgtgaaggatggcttgtagaggataggataagaattaaagagaaaagtttgctaaatcataaatgaccagagattgctttataggttgaatatggaaaataagctagtgtttgtataccataaaatatattgttactacttttttcgggggcttaggtattttgtattgagcaaaatagtttttagtgacttagttctgccatatacttgaaacttaacctgataatttggcgaagccaaacctgctataggttagttgcactcaccaccaaaattaaagccctttcgtggaagaaccaaatactgctattacagtagcctttaggaaactgtaggatctttgtcagattaattctgttataatcagaaaacctaaaatatgtagaggtagatattttagaaaatatatagattctattttctcagaataaaagaggagcaataaaaatataactttttgaatattttcactaggtcacatttcacttgttaaaacaagttatttatttgctttgtaattgatctttgactttttgttttctttgtagctgttcaacggttttgtgtatagcatttgaggttcttcagggcttgcagtatatgaacaaacatggtatagtacacagggcattgtctcctcataatatcctgttggaccgaaaggtaattgttaaatcatgtaataaatatttatatatcatttgaaattggaagcaactgggatcagggctactcagtcagaggaacaatagaatcagaatatgttttaagaatattcataatgaaaagtctatatgaaagtgatgtaactgtggtttttgaatttaaggattaaataatccttaaattatttaatctgtatatctttcacatggattatttttcccacaagacccattttctaactttatggtttttttattttactcttatttctaaagccttgtggcgtcccagtatactcctcctcttaatttattttcatttttaagaaaatggctcttt

SEQ ID NO: 112540 - DNA, 1050 bp, Homo sapiens
acctaagtgaatacacagtagaaggatccagtatacagaaatataaaaggaatgaaatcagcaactctttactttggaacacagatgtaatactcattagcatagttacggttattgttattcttatctcttagtgtacctgaagctttctttgaaagctttcaaccttaaatgtggctaaatagcctgttttctgcatttaagaacaaactatatttcctcttctaagtagattcaggaattagtctacttaacatttctgctatttgtttggcttgttgctctccataggaaaactatttttctaagatatttatctattacagtagaaaatgtttttcctttcagactgctttttcatagtggcctatagtataaatttattcctttcacagtgtaatttatcacttttatttttcctataggattttctgccgtctcttggcaaaaatggcaaataatgatgctgttctgaagagactggagcagaagggtgcagaggcagatcaaatcattgaatatcttaagcagcaagtttctctacttaaggagaaagcaagtaagaaaatttaaaattttttgaggagatacttaaaatgaattcatacattgatggagaaaaaataatgtttaccgctttaagttatttaagttttacttagaagtttctgttatatgtagaaaaatatcaaacctgaatttctaccttcaggacttcagttggctttggttttgtttgtttaaatgtattttattttcagtagtcaatgtcagaatagaaatttcaaaatcttttgctgtcactagtagaaataaatgctttcctacgttttgtaagctaatggcttacaaaaacctgtatttactctccagaaactttatcaatttttttctaattttaacataccactttgtttctttttttatagtgtttctcgagattttaaaattatttttcttaaaaattcttactctctttttattaaaaagatgaagagattggacatagtcattgctcatatgatataatatatgttgtaaaccaaattt

SEQ ID NO: 112541 - DNA, 1006 bp, Homo sapiens
aagtaaagttcaactttcatgagctaggataaaattaggaacaatatgatattggaacataaaagctgggtcctaaatggtgtgtgaatattgaccagattaacggggtaaaaatgtggcattttaggcagagggactggcataagttaaaacagactgtaaaggttaagtgtagaaacccatatgtagtttggtatggctgaattttggtatctatttgtggtatagtttgagagaagtcacagataggaaactagcttaggaccagttgtgaagataggaaaagaacattccaccagtcaaaacagactgtctgaactaagatttcaagaatccatgagaactaaagtagatagaaatgtcaccatccacttaggcaacaacccttgaaatttagtcatcaaccttaacctgtccctattccctgttcttcatatctaattaaccaacaaattctattattcctgtccccaaaacatacatagaccccagctctgctctttcttttcattaggtcctacctcagttcaggttttcaacgatctttcatctgaattaatattaaagcctcatcttttctagtttatttttagccttgctgctaaagctatttattctaattgtaaatctgacttcctttccccagatatgtctaaaaagttgcctttataaataattatgaatatttctcattatacttaaacttatttactttttttttttttttttggaaaatataacatgcagagggatttatgaactaacccaagccaatttagcctctaaagcacttgccagttcctttggcaaacatcagtaacctctgttagttaaaagtaggtaggggctgtacagcctctgctatacaacttcaccactaggtggtatgattacaatgaaagcaagtcagactaactcttctagtttataaagtacgttaagaagtagacacaaaacaactatataacctgttcttgcaaatttggtggaatccatattctattct

SEQ ID NO: 112542 - DNA, 3452 bp, Homo sapiens
atgaaacttctaactacaggtgctatgtagtttttagagccatgcatatgaccaaggtcataaattacaaactgctgggccaaggaaagaatgcaatcccaaaaagtttcagtttatctttcatagtatttcataaaatacttacacatggaattttacatgaaaatcctgatgtcttgtttcttaaaaattcagaactaagccccacccctacccttcccaaccccctgctattttcttaaggcagaaattggttaacacttagtaatggatagcccctttaggtggaagttagactctttaacacagtttcaaccattccatagttgaggtggaaggtcacttgtgattatttggtatttatctttacttttctgctagtgttatatttacggaaggttaagaagagactcgagtatctttttttaccatgtctcaaaaaaacaagggtgttacttgttttttctgtctaggattccttactcatttcctttacttatttggtagacagttgtatcataattgcatcaaattgcacttttgatccctagcctgggcttttgttttggctctctaatttcagcgttgctggaacacagtacgggtaatggatcaatattgacctatcatcaagagtacaaggaagtgatttcttctacttcctacttaacaagctcatttcttttaggtctccaatgattaattatccgagccagtgaagtttgggttttaagtgtttcataaaagaaattgataggaggttagagtatctccacttttcctttcttctggtgagtttagcaccagggactgtgctttgtgtagcttcagaaaacaaaccatggttacagtttatataatattattccctatttaaaatttaattctttctatagtgaaattagagctgggtatttggaatatgtgaaaagtattgatggtatattttatgaaggataaccttgcatgataaccgttttaaaagcaaattgatactccatgatgatacccttcagagcagtggtttctaactgttgctttttttcttataagctttcaaacctccttctcaacaaaagtttactttcttcctttttctttacttttgaataccatatttactttcttgaagaaatatggtttttaaaaaatctagtaacagtggaaagaatcgaagacagtagcagttttaaatgtcctctttctagatgtcttctatggtggtttgaatcatctacctatttcctctgtcccatggtgcttcagagatattgcaaagaatatggacttcaacattacgatagttctgcctttgtttattgctactctgctgcttgttggttttgtgaacttgaacaaatccctgtgttcattcaattatatttatagctgcaagtatttattaagcaccaagcacctaagtaaaggatacagcaacaaattaaaatacagagatagataaatttcttttttctttttttttttttttggagactcacccaggctggagtgcagtggggcagtctcggctcactgcaaccactgcctgcctcccggattcaagcaattctcctgcctcagcctgccgagtagccaggattacaggcaccaccaccaagcccagctaattttttgtatttttattagagacagggtttcactatgtgggccaggctggtctcaaactcctgacctcaggtgatccgcctgccttggcctcccaaaatgctgatattacaggtgtgagccaccacacacaagcaacaaacatatttttaaaaatagccctgcctttatgaagctcacatttgtataagggagtcagaaatattaccaaggtgtaagtaaatatttagtatgttaaatagtgataagtgccaagagaaaaatagggaaagaatctagtaagtattgaggccaggatgatattgacattttatataaagtgcccagggaagacctcaaaaagaaagtgacatttgagtaaaggtctaagaaaatgaaagcaagtcatgtgtttatctggctgaagagcatttcaggcagtcctgggagaaatggatggctgggatgttcaaggaacagcaggaggccgatatgaatagagcagggttaataactgagaaagtcatgggagatgaaatcagagataagggtgccaaatgtcttatagatcattgtaaagtttggcattttttctgagtaagatgaaagccattgtaggattttagagcaaaagaataacattggtcagcctgacattttaataggatcattctggctgctctgttgatgggaggaagatggaattaaggagatcagtgaagtttctcttatctaggaaaaaagaagtagacttggcatatgcatgtgctttttttactttttaatatttatgttatataggaccagaactgattcataactccttatgaagttaggagccctggagaaaagaaccaactgatcttcagccagcttaaattggaaaaactcctcatttgggcttcatcttttctgttcttataagttgtagactattttttctcttccagcagccatcattcacaaccataagcaaagctatttttataaacatctgtatctaacccatcaagatacaacctaaaataaaagttaaaaaaaaaaagatagtactagtaaacattctataaagtagggacacttagaattcaaaattatatactctgttttgtaggtggtacatttttctagggaaaagtttcatagctatcgtcagatccttaaaggattgcatcttactaatcctgttgctactcttaaacacttttgctgtaacttttaagttctcatatacgtgacattgtcaagttatttgaagcattcgaagagaaatattatttatgaagaccccctaattcatttcgaatttgactcttaggctcatttttttaaatcatagtatttcagagtaaatttgcatataacatttatttataaaaccatcttttatctagaatgcatctttttttctcctttgagcaatagttctcttgtatgattcattttaaacttgttgaaagaatttaaataactatatttcttacttttgctagttggagaaaaaaattaagacacttcaaatatgaagattaaagaaatttccgtttgcttccataaaaaatttgtagaactagccctacatgttagttgcatgatgcatgatgctgaaattgttaaatgatctttttttttttttttttttttttttttttgagacagggtctcactcttgcccaagctggagttcagtggcataatcaaggctcattgcagcctccaggctcaagcgatccttccacctcagcctcccaagtagctgggactatagccacatgccaccatgcccagcgaatttttttattttttgtagagactgggttttgccattttgcccatgctggtctcga

SEQ ID NO: 112543 - DNA, 1085 bp, Homo sapiens
tctcgtttctgaggagaaaatccaaaatgaccataatattcaagaggagcaggttgtaaatctctcttcaaagcaaaaaacaaacaaacaataaaaacaactaaaaaccaccaccaacaaaaaataacattttaaatacctggtagctactagtagttactgaaaggtagcagattgcaaaaccaggacttaaagatagttggcaggaaattcagctccccaaattgcaagagtgttagtttatacttttttagatgtcagttttagtaggaaaaaagataggcagttactactaattattcaatagagttcgtattgtccactgtgtttcctttgaccagattttcaatgattaggacaaggtatgggtcaaatattgcaccatgttttagaagggctaggaaagagagatattcccttcttggtctgattgtcacaaacccagcaacccatagagcatttttggaatgtgcacatgtttaacacctggaattatagtcatacttcatccgtcaccagaatgaaaagccaacggctgactaaaggagaatttctgaggcaattcttctggagctagcaatataccctacttgtcatctctcagatatgagcctttaatcccctcttcctaaaattgtttattttaaaataagagaaaggctagggatgttacaaccgagttctgagctttctcttttaagaatctaatccttcaaacccatcttcagcaaagaaactggcatttcatgtgctgagcagatgatgttctgcagctctggccagcccacatgtacagctgggccggtctgacacacaggtgttctaatttggaccttcttaaaattctgacaccatactctcctccattgggaagtatgacttggctatgctatttgctagtgacaacagttatactgacttaacaaaaacagctccagctaaggtgataacataatcctctggctcagactgagctcagatcgagggtgtgtggtgtgttctaagagtctgggccaacgttttgattttgatttcctcttttatattgtgtattgtcattcatgtttcctcccttcacctctcag

SEQ ID NO: 112544 - DNA, 1028 bp, Homo sapiens
cagttcagtctcagtggaggctttaattgagtccatggagagctctggaaaggcccttcagagatgtccaaagttgcatgggaaataggcattatacctccgtgtttccaggggttggctgcccatgggagggggcatacctttgggtgctgctgctcctttcaacagaagcagtttctgagcggggcgacagctgctggagagcccgctcccttcttgcaggaggcctgagtattgcatcacagcattaaatccagctggtttttagtatttctgtaattcagatcataccgcatatactctttcgtgtctggcttctttcactttacattgtgcttgtgaaactcacctttattgttatgtaattagtggcagattgttcattcttggtgctgtgtggtgtttcgctgtgtgattttacccaatattgttgatggatgtttgggcactttacagatttttgctcttaagaatagcgctggcgtgaaggttttagtgcatgtctttttgtggacattcctgttggctataccagggaggagaattgctaggtccttggatatgtatttgttgagcattagtagattcgaccagtcagttttttgatgtggttgtaccattttacactcccatcagcagtgtattgcctcaccagtacttgagtgtccttttcattttagccattttggtcctttagtgctgattacttagccaagcactctgtaatacttttcctatttcttaaccagcctcaaaaaatctcctcattgaaccagtttcactgaaatggagtcttagtaaatgagttgtagttataaagcattgagaaatagaatataatagtccatattttattgatttcttactgtatttttcagacaatattctgaatgctttacatatgttaactaaatccttataaagattgctagttaatgtataacttatgttataagttatttgttgtaagttttatgttaggttttataacttatgttataaggattaatccttataatactaagagg

SEQ ID NO: 112545 - DNA, 1039 bp, Homo sapiens
ttctgattttcaaaccacagtggtggaagtaaagctgacattctagaataccgtgttgcttgggtaaaaggtggctttcctgacagtggtgataaaggtatatataaaagctggaataaaatggtttcgtgatatggtaaagataataaggatgatggttcaggtggtttttgtttgcttgtttccaaattctttttgttgttacctcttatttgaggccacctctcatttgtagttgcctgactttgacatatgtagtatattttaggaatttattctttcccactagataatgggacattgggcttaattacttcttggatgtgggatactatctgcttgagagtattggttgaggggaacatagcactcacagccttcttttatgctactttttggttttattttgagagattttcttcattaagataccctttggtgaactctaaattcttgaatcaaacatttaaattgtactcctgttgttatataggatattgtacctgtggatgcatcttatgaagtaaaagaactatatgtgccagaaaataaacttcatttggcaaaaacagatgcggaaacattaccagcactgaaaattaataaagtaagttcttcgttgcttttcacactaagtgatacagccttatatacagtagtttgttaaatttgtgacttatagcagtatttgaggccaggggtggtattagctgggggggcaaagatgttgtggtatatgtcacaatttctaaggatggggaatgtgtttaatttgtgcaaccatgttcccaagttaccatggctttgatttgctttgagtaataatacttatttattttgaactatcaaagaacaaatattacatgagatccttaggcttatcagaaataatgggttctaaaaggtcaaggaatactaatccatagtaattaagtaaacattctccccttcagacatgttttctaatcccttgccaaaacttgactctctctgtcttatattgttaagaataattttattgtgtatcttagctctgatg

SEQ ID NO: 112546 - DNA, 1051 bp, Homo sapiens
aaagtgcctgcctcaggattgtgcagaggattctatgagttgatacatgcagagtgcttaaacagttcctggcatgtagcaagcatactctaattactgagtattctttttatgttaagtccattgaaagacagtattgcagggatttgggtcaagttgttgacctctcttaggcctcgatttcctctgtaaagaagggatagcagtagtttcttctgccttcattagtaggactgtgtgaagattaatggactaaaattcacatgaagctcttagaacaatgagtggtgttatagtcagttctcactaatattatcctccactcttcaggtactttaagtcactagtttgtcaaaacagccctgtaacatatatgtgtgtatcttttttgtacttttttttaaacaactggggagacacgttgtaagatgctcaagattgcactgttagaattggaactcagatcttaaatataaaaagactttgccctctttttttacttcatattcttagtgataagaacattggaaataactgacctatagactcctgttgctttttgtatctcgttggttttgaagatgttatgcccctaaagctttgtgattatgtaaatatttaattttaagtgtctcgtgaaagtgtatcatactcttcctcacagaagtcctaatgagtgcctgactttttgtgtaacttgttatgtttagtgttttctccccctagcatagaagatttcaattctttactttgtagctgcaaagaatctgtatgcctcaaggcatctttggaggctttacatatcgaagaagctaattgaacatacaaaatgtatgtgtagttcacttaatgcacatcgtattgtccttccaggaaaaattgactctgaacttttattttctacttgatgaagtaataggctttgcacagactgctaaactatcatttgtcgtgtaatgtacctatggatggagaccagatcaaagggaagacagaaaaatgacagtgataaccatatctgggatacagggtgatttggttttctcataaa

SEQ ID NO: 112547 - DNA, 1011 bp, Homo sapiens
ggttttatgctacacataaaagccagactttgcagctcagttttaaagtgttgccggaatgtcgtttggtgttcatgctttggatgcatgtagtttagataacagaaatttaatagttacataaaaatatgaatgtgcccttgtgttcaaatctgttgagcagatttggctcaagaaaaaagtacagaaagtatttaaaggaaaacttaaaatgtggaatcattgtattaacatgttcagagttctttaggaagattaaaatgagaggcgagagctaccactttcatgtagcgcatgttgtttgccctgcctgccagtgtccaggtaaaaacaaaaacagttgtctgtttttggatacaacatatgttagatgttagactgtcaaagtcaaacaacgttctgggtaccccgtgttacattttaaaattaaattaatacttataaatttataatatctctagacttacaggttacggaattcacctctcattaatagtagagtgtgggtcatttactgatcccctgctcaggaggactcctagggcctccctgagccccctttacccttcagtgctgggtgactggagcctttcagattggaggtgagatgtccaggtgtgtgcagactttttcctggcctggcttgtgatctctttgtgttttaaaggacatttcatgaagcaaagggttttatatgtacaaattgaagaagagcacgttgtttctaatagctgtgtctgtggaaatcctaatgaatcccaaataaagtggatagctcatgtggcagggaccaactttctgttgtccagatatcttgtgtcactttgaggtggttttgctcctttcagatgtttagtagtggttttggaaactgagatttgtcactggaatgtgctagaagctggcagcatctgcatgtttaagattctttttatattcctgtaagagactgagtccttttgtctttacacatagaatctgtgtataactcatttccacagactgagcaga

SEQ ID NO: 112548 - DNA, 1984 bp, Homo sapiens
tccttccaggagcgcggaggtgggttccggggctgcggcgcctcccggctggggccgtgggtggttgcgaggcagaggggcgcggcgcagggtggggatctcgccctagcttggcgcagcgtgcggtccgagccaccgttcgtgggaagaacgccccccctccccagcgcctccgctcaggtaagacccccaggaaaatccttcacccgtgaactggcgcttgctgaaacctccgggtgctgaaacctgcggctgcagaaacaggagcttcctgcataccttggagtggcctgaagatgtgcagagaaggcggaggcgggcgccttcgacgcgttcttggtttttcttggctctgccagtgcggttggcccaggtttgggtccatctccgtgtctttccatttctgagtttcagtgtgaaaggagagtacccaacaatgtggtcattcatgagttgagactgccctgaactgaggttctttgtgtctctgtgttaaatcggaatgtttaacaagtaggagtttggaagactccattcctggtgacagtcaggtatgggaccagtcctttataacgtttagtaatgactgccagttgactttgtaaagtgctgtgtcctcataacgttgcttacttccttaatttctctgtgatgagaaagagccttatcttcctttgtaagtgtgcagcagggaagggcccatctttggagtctggaaaggcactggtttaagtttagacggaaacgttatttcacagtccaatggaataataaggtttaaatgcaatgtctcccaaaacgttacttgccctagatgaatcaaagaaaaaaaaaacaagcaatttcaggcaaatgttctttggaagtcattaatttaccacatctgttgttattgttatcatgagttgtttactgattcctctctccttttatttaactctatagatggtaaggaggggaaggagatttaaaagatgaattagaacagtggaaagagcgctggactcctggcctggtctctcatcccagctttgccatttactagctgtgtgatcttgaggagagtcactttactttttcgaacctcagttgacttaagggtataatagtatgtacttcacgggattgttttgatgaacaaagaagacagatcatgaatttgaatgtgcggtgaaaccactgccttgaaactcagactcagtttcgcttctcttaccttaaggtgtttcacggttagggaaataaggttggcttacttggggtatttacagatgatttctgttacattgtccatttatgtactcatttatttattaacatttgccacatggtgcgtattctatgtagagacttgtgctagacatggtggtgaaaaatgtgggacttactgcttgccttctggtagttcatggtttgtgttggggttgtgacatttgccaagtggtgaatatgtctttgtggtccagagtgagtggcgtaagacagaagttttattgcaatttagaggagagattagtttcgcctgggcgttttgggagggtttatggaggatttcagatttctgagtcagaggggaactgcatggataagtgttgggaataaaaattactattttttttactccagaaacattgacgaaacttgtttgactgccctggagagtttttgttgggaagtggaggtaaggttcaatagggaggctggggctccgtgatgctcttgtgtttggctgcagagaagacttgattctatgggggatttttgatggggctagaattttaaattttctgatccttgtaaatttttctctccctcatggaacacccgtcatctcttcctctctcatatttaaatcatcttaataggcacaagtgtgaagaacccatatacctttaaaattcctatcacaggataaaattggtaatccaggaagaatgttccgctgaagaaatgtagaccctggtaggacccagatggggaagcc

SEQ ID NO: 112549 - DNA, 1026 bp, Homo sapiens
tgtagaaacaggagaaataggatcatacacatatcattgttttatacccatgaatatataatgcacctcttatcattccccactaactgtgataggagcatttcattattccattgtacctacccaccatgttgtttttaacatgtctcttattattggacacttgtttctcattttttttttttactgttactggcaatgtcttggttaataggctcagaactaatctttgttgatgttcttaggaggtttatagaatatatgaaatatattttacaatagccctggaaagcagtgtaataattttatgttggtattttaaagagtcaatttaatatgtagaaaaatggtatctcacttctttgagtttcttttctcactggtaaggttaaacactttctcactttaaatgttaaagtataagagtttattttcttttattgtgaaggtttgaaggcatttgtttaaaattatttaatttttactgttatgatattatatgaccttcttgtcatcgctcatgactttaaccttaggaggttaatcatttggatataacaactttgtgtcatgaaagaaagaacaagattgccaattgtctgggccatggaagacctaacagaaactgtagaaagcagagcttatgagacagaactttttaataggtgtgtcaggctttctgggcttaaaaaaaaagtcctgtttcttggatattttaattcagtctgcattgggcagagagaagtacagagttgcctttcaatatattttaaatttaacagtctataattagaaaacactatttgagctcttataataaactttcactctgaaagtacccatctaaattagtgggtcattcctccccactccttttctccctccccctcagtcacatctgccatagccatatccatggactctgcttctgtaagttcaaacttgtgggtcactgtttcataatattaaatgatattagtggggcttactccctccccttataagattacttcagtgacttcctta

SEQ ID NO: 112550 - DNA, 1060 bp, Homo sapiens
tgtaagggtgtgcttaaatgttactcctaatcttagtgggacagtcctgagttctagatttattaaatgtttatgaacaggaggatacaaaagttgtttagaaaattttattttttcttcctttcatccaataatattcatccttaccttggggtttcagtatcctgatatttgtaagaactattaaaaatcaaatagatatgaattacttcacttttttaacaactataaaatgggtatatgagtttacttagcaaagattttcaacttaaacatgttaatcctttatctcctccaaaatatttttctttttgaaaggcatatttaaggaaaaaaatctttccatattaaaaaattcttgaattccaccaaagtccataacagatttaagaaaagagtaccctcattatctagaactggctaactgtaggctgcaattactagtggcaagaaataagggggttgaatcactctccaaactatttcaaagtccttaaccacatctctcaagcaagttttctaatttggggttcgtagttgataggtggacctcctgaagccctgtaaaatgttttggctcatgcatataaccagaagtagaaagcttatttcttcagattctcaaaatcgaatttaggtcttgggaaatcaaattgccagcagataactgaggatttaacctcatgaatttgttgctgactacctgcttaatataaattgcagtaacataaaagaagaatgtttgttcccatgctgaaactgaagatttctaataattaaatagcagtagagccccatctatgacagcaagccagtttactgcatttgtataccctgagagctaaattaccactaattgtctcatctttcgaaaatgtatttaaacttcattagatatgtgaatgtctgttatggccaggcgaaagagaccgacctagtccctggcctcacaaagcttgcagtctggttggagaaacaaacaaatcattatcacacagggagataaatgtttagataattgaaagttcaggatgctataagaacacattgccaaggcacg

SEQ ID NO: 112551 - DNA, 1054 bp, Homo sapiens
ttatcctttttttgatcaagattgaatgaaataatcagcttacacattcactattaaatgtaattaactgtatgagaacactttggacattttcaagatagagttttttgaaaatctagtcatagagaaaatagttcatgcccgtattgtcaaaataccttcagatggtcctcaaataaaccctgcttatataccgtgggctaaatgtgttgtcacatttccctatgtgtctaattatgtaatgtcaccttggctcattagttaattcctctgttactgtggcttgcttattcctttcatatgttctcaagaaagggttttaatgcagtgagttgactgaaaatacagacaggttcattctctggcaaagagtgcttttgaggagaggtgactatgtagactcttcgtctactttagttcccccaccccacacacacacatcctttggaagccaaaccacctagatttattgcagtatgtgaatcttcatttctgaaaactgtggtgcaaatctctccatgaaactgtagggatgggcaactcaaaagtaagcctttaaactctgtgaaactgtggtttgtttgttaatgccattctgtactgattattctttatcctgttaaacattgttttatttttcattaggagtaaaaccaaccagtaaacttgtttttccccatccctattttttcttttaggtcaatagtgggacgcagattctgttttattattggaactttatacctgtatcgctgcattacaatgtatgttactactctacctgtgcctggaatgcatttccagtgtgctccaaaggtcagtacctccaaactgccacttagaagaaatcaggcaaacagttattgatcacttaccctgtattatacattcttctagacacttccctatgtgttagctgaaatctagcatcttttctattttctatttagatttgaggggaagaaattaaaatgtatttataaaatatataccttttgtgctaaaaaaatgtattttctgttaactgaaaattaccattgggggtttgactctg

SEQ ID NO: 112552 - DNA, 1032 bp, Homo sapiens
tccattaccaacacagccaagcagcacatatttcttcagagcctagatatgcacatgtcatcaaaggatagcattttacagagtcaacaccactcacttcatagaacaaggggccagtggcttttcagaagaagggtctgttctcggccccacaccagaacgccagccgccaggtcccgctgctcagcaggtctcaagcccgcgctcactcgggctccggctgctgacagctgcgagcccgcgcgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggtgagcggccctccctgcagcgtgcccacgcgcttggccgcccaccctgaggtggaagctctggcgcgaccggccgcgaggggcctgcacccgcccgacaccagggagttttcaccccgcgcctcccgggtgtagttgaaatatctcgcgtctgggcctgtgagggcccaagtctcactcccctcaaaattcagggttctgggccgatcctcagcttcctcgtttggaaaattctggctgcccccagggcccgctgaaggttccatggagagtggcggtgaatgcattttggaagcgggccgtgcaagagaagaaagaattgtatgtgcacaaggttcaggcataacgcgtttgttcctgctcggctcaaacgggagtttgctgccaaagacatgaactgcgatcagttttaattctatcagttatttttgattttta

SEQ ID NO: 112553 - DNA, 1037 bp, Homo sapiens
gtcttcaatatgcattcttatggaaaaaggtgttcatggctaaaacatttgagagccgccacactgaatgatctctgggttgtcttcctcctctcaaaattgatgatcctgattatctgtagctaataagcctgaacaataaatgctttcgccaatctcttaaagtagttgagaagctaggtgtgttagtttcccttctgtgatagagaagaaacctgtgttggagagcagtgagcttatgtgtctgtggccatctctgacctgattcacacatgtgcccctcacagacaggcacagacacagggttggcatgcctctagccttacagcctcttggatgaaaggtataagacacattcacatgttggagtgaattaagcacacatccattttgaaatcacagggctggataccacttaaagaatattgatcttgcattgggcaacgcatagcaactgccctacatttccccttttacctagcgtcacaaccaccagtactagaaagcagttaatctgctcaccaaaataacagagagagactttagtggcattttttccacttggtaattgactagactctggctattagctccttttttttccttactatccttttcaaactaataacgtgacttctcataattttaaagtaacttgatgcttacacaaagtttatcataaaggtttctagcaacaaaaccagtcatgacttcttgagaacttatttctaaaataatttacaaattgagacttatgaaaaaatagctctgtcattcaagtgttcatttcatgagtatgaaatatctcccttgtgctagacatcaggccaggtaaaaagtaagatgtgattgctgctcttgagaaacctactgtctagtggaagaaatacaggtatgaacaactaattgtaatgaaggcacagacagcctacctgtcatatctgggatttgatctgaaacagatgaaagttataatagtttacataccttaccttaaagtatggtttttaaatacttaagatgtgatatgacatata

SEQ ID NO: 112554 - DNA, 1020 bp, Homo sapiens
atgtgtgtgtgtatgtgtgtgtgtgtgtgtgtgtgtatagttgaatgaatgagtgaataaacacgcatctctcctgtttaaaaatatatatatatatacttcatctggttctttccatttaccattacacatgagttctctaactgcttactgagggctgactgtgccgggcatcgtgcttggtgccatcccctacagatgccagtagggcagcccttgtgcccttgcctgtacctcacagaggtcaggagggctgctggagcaggtggcaggccccgcttgctgtaaatgaaagccttccccagaaggatgagtctgttctgaagccaaggggccgctggcctctagagcatctgtgtggcagagggtggagtcatgggagaaatactcaggaatccaggagaactgtcacttgggcaaattactcactttcctggggctcctcctcctctataatagaagatcaggtcccacgtagaagactttaagggcaaccatcatatacttccagacttctaataattaaataatggaagtcagcatttattgagcatttgtgcttaggctttgtgctttactcccaatgtaatttcattctcacctcaacttcctgaggtgaacagagtgatttcagtgtcatttcagtttcaagaaacatactcagggtcacacagccagtaagtggtgcaactgaacccaggcttgtctcaacaacaaagcctgtaaaactgtcctatacacacacgtacacacatacacttgtattttaagccgtgattttgtacattctacagtacactgttgtctttttttttttttttttgagacggtgtcttgctctgtcacccaggctggagtgcagtggcatgatctcggctcactgcaacctccacctcccaggttcaagcaattcttctgcctgggcctcccaagtagctgggactacaggcacatgccaccatgcccaactaatttttgtatttttagtagagatagggtttcaccatgttagccaggatg

SEQ ID NO: 112555 - DNA, 1164 bp, Homo sapiens
ctttgaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacctgtagtctcagccactagggaggctgaggcaggagaatcacttgaacccaggaggcggaggttgcagcgagccaagattgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtgctgccgttttctccttaggtgacgcatccaaagaagacattgacactgctatgaaattaggagccggttaccccatgggcccatttgagcttctagattatgtcggactggatactacgaagttcatcgtggatggtaggaattggaattttttgttgtctttaattgaggtagtttttctgaactgtaaattataatgcctttttaaaaaaagttagcaggggtcttaataaagaccttccaaaatcctgcctcaccaggttgagaattcatgaacagatgtcaggagaaggaagaatgtgactgtctagtgtctctttaacagggtgaccttgaagaaaaaaaaacctttatggattcacaggaagttacaaatatagcacagacaggtcttgtgtgtgtgcccttcacccagtttccaccagtggttatatagccatagtacaatattaaatcccaggaaattgacactggtacactgtgttatcacatcaatagatttgtgtaacctccattgcaagcaagatacacatccattttaaaaaatatatccattgtaatgtaaaagctctgaagacagggtaaaaataataattaaaactggactactgaagttgaatgtagctatctgttcccaagtttcacagaatgctagttgaagaattaaattttgaatcttatgtggatgcaaaa

SEQ ID NO: 112556 - DNA, 1360 bp, Homo sapiens
gaaatgccaagatgtaaaaataaacccagcacttcatcctgagttctcttccctccgctcaatagggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagctatttctcctcttctttgacctgctgttaatttttaaagtgggagtgacggggagggaatggcaggacaaggcatttgtgtaaaacctgcctggggccgtcgctgccagatttcttaccaggaaagcagtaataagggcacagagaacaatttttaaggaacatctgtttcttctttgccaacaaagtgaagtagtgtaacgtaagcttcttttaatcattggcttaagaaagtgtcttccaagatagaattttggagttggaaagacatcagaaatcctgaggtccaatagcctcattagcagaaagcttaagggatgtgcccaaagtcactagatattttgtcacatagcctagacta

SEQ ID NO: 112557 - DNA, 1099 bp, Homo sapiens
ggtgaagttgaaagaaacgggttgtttggaccctcagccagttccttccacaaacttggtcccctcctagtttcctgtatttcttccacaataatttttcccaaataactttgatgtcactgcacagagctcattctgggctcattctgcccaaatcctgctttctgtaggcagcagttctgggggagagtcaacagtccccctagagatagggatcaaagcaggtgtctgcggggagagggacactcctctggccacttcttctgtttgtttgatcttgaagggatttggcctccttccctgcagcgaactcagagctgaactgtgtgccaagaagaggctaggtcagccttctttctgggagctgagccttctctgaggtcacagctggcatgcgggtctgtatgaaggggtgttttcctcctggttctagtttggttgctagggctgctggcaactacctgtttagctggaaggtgactttgaactgtttcatgactacagttgtcttaagtattttacacaataattttttcctctagtttggtctatggctgcaacaatatggaaactctaataaagggcttatgaacaataacaagatgtctgtgtggctgtgcttttaaagaagaagagtcatgagcgagtaatgtaccgttctgacagaaaagaggcccctaacatccgcacgatgtagtagttgttgaaaaatcgcatttaccatttctgccacagaatgtgatcttccagatgtggaagatgagaactttaagagctgccctgtgaaacctaacctctaaagatacacacacaagaaaatgtggactgctttttaatagaaactgtaaaatttgatggcaattaagtatcttaatactaatagaaggatgtgattctatacaccgtttatactgatttattgtgggaaaaaataagattggttttcttggcaataattcagtggatatcattctggaagtggctcttctaaatttcttcaactcttttctgggaaaacttttattatctttactctgcagccaggcgtgactcagggagcgtgtaccaaggtgactcagatacacctacctctacacag

SEQ ID NO: 112558 - DNA, 1014 bp, Homo sapiens
ggagcggtttgtatcctctgggctgtgagtgtgagcggacagagcacatagcgtcacgggagttggcagtgcgttgggtaatgtgattatgtctgtcctatgtagaatcatacagtggcttcccacagtggaccaaaaacaccaaacactgcagaatgacacatctttccctgatctggctgttgcccgccttccctattcatgtttgcctgtttcctactggtgtttttcaaactttttttttgttctgtttaccatgacccagagtattcactacacttcacatcataactctgggcatacgtatacatggaaccaaagtaaaaatgtcactatattaactctgtagtgtactctcaggatttttgactgatagggcaattcattttagccatccccaaattaacaaaatggattaattaaatgcagaggttgtaagacatatatggtatggaatagaggttataatcttaaggcctacggcaaattcatattaatagcatttcatttgttccttcttgaggtggaaaacgaagctcattcccaacgtgcaaagccaaggcagcgaccccaggacctcttctggagatggaagcttgttgaaaacccagactgtctccacggcctgcccagtcgaccccaaaggaacactgacatcaattttaccctgaggtcactgctagagacgctgatccataaagacaatcactgccaacccctctttcgtctactgcaagagccaagttccaaaataaagcataaaaaggttttttaaaaggaaatgtaaaagcacatgagaatgctagcaggctgtggggcagctgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttccctctttgtttctgcttca

SEQ ID NO: 112559 - DNA, 1077 bp, Homo sapiens
aattctgaataaggaagtgatattacatgatggggcaggggtgcattttgttcctggacaccagctttgctgcccttgccttggcctggacagcttaaactgactggccagtgagccctgagtggcaccctgacagggctggcccttgcctgctcctgaccctccactccaccacctcagagctcacccatagacttgtctccttggccctttcttccagaggacagcctggggaggaacccccaggacatgagctggccaagcgctctgcttttggtaggattttacatttatttgggcttagagagaaggagtttccccctttccctttcttcactcctgagtcagggtctgtaaagccctattggcccagggtcggtgctgttgacctcccagaaacaggcccactcttgaaatctttagattcacctttattgcttgggcttttagtaaggaactctacccatttgggttcatggttccatttggttgatgggatattttgtcaagattggaatttggtccaggagagcatcaggggggttcggttatatggggtggggtggggtcttgtgccgcctttgcatccccagtacaaatgcgtggtgactcctggtggagggagcccaagtctgaacatatgtaagatgggccttgcctcactccctttgaagcccagccgcagccggagagcagtaattgctggctttgattgcgcagacttcactggtgggttgggctgtgccggggctcgcctggcctggcccagcttcagccgcagccccccagtgaagccttagatgtgggaaagctccagcccctggagcctcatgcctgtggtttcttgaaaataatctggactggacctgttttatatctgtaaagcaacactacaaggcccccgtttctcccacttggaagtaagacttggtctcccctgacatccctgtattttaaaagagccaccagggacaaactgcctcatttcatagtgaaggaatttctttgctcttttttttttttaagcactagtccctgaaagggattagttgctttttggtaagcaactgtacagag

SEQ ID NO: 112560 - DNA, 1060 bp, Homo sapiens
ataattttttatttatttccacatgaccactagcccaaggaacctgacattgtaaattaaggcttggtctttattaagctttaaattagcagggtgtgtacctcttctcctggtaacagttctcaaaggagctgcctttggttatcctctctaagaacccacatccagtcaatcaccaatccctgtctttggggtctgtcttgagccttttctctcacacttaccactgccatagccctagttcaggtgctcagactttccatctggagtactgtaatacacgttaataatttttctgcctccaggctttctttctaccagttcatccttcacgttgctcctggagggatttcctacaactcagattgtgcatcacttcccgacctggaaacttagccagtacttcccgttggctaaaagataaagcacccgccactgagtgtgtgggtctgcccagtcctgcccttgtagctttgcccccagtcactcttgctctctgcctcccctcactttcaccctagcccttctgagtcctatgatcagtccaaacaaaattattagcagttccccacatggcaagagggcaccgcacatgctgtccctgggcttcgaaagcccatttcctctacagaggactggatagacgtgtgcagtgtttcttaggagaagagtgtttactgcagctcatttggcttttgactaaaccaggtggcccttacctaaacttttagaacttaattttggtgctgaggtttcaaacaacttgcccaaaaggggccagcagagattttggtaccaaatagatctgaattttaaatcagttgattccctgagcaatctacttcagctttttaatcttcattttccttacctggaaaaggggaatatcgatacctaccccctgtggtggttgatgtgcaggatctgcccagcggccagcacacagttggagctcagactcactccttcctcctactgagacctaagtcaattgccctctcctctgtgaaactttcttcatctttattcagattccccaggtttttccaaatcccatcac

SEQ ID NO: 112561 - DNA, 1879 bp, Homo sapiens
cactctgtcgcccaggctggagtgcggtggcatgatcttggctcactgcaacctctgcctcctgggttcaagcgattcttctgcctcagcctctcaagcagttgggattacaggcatgcacccccacacatggctaattttttgtatttttagtagagacagggtttcaccatgttggccaggctggtcttgaatgcctgacctcagctgatctgtctgcttctgcctcccaaagtgctgggattacaggcatgagccactgccccggctattttaaatttcttcatacatattgtcacattgctttccaaaggactgtattattttacacttcttataaacagtgtattcaggtgactgttttgccacagactacttaaaactgggtaaaaaaatcttttttcatgttatcgtaccccagcatctatcacatattctattcagtgtaggtatatcatgtttaagtcatactaattttatcagcaggaaatacctcacttatagtgccaattgttttattactgtagaatttgagcatctcacttatgtagtcttgatagggcaaagacttttattttatagaggggaataattttcactatttaagctcttaagttaatttaatattttgcagttattatgtctgagttcatgcagcctgctataataaaataccatggacatggtgagttataaacaacaggtttatttctcacacttctggagcctgtgaagtccaggattaaggtgcaggcaggtttggtgtctggtgagggcctggtcccagtcttctggctgtatctttgcaaggtagaagaagggggaagagagtgctctggggtctcttttataaggacattaatccccttcatgagagctccttgcttaggctatgatcacctcccaaagactctccctcattataccatcacattgggggttagaatttcagcatatgtatttgggagaacacaacattcagtctatagtaattctcagggtctacgtgagacaagcattagaaatgccagccaggtcagtcttaataaaagtgaaattatttctttttaaaagagcaagagtgaagccgttaattaatatacaatttaatatgtagccattgctttaggtgctgctgtggggctcaagttctcacaagagatgatgacaaggatgcatatctgaggtcatgcacacatggaaacttatttctggaaatgggttgcacaatttatttcctataatatgctccacagaaaaagtcactttactggtcaaggtttggagctcagacattggatataagtttgacacaggaagtaagagtctgtctgttacttatgggaaacagcatagtcagctcttctgagttattttggttgccttaataactaccatatgctgatggttaggaactgtcttaaattcttgacagcaacccagtggtggaatgaatactattacatgaatattattactccatttttcaggtgaggaaattgagaggctgaagagtttaggtaatttatgcaaggccttgtagtaggtggctaagctgaagttttcacccaggtcactctgacttcaaaatctacgtggttttcctcctcctgagtggattagctcagtcttccagtaccttctttttgttttgttttgttttgttttgttttgttttgagacagagattcgctcttgttgcccaggctggaatgcaatggcatgatctcggctcaccacaacctctgtctcccaggtttaagcgattctccagcctcagccttccgagtaactgggattacaggcatgcaccaccacacccagctaattttgtatttttagtagagacggggtttctccatgttggtcaggctggtct

SEQ ID NO: 112562 - DNA, 1155 bp, Homo sapiens
gagttaagggccccctggccctccagtgggaattactttcctgctgaatacagagagtgaggatatgatatgaaggtatgcttcctattcttaatgcacatttccaacaattgctactttctcagctcccttaacaatccccagatccgagcatgtgtcctaaaggatggttcttatttggggtctctgtctgtctctgatttagacacctgtttctatttataggtctctgagatctttgattaagatcaggttttctatcctttcataactcccctctggcagggcagcccttgctagctctttaaagtctctggcatcaaaatcatgacgttttacactgggataatttgagttcttaaaagtggatcttaaatccatcccagaacattttatcttttgatttttattcatctttactatatctctaaaatagtgttcatatgaattaatcaaagttttatttttaatccatattataaataataatatcacaaattttattttaaaataagccttttctcttcagaccttcctggctattaaaggaaatccatttatcacaaatttgtcatgagaatgttttatcttggaactgtacaagtttattcaaattaaatggatattttccccacaacttggtgaaatcttgacaatgagatttgatttttaaaaagtttgactctttattttgcagtaaatagagatagagaagcatttttagtcaattgtgtttcagaaattcctgtaaagaaagaccatctttcaggtctgtactagactttgtttttgttttcaatgcaaaactttaattacatcattttatctactgttcattttggtaagtgatcttctatttgtgagtcatttttgtacattagaaatatcagagaacttcctggctaacacggtgaaaccccatatctactaaaaatacaaaaaagtagccgggcgtggtgggacgcacctgtcgtcccagctactagggaggctgaggcaggagaatcacttgaacctgggaggcggagcttgcagtgagccgagatcgcgccactgcactccagcctgggcaacagagcgagactctgtctcaaaaaaaaaaggggggggggttatcagaggacttaaagcaatggaacatgtaaataaatagtt

SEQ ID NO: 112563 - DNA, 2184 bp, Homo sapiens
aactggggcgctcgaggacaagttgctcttctcgtgcttgcatcctgtgcgcctctgcttgccttttggttggctaggagggtgcatacctcagccatgtgtctgtctgtgcagtgtgcctggctcccacactaggtgtcagagagagtcccgggtaggagctctgcgctgtgccccggccggaccagccacaccatcgggcgatggactcagcctccttggaaagcgttgcctccaaacaaattcatggccgcctgactgtgggatgggaactgtccggaaagcggacattacaagaagagtttgtttgattcaaaatatgccgggggtggggtaagggaggaggataaaactggtttggtctcagctctataatttgcttcctttgtggaaagttgtatcagtttgatgcggcagtgtttgaaaatgcccagatagtctagagccttcctggatggaggctgtcagaagagacagaacagtgcggacaggctggcaggccatacagggtgtgcgtcctagtgtgtgaatcaggccctgtgtggacatggtcatgccagcggagctcgggaggcctgccgcgccgcaccgagaagctgctgtgtgtgatgcttttgcttctggagaggatggcactgtgccctgtgcttgatgtacacacacatttggggtgcatcatctgtgtgttcgatgtggctttgtcaagggagctagcattattgtgccggaagtcaaactggtgggttattaactggttgtgaatatgtcttttttatatgggtatagtattcaaagtttctgtggtgaattacagctttaaaaaaactttttttttcagtgagttgtaaatgtagctgattgtgggaggaggtggaattaatatccttccccttaaaacatatttttatactttttaacattgtaagaactatctgatgatagaactctcacaggcaaataactatcatcatgtatttttgcaagtaatacatttagcaaagcatcattatttggtcaaatatttgtatttttaccatgcttccttcatattttaaaatttgtttttgaaaaatatatatcctagcagagttcctttcaagaaaaggaaattaattgtgtaggctgtgatgaaagacctgagaatgttgttcttgctgaattaaatgtttactttaaaaagtttgaaaagcaaaaatttctaaaacatatccaaatttatctagagagcttattgaaaatactgtctttattttatttttcttgcctggcagtttccctcctttgtgttggctggtggtggatattttaagattttttttaatgctgttcaagcgtacttgggaaaaagcctttggcaagtgtagtttttaaccttgatgcagaactttatccttcctttaaattcttctccttatttctgttaccagttttccataagatgagatctctgaaacattagtgtatttctgcacagaaaatcattttggatgatgttaatggaaaccttattaaatgggagactgattcctatccgttttctcagttgttccctcctaatatggatgaggaagccaataatatgagaaaattcccattgtgatggtttgcttaggaatataggcagagattttaaaacatgatgtgttttgctttcatttaaaaatcatttaaaaagtcaagtcttaaataaagtgttatatttccaataattacttttcgtgaaattcctatttcaaaattgctttgcaagaaaaatgattcacttttttttttccacccgaatatagaaagaaaaaaataattatcggcccactctaatttatagttaatgcttctgtgcgtaaagatgtgtttttactcttagccagtagcagttagtggattgctttgaaattccatctagcttttgctgcaacagccagtagtacattgttttcttctctttcctcctttcaggttttcccatcatatgattcccggtcctcctggtccccacacaactggcatccctcatccagctattgtaacacctcaggtcaaacaggaacatccccacactgacagtgacctaatgcacgtgtaagtatccacccgggctctgctgtgattgccttaggatactgaggatttctacactgttgctcctttgcaacagtgatccttcacccctttgtgttgctgtga

SEQ ID NO: 112564 - DNA, 1008 bp, Homo sapiens
catctttactcctgtaggagttccttaagataatactctctgaaggcccagttttcccagatgttgaaatcttgagaaaagctaacaaatggactcctgttccttggatctggtgaataaatattgtttcattctgaaccttaagtatgaatggtataaaacatgtagttgcatttctggttaaatatcctgtgaatctgtaaatgatacctctctgttctgtttaacaggcatgtccagacatcctccagctcctgatatccctactttttatcccttgtctccgggtggtgttggacagatcaccccacctcttggctggtaagaaccttgctgcacccttcagccaggcatttgaacacatgttcctccactttccattcatggaaattagatttatgaatggtaacacttgtggagttgaagaaatttcacatcaacaagcaaggtgctaactttattcatttcaatttaaaagattaaaaaacatacagactttgaaatggattgatccgtttgctaatatgggtagaaaatgactgtagcatttgctttgaagcttatagttttatggattccctttgtggctttgggcatttgctatgcctgtacaaagttagtgctcagtgtggttcttcttttctaggttttttaatgaacaacttatatttttcaaaaatgaatttagacgcattgaatatctacctttacttgtaagtgggcaagtgaggtaaatgacaaaaataactagagagaaattcaacaatataagagcattttttggatgttaatgaagtaagcatccaatttgagttcagagtagtaaaaaactgatttgggggccttctttttttctgaatatgaacgctagtgctctttattttgttgtttatttctaaaaatatgcttactgctgcctccaaaatcttttcaattatgaaggtgaaggaaatatattttgggaagaaagaataacatggtatagcctatttttattattttatgatt

SEQ ID NO: 112565 - DNA, 1087 bp, Homo sapiens
gttaaaattcccctggattcagttattaccagaagattattgattaaatgcacagccagttgaaactccagacctttatgcacagccagatcccgcactttgggtttagtttagttagaacctggagatgtggaaaatgaggactagctaccaggacagcaggtttctcccccagttactcctctatccaggaggccccaggccttagccagtagggagttgaaccacctttttagttcttcccagaaccacatcctctgaggctaacagctttcatgacaccttcaattcctgccagtggtgagtgggtcatttctgggaatgctgctttgggggtggctctcaggatccctaagtggcacccacttcgtgtccacaggaggtatgggttttattggctgtgatgccaaagaggtccttacctgcagggaccagcctgggtggcagccaaccaagcttccttggcatgttttccagtcctggagagaaaggctgcagttgagtctccgtagctttacccacttctgctgaggtgcttctttgtctcaagtgattcctgtgcctgggacagagaccacacagccatttcatagatgtcacatgctctcaggtgtggcccaaatggtcacctcagtgtccaagattttatgaacttggctttcaggaaggccacatgatgtacaggtaatgagcttggcctctagagccagacttctgcatttgaatcctggcttggctgcttgctagagcacatacccttcaagaatattttcttctccatgcctgtttcctcatctgtaaaagggggataataatagtacctgcctcaaagctgttgtgaggataaagtgcttagcacacagtaagcagttggtaagtgttaattgctgtaattactatgtattatgtgggtaggttggcctgatggtgatttgcaaatttaagaaagggtttcaagcttctccctaaacagccatccttgatattttctcccttttctttctttcttttttttcttttttaagtatctactctttttgtcttttcctttgctcacccaccaatcacctgcctgagattaaagaat

SEQ ID NO: 112566 - DNA, 1135 bp, Homo sapiens
gagtctagtgctggctctaccactttgcagcccgatgacctcatacaagtcactttataacttgtgttgcatgaaacgacaacaaaagtaccctaatgtgtgtacatcagtgcaccatattgtcgctggcttgcttccactggacactgaaaatgaagcccatcatctttcctcatcctgcctgcctgccccatcctagtccgtaaaggcagcctcaatcttgaaaacctggaagcctctttctcctggcctttccccttcacccggcacacccaggctgttactgtcttcttcccttccttattacctcctgcctggagtttcatctcctaatggctggttttgttcttaacattacacattataggtgtttgcatatatgtcttacctccttgagtagatactaagtttcttgggaatagtgatgagattttacttatctttgtctccttgtcatgcttccttgggatagcaccttaacatggtaggcatttatttacttaagtactttttgagttggataggtgaaattgactgatcagaccgttgatctccctgagccatatctgggctcacctctgagcatttgtgactgggtctggtagtagctttgtatcccaggtggggcactggattcggggtggcaacatttggagcccgactgcagacccagctgcctgacttgtctgaatatcactttcgtcattgactgactgagggtggttagaatttattgaacgcttaggctccttcagctctggaattctacattaataaactgctttgcacttgattactttgaagtggaagtttcccccctttctttataaggtaaatgaatatttcatctcaagcccaggagtcactttgcacatatcctgtgatgggaggctaatgaaagctttgatagagaccttaaattgggagagatgggatcatatccattgctctatcataagaatttcaccaggtctatagagaaacgagatagaagacttaaaattttcattcatagctgtacaactcatgatttgaaacattattaaaattaattttgaaaacacttgggaaaatggagatgtttgaggtaaaaacaatttttgaaattcaaagagtggcttttaaccttttcatt

SEQ ID NO: 112567 - DNA, 1018 bp, Homo sapiens
gagggtaagagtatgaaggaggagagagaaacttgcagctcaacaggaagagctcgtttgcttgttttctgtttattttttatcctaatatttaactgctaatcctaacgcagtgcatgtgtatcttataaataaagaaactgagaagttagtgatttgtattggtttcttgagtgatcctgtttaccacatggaaaagtctggtgagatgaacaagtgggactgcagcacttgcatgtttctcctgacagtgtggctgctcttattttgatggaagtatccccagttccaagaccactggacatctcccacattttaatataatttattttatacatacagaaggagaacagcatctttatgtcatgctttaggttggataggaaaaatcaagtccagaaaaatattattagcgctgcatctcttaaccaggtcaggttgcaaggagaaagggtatactacgagtgagtcaaatctagaagaagctgaaagtaagaaagaggtgctatgacaaactgattgcagataagatgatgataatctaagacctttttttattaccagcacaatgttaggcttgttacaaaacagtcatctcttgcaaagcacctgaaggttgatgtggaaagtctgagcaactggaaaggaaacctcaaagtcgaagcacactgttaaaagctgtgtatcaaggttgaggtcctttgtaactatacactttccagagtgattgaatagatggttgggtctcatcgaaacttgcatctctctcttgaattaaagcgaagaccagcctcactttgtagcttgctttgcttttccctgtccctgcccaggagacctgtccctttctagcccgctttagcactgtggatgtctgactctgaattgaattgtgagagctgtgctttctggggatctcctagctgtaagcatctagaagatcagtataagcatcttcatgtggtaattgtccttttgagttatgtgcctgtagtaggttttctgtctgttgttcttt

SEQ ID NO: 112568 - DNA, 1106 bp, Homo sapiens
aattgactaggctggtcttgaactcctgacctcaagtgatttgcctgccttagcctcacaaagtgctaggattgcaggcatgagccaccacgcctggcctggaaggtcttttgatgagccataaacagttaataatatcatcttaggctgatagtgcagcatcataggactggcaagtaacataagagagcattcttgtgcctttaaggatctcatcaaaattatccaggtagatagttatctgtcaaactcttaatggtctcatttaaggagaatcatataagcagtcttaaataactggttctggtcaccagtgttatcatctgtcctcctctttttttagccttaattccaattgctgctctgcatgtccttgtatgaagggagtgatttgaagggctattttagctcaccctaaaactcaaagggaagtatatgaagtagtattttcctctaggtgattattggaattgatcttatggaagaaaagaaatgaaaaatgggatcactattgaataccttggttgtcattcaccctgtaaatagtatcgttactcataacacagcttaagaggaccatgtttctttcctaaatagacaccatttgttattggtacttgagaaacactaagaaaattgttcaaagcatacacagtgtgattcctatgtgtaatcacaatgtgattataccctactaagtacccaaatttgtatcacattttttgtgcctaggatttgcagccaccttttactaacataaactaagcatgtttctaactttattcaacaattagaatgccaaggtatgacctttttattaatgaggaatattttgttattgaaaagacttacagagaatgagcagaacaaccttagtttcgttgtttatgaagtggaacatgctggcaaggtttttgttctctatctggaattttctcagaatccagaaaagtgttgttttacttggattgttctctctctcctttgcttctccattattcatgaaggaccatgtttttatagaacaaagcattcaaaatttatgcaatccatacatgttttgagtttctaactattacaggaaaaattattaccctgaggcttag

SEQ ID NO: 112569 - DNA, 1054 bp, Homo sapiens
tattaacgtccctaaaggtctctcacaaaatggcagcacatatttcattcttgtccttccctttgcttcctctttgttttccttaccgagagagtcatgttcctgagctaatgccagcagggccagcagggccagggtggaggtccaggctctgcatccacctccctaaccactgtggagcccggcctgcaccttgccctgtgatctgtgctggacatagtcacatttaacagcccttcaagtttccaggttttaagggagaaaaggatagttagcttggcattgtagatgtagatgccatgctatttaaagatgcatgttctatatataaactctagttaatcatttgactaaaaccatcataactttcctttgcatagttcagatgattcattgttttgaaaactatgtaaactcaaatggaaaacaaccacgcactgatggttgcaacttatatttcccagtatagagttaatgagcagaaaaatggcagagccgcttccacacatctaaggctgaacatttcttggaactattaatgaatgtactttactgtaaacattgaagcttagcagtatgttctataggccctgagaagaggggaatgaagattctttctagtttcttacaattataccatggcagggaatctcagtctgtatttttaggtatttgtcctccaactctccttcaggcctggttcagctagcatttccagtccagtctctaccatttcctatccgtaatccatccttgttatccttccaggctacttagaggatgttgctacgagtggcttcatgtttacatgcaaggaagggaaggcagaggaggaaaatggggcatggtggcacatgtaggtcacataggcatcatgcgtcagcaagctccgttctgtcccccatggaagcatctttgaattcctgatgttctcagccctaaattctcagctcttctattctcatataggcagtggcaacttcaaggcgtttggaggagttggggctagcccccataatctccagcaatacccttcaccaccccaaataaacac

SEQ ID NO: 112570 - DNA, 1050 bp, Homo sapiens
aatttttgctgagggcagtctgagaaatgtgtggagcccacagctccgggggctactgagattccatatgcttttagtttgtctctgcttagccactggagtgcctctctcaaggttggtggctgagcaagtggtgctgtgttctctcacatgctgttcaggtgactaaaattctaagtacaggtttctctgaggagggccttgaagaaggcgggggcaggggattgagggggcgccgtatattgactttttcctttggtttgaatgggaagcctgggatgcttccagtgactgttttgcttgttactttgcaagagaaggctaatgatagaatcacaaaagaaatgtttttttgcctgataatctgaaattagaagggggccttgggatatggaaaatgtgataagcttattaagaatgcaacctacagaaaaatatttgataacactggaacttatttccggcattttccgaaaatggtaaaattaaggaaagatggcacttttccaagagaaaaatatacagattttgagatgttattattcaggttttcttgctgattttgcttttgcaattctgaattcatgtagtttgtaccctttcctctaaagcaaaacaaaccccaaatgaaacaaacataaaaactgtaacccagtaaactgaagtaggcaggttgttaaaagaaagagttttccagttctgcacagttacagacaaattttcaaagaaaatttacagttgggtaccttacagccaggtctgttgattcaaaatcctttcaaacaaagatggcttttgttcgccaattacttggtgtttcagaactaagaagttttgtgcagaatgaaaggaagcagttatttcatagtcatttctcctatgtcaataagttttagaactttgtagacttggaaaagttaaagactgatggttcattgactactatctacataaacaatattaaatctttgtgaaaaggggactttgttaaacgagatgcattttattttataaattctcttaagattctactttcctgctctctccatc

SEQ ID NO: 112571 - DNA, 1026 bp, Homo sapiens
tagaatctttttggcaaatgatgttgcctccttattacataagaactgagcatttacaggcaaaagtctgccaaagagcattctttgcacagcaagcaattaaaatgtggtatgtgcttcatttttaggagcagttagtggtgatttttgtggtatcatgatgttggtttaaataagagaaattagtttagaattaactggaattgtgatcattcctgagaagttgcaacagtgagtttcctttaaaaagtgaagaaacttttctttctaaggagacattaggaacagtcttttcttctttttctcaaaaggaaatatctttttttttttttggttaacagtaatatataaaaacgggggaaaacccatgaaagaacagaaaaaataaataaaaagtacctatatttctgtcattctgatataatggtttcattttgatgaattgtttcatttcagacattctttctgtatctatacctgtaatacaaacgtttttgtaaatgagcttataagattattattctattataatcttttgtcattaaaaatgtattacgtgtgctcatctttatgtgaatgtaggtctgtgtcatcagttgtaatggctggatagtatccagttatatatatatatacacatgtacatatatgtacatatatatacacatgtatatatatgtacatatatacacacaaatatatacacactttaatttattggatttatcctcagttatggatgttaaagtttttttgttgttattttaaataccactacaatgaaaccgtgttaaaaatatatttataatctattttttttttttttttttgagacggagtctcgctctgtcgcccaggctggagtgcagtggcacgacctcggctcactgcaagctccgcctcccgggttcacgccattctcctgcctcagcctcccgagtagccgggaccacaggcgcccgccaccacgcccggctaattttttgtatttttagtagaggcggggtttcaccgcgttagccagga

SEQ ID NO: 112572 - DNA, 1259 bp, Homo sapiens
ttaaagagaaaacatgccagcactgtctgtagcaagcagaaaaacatatatgttttattcccaggtaaaagtagagctcagcattatgtaggtgctgctgtcctgggactaaaggttgcgcgctctctctctctctctctttttttaagggaatgttcatttaaaacttgtcctctttgaagctgttgcttaagtgtttgtgctgagctgagccaatctgtaggaagctaatactgtagtaatcaagacacttagtactcttctgtgctatccttacatgtccttacttatttagaaaaggcagccattggattttattcagataatttaaaaattatactttaggttcatgattactttttaaatattatgatcttgaattacctgcctaggaactgtggactctgctataaactcttttagggatataaatcatccagtatctcagatagagaagatgaaagccttaaaatatcctagagaacaacaacaaagactgggggtggaggtggggggagttgggagttaatctgtaccaaagtgaagagcggggagttgagcagaggactggacagggagcaggaggcattgctaactcagaaattctgataatctagctgggactatttgcagactgttagcagaggctgtgtagaggattataaagtctctgtaaaagagtgcatttgtataatacccactgtagctaaacctgtaaacctgctgcaattatccacttgttatctctagatcacttacaaagctcactgagcgatggtactcacatgccttcaatctgtatagggaaaattgcaagggcagtgcagagcaagcaagagttttgttgccaaccccatttttccatttgtaggagaaataggactagcagagaaggttgcatcacagagtgtctagaaatacagtttatttttgcagctagctagggacaagtagaatctttaaaaagctggatttgttgaccgttgtgtctacctatgctcacacataaccctatgtggaacttgatgacagttttgcagatgaaattttgatcttcatcatagtaatttattgtcattgttatgttcacctgtaaaaagttgcctattgctcgaggcaggtggatcacctgaggtcaggagtttgagaccagcctgaccaacatggtgaaaccccatctctactaaaaaatacaaaaattagctgggcttggtggcaggtgccaagctactcaggaggctgaggcaggagaatctctt

SEQ ID NO: 112573 - DNA, 1067 bp, Homo sapiens
cttccatttgtcccgcatgcaacccaaatgtttaacaccttagaaaagaaacatctcatttctcttcagatgcttggggagggaaaagcaacacagtgcaggaagctgcagcaaacgttgcagctcagtcacatcaaaccacaataacacctggtcagtgtagcgctgcaaacttcattgtttttggttctttgtgatctttctaagagtcaatttttaggtgggaaaggaaagatatgggtgttctcatttcagctatcttttaaaatgtttatttttttaaagtagaaattgctatgaaaatgttccatgagttcttttctaattaccttgtataacttagttctgttgtgacttttaccttaagggaatcaacactttggtttctattaaacagaattatacctattataactttgtcttacctaccctgcatatttgtacttgcttataaacagctaaaatctgattttgtcattgttcacatctggaattaaggaactaagttggacttgtctaatcagtaagcttctgaatgtaccactgtacgtgacattgttggatacctttgaaaataatcacataaataatattcaaggatagatggagactaaggcttatatctcatgcaagatttttaaggtagagtatcttttcactttattgcaagaagctattgaatttgacttaacctataaataattttcacttttctattttaagttgtgcactttttgaagctaaacacattgagttttccccttcaagtggagaataagttttagaaagtgtattattctaactcaaatgtatatatagatgtcaggagaatgtgtgggaaaattcctcagagcccccaaagtttcctgtttgatccctccttcatggcattgctacaatttgggacaggatcatagtcagaataattggaagcgcttgccattcccccatcaaataccttatggccagtttgcttatttaagtgtgccaggaagccatactacatgtaacccttgcagagctaatattgcatttacatgcctggttcttactcagatagttttttt

SEQ ID NO: 112574 - DNA, 1115 bp, Homo sapiens
tgaacaaaacatacaaatatatagatatctctttaatatttgggcaggtttttttgctgtttttggagggggtggagaagggaaggagaatatgttttagataaggaatatttgaagattcctgttaaatcattttcagaataacaaataatctttccaaatcaaagtagtgttggtgacaatagaaaatagccacaaaacagccttacgtttttcagctgtgagtatacagcatttgtggaatttatttcttaaaaagatcagctacttctcctttcaaaatggtaattttaaaaaatcaatataatgaaaatttattggtatttataagcaatccctaagaatattgaaaattaagctgatcttcctctttatgccagcattctgccttgtgtttccacagtcttttctcccaatctaccagtatactagtcattttgaaattttgatagaaaatatcttttgatagaaggtatttattgttagtgtatgtattaaaattttgaggtcagtgaatcaaacagtcattcattgtttaggaaagatttgtggccagaataaatgttggtctgggtaaagtgtaggaaagaggtgtggtcaggaaacagttaccttaccctgttatctgttgctttgctttattctgttaaatattaggatgtatttattttaggcatgttttcttgagatattctgcagtttgcacaattccagaagcttttcagctgtaaccacaagactatgtaaattttttttttagggtccaaccgaagtgagttacaatctttggtttttaatacctaacagctgtttttaatgtgtcggagatcaaaaacactaaccggaagacagcctctcttcttcacccctaaccacacttctgccttcttgctctttaactctgtccttagcagggctgagtgtttgtgtcactaacatccacagtgatagattttcatctagggtgtcaggagcatggtgaccatttgtgtttgggcttaggatgggagcatccccttggcatcctgcttcttgaatttccattacaaacaattgcttgtttactgcatctgcttcccaaaagtgttaggactggaaaaacacctggggtgggg

SEQ ID NO: 112575 - DNA, 1151 bp, Homo sapiens
tacttgaggcttttcatgggtggtaaagtttaacctttaaaacagtatgtaaaattttacattaagcgcacgtgtgtatttttctgagaagagggtccctggctttcatcaccttgtcaaagggattcatgacctctaaaaaagtaaagaactctttgcctgggctgtaaaagacaattctaaaaggggcctttaagtttttaatcttagatcaggctccctggaaacacacctcgaagagacttgagtgttggcttatggggagcgctcttagaatgcacctccaggaagctgagaaaggcggggtcaggtgatccacaacgtggttgctgtgaggcagctgcattgccccagaagagaggatttggataggatatcccagtacccactcaactttccttctagtatttctaatccatctagcaaaccaagaaagcaggcaagtgactgagggcatgtagtctgtcttgaactgtgaggcctattgattctatcaagcctcacatcactgccatctttgtcacaacaccagatggaaggctctggttatatccttccctctgctcactctcaaatagctgcttctcccccgaccttgtcatcagctacttccctcctttccagtcctttgatttttgtcctctgaaatccttttcgtctctgtgccaggcattgagatggaagcttgcatagagagacaaatgtggtttttgaataaatgcactaatgaatgtatttacttgcaatatgttctctatattttaagagagactttgcagagcagaagagaacaggagatgggagcccttggcacactatgctgttgtttacgtctctgtccgtgccttcccccacccaagtagataagaatagtggtctcattgttgtagttttcccttaaggtacttaacccagttccataatactatttttccctctctttaaatttgtatttgcattttttcttgatcagtcttgagagagatatggcaatcttattaaaaacttcaaagacagccaggtacagtggcccatgcctgttaatcctagcacttcgggaggctgatacagaaagatcactgagacctgtagttaaagatcagcctgggcaacatagcgagacgcccatctctacaaatttttttttttta

SEQ ID NO: 112576 - DNA, 1039 bp, Homo sapiens
aaatgacaaggaaagagaagggaaggttgaagaagggaaggttcttgaaggtccctggtccttgaaggtcccttaaccataaatgtcaagagttgggatttaaacccaggtctaacgccagagctggcgccctttagattaaaagtgcagtgtccatgacaacgaaagaagttgattttgtcccacctttgctctttgcggcttttcatttgcgtttgtttccacagcgatttccaatagatttctgcgtggccttgacacagacagctagtgtgaatccccgcccacagaggggcggcacgttggttgccgtacaacgtggtggttccctgcatctctgcccacgtcggagaggtgcgtcggcttccgtacaacacggatactctctctctgacgcaacttcctgtcctgcgcaattctatttgacctttgaactggcaaaggcttttttcttcctcttccggggacgttgtctgcaggtatggatgttgttctcttttccctgtctttatttccttaccaatcggctgccatccgaggagctgaggaagcctagagctctcagaagcagtcctttgagctggtgtaggggtaaggggcacaacagggaggttggtggtgaggaagttccttactttgatctttggaaatcccttgttcctggtggcacctccaaagccgtgagtagccacagctcaccacccgggactttgctgcattccaagtgtagcgtttggagactaacgagttgtggtttggcggtttgagtctggaaaatcgccaaacgttttcatattttacacccacgttttcacagcacgcctgtacgtgtccttagtctttgggagggcagggtccggcgagttcgggtggtttcgctatttggcttctgcgtccaaggcccatgtcaaggaagagaaaaatgtgttagaagtttctgtcttgcttttggagatgcaaacagaataatggcttcataaatcactcgcactggttttacgtgtcaagttttggtgtctggtaattctgttttagttta

SEQ ID NO: 112577 - DNA, 1203 bp, Homo sapiens
gacagaattcccatgttagagataaggaggctagctccttgccctttatattcccagtaaatggcatagctaaggattcgacttcagagctcactttttgtgctctttgtttaaagcggtgtttctccaactgggctcgtggcacttttctggacaccactccaaacaaaattagactctgagtaaggagcctggtcatcagaacgttaaggaagtgccacgtttgattaccatcaggaaagctaacattcttggcctcttgtttatcagtcacctttaaatacaagtagttttaaaatgtggaataatacatcttaatttaagggtgttacatacaaggatatgtatgtgaatgaaatagaccacatgatactgttttgagattttatttacttttacaatggaaagatttgatgttactctattcttaatttaggcactcagaatggtccagcgtttgacataccgacgtaggctttcctacaatacagcctctaacaaaactaggctgtaagtatttctgaaaattttaagtatatattgtcatttactctacaaaatgctgacctactgactgtttcactttctaggtcccgaacccctggtaatagaattgtttacctttataccaagaaggttgggaaagcaccaaaatctgcatgtggtgtgtgcccaggcagacttcgaggggtaagtgtaccttttactgtgtgcagcctaacaagtcttgaacttactgagctttcatcccttgacgatggaatgaatcaaggagaggttaccactaagagggttcagaattactaaacattcatgagccaaatctgccacgaacatagactttttaaaccaatctgagaaatgcagtgaaatgcctttcagataaatgagtacaccatttccctttgtaacctactttaaacttgcccttaacacttaacaaaatttagggaaatttctgttaaagcatcacaaaaatcttaatatttttcttatgcaggttcgtgctgtaagacctaaagttcttatgagattgtccaaaacaaagaaacatgtcagcagggcctatggtggttccatgtgtgctaaatgtgttcgtgacaggtaagttaaatgcttaaatgggctttccttagcaaattattgtgtgtgttatactgtctgctgatcagtacaatggtgaagcaactcattttaaaccag

SEQ ID NO: 112578 - DNA, 1196 bp, Homo sapiens
aaatctaataatatatacctccccaaagcctcaccatcccattggaagttagtactccaacatataaattttgagggggatgcaaacattcagtccctaacattttctaaattaaaggataagatccgcaataattctggatgaaaagatgcttttgggtttccaaaatattagctattcaataatttttaataaatcttaaatgtttctggttaacctgaaggattatgtaagtatttttgccaaacatttacattcttttataattgctttagctttcattcatttactcgataaatatttattagaaactaccatgtaccagaaactatgatgctggataattgttaatacagtagtcaacaaagcagatgagactcttcccttggcctcatggcacacaggagagacaatgttaaatggggaacatataaatacatttgttgttgtacacactgggattagactcacaaaaagaaagtccacagtgctgtgaaacgatgtggaaagggaacctcatgggggagttaagggaggctttttctgagaaagtgatgtttaagcccacaacaaagataagtaggtgttgtctgggtgacaaaaagggagaatactctggacatagaaaccaacatgtgcaaatgccgtaagtcaagaaatcgtttttatgaaaaacaaaatcaattcaggcaatccaattcactctcaatatttaaaggccaataaacctgaaaagtgtgaactaattgttaatcactaagaaggaacatccctgtcagcacatagatttactatacctgtgtggccccagggctacttttcatcctaagggacaccagcaaaagaaaagctttcctaaactgttttagttaggagcaaataaatcctcctctacattaggggatatttaaattatgcaatcccctagataatttaggcaccaaccacctaccattaaggaggaaaaggatcaaatttactgaccaaattcccttgatattcattcagcttctatattccttggcctgtgcaaatagcctgaagactttactctctcaactctctctcattctagggttgaaaataagcttacagcttgacttgcctaaagaacaaatggtcttgaagaaaattcacgtgtttattgcatcttagtgtaagtcataaaagatgtcacaggccatagggtctctctt

SEQ ID NO: 112579 - DNA, 1780 bp, Homo sapiens
ttcttattattaccacgactacatcgggaagtaaaagctcagcagcctccggcttttcctaacccttgaaaaaacctctaatataaaaggcatttatatccaaaagttcccattcatctcccgctctgggaaccgggagcgccccctgtccaatcagctttcaaatcccctgcgtcagcgagtgggcggggctcacctagattccttggcctccgcttctccggcttggccacgttagaagtcccgcaggtccttgaaggtacacaaatcacctatatatccattagaaaaatgtagagtacattatcacaatgtaagtttaattagattaaataatttacaacactttattcatatcatttatttgttttatttagtttcttattttcttctatgagtatagtaaccacctccgagctttacggatctgcgggtcctttcctcgcgcacgcgcacttgttagggagggcgggcctgtttccgggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggtaactcgggctgtcgggcccgagaggctgaggagcggagaactgacccgccccgggaggcgcgtctgttccgctgactctcagccccgggggaagcatagctctgctttggatcttttctgagggtggaggggagttctggggtccgaagtgttaacgtccaagtttattcgccttcacgccctgtcttaagagaattcgtgttctcactcccattgcctttcttctccttctagccctcccatcccagggatccgagtcaaatatatttttcaaggccaaattgttgctctttttgttgcttgccatacgttgtttgataaatgtcctgggaaagcctaatttggcaaactccgtttccatggttggttgtttgataaaggtcctgggaaggtctaatttggccaactccgcttccatggttggtcaagagcttgtgggacttttaaacttatctttgtcctggaatcttggaagagacttgacaatctttagttttgttggctcaaacctagggttctgtgttgccttttgcatgacctacaataaatatcaatggaattttctgaaatcacaggtttgataaatatttgagattggagatgagatttgcagacgatactgtatttcagtgggcagaagttgagaattaaaaaaataagataaatagcattactattaaacgcttctgaattgtctatcatcttattctgtccttttcaaatagaaaattgcaaaggggcgttgccttatgtactggtgagttggcaatccggctagtcttttcagagccactaccctttcaggccacagttccaagatttacttagaactgtgctactgtgtacatttagatttggggaagtggtgtacttaacttggaaattataaaattaatttagattttgggaagtggtgtacttaacctggaaattataaaattaaagctacggatttgggatagcaaaagtagttctacttttaagggagtggccatataattgttattttcatagatgttttgtgagaatagttggcactgaagggggaggattcaaactgagagagctgagttctagaaagcacctttgaatttacctccttccccca

SEQ ID NO: 112580 - DNA, 1077 bp, Homo sapiens
taattctaaaacattgagttgaatgtctgaatgatttatcagaactttagatgagttgggccacatttggttataataatacaatcaaagcattcctatttaaaagtaaatgaaacttggccgggtgcagtggctcacacctgtaatcccagcactttgggagactgaggcaggtggatcacctgaggtcaggagttcgagaccagcctgaccaatatggtgaaatcccgtctctactaaaaatacaaaaattagctgggcatggtggtgggcgcctgtagtcccagctacttgggaggctgaggcaggagaattgcttcaacttgggtggcggagtttggcagtaagccaagtggcgccactgcactctcaacctgggcgacagagtgagactctgtctcaaaaaaagtaaatgaaccttaagagacaatgaaaactataatcctgttttcaaaaattagtaatacaatctaatctgttctgttgtctttcttataggaataatttatgatgttattgttgaacctccaagtgtcggttctatgactgatgaacatgggcatcagaggccagtagctttcttggcctacaggtaaaagatacctttttgaatgatttggtggtgggaaagaaggttgctgtggtatgcccacttatttaaaaatagagtaaaacctatgggatccatgtgtatttagacaacagctgttttaaaatgctggattctgaaatggcagaaagtgagtcaaaaacaagagtatattatttatttattaagaaataaagtatttcataatgatgtatcaccaatttacagtagggtgtcagtttaaactacatttatagattgttctgggggtcagtgaactatagctgctttttttttcttttccccaaaaaagttttattggaagtaagtatgcccatgtgttttatatgatctatggctgcttttaagctagagtggctgagctgaataagtatgacacaaaccatataccccacaagcctaagatatttactatatgggtatttaagaaaatatttttggactataccctggtctataccattaaa

SEQ ID NO: 112581 - DNA, 1088 bp, Homo sapiens
aagactcaatctcaaaaaaaaaaaaaagctaagctaaagttctgggtaaagcgttcgtatacataaaatatgagtatttattttacataaacagttgtgttagttgaggttttacgacattttttgaatgtgaactccatgaagacaaagatttttgtctgttttattcattgttgtatatcccccagaacctaaaacagtgcttgctacctaatagactcaataaatatctgttgaatggacagatgaatatccagaggtatagtaaaatagttgtaaggctaagaataagaaatatagcacaaaaatgttttggcacaaaaacggaaataggaatttcaatttaagggaaacatttctatttgttatctttctatggtcattcttttcttttccagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgtaagttatttgtgtaatcagcaccttatgttgcaaattggtaaaatgattacctggaaaatgtaaagtcataggacatttaatttaactttcatttacatgggtgaaaaatccagaaaccaaatatatttgtaacttggtcaggttacagctatagttaataaaaattgaaactaatagatcttcttagttgttatccccatgaatgttcatgagagaaaatttagttactttgtcctggcatcaatgactgaagatagtcattgtttcttttttttttttttttttttttttttttttgagacggagtttcgctcttgttgcccaggctggaaatgcaatggcacaatcttggctcactgcaacctctgcctcccgggctcaagtgatgctcctgcctcagccttctgagtagccaggattacaggcatgcaccacagcactcagctattttttgtatttttagtagaggtggggtttcacaatgttgac

SEQ ID NO: 112582 - DNA, 1075 bp, Homo sapiens
tccaaagaaccttttaatttttaatttttttttttttgtgggggacggagtctggctctgttgccaggctggagtgcggtggcatgatctcggttcactgcaatctccgcctcccaggttcaagtgattctcctgcctcggcgtcctgagtagctgggactacaggcatgcactaccacacccaggtaatttttgtatttttagtagagacggggtttcactgtgttggccaggatggtttcaatctcttgacctcgtgatccgcctgcctcagcctcccaaagtgctgggattacaggcgtgagccactgtgcccagccaaacctttttatttttaaatttttgttcagttttggatttgggaggaggtgagaagtatctggttgtcaaggtggttgtgttagatgaaagttctctttactcagagtgtgtggattggccaggctgatacagcagaaagaagagtgtgtgagttctaggttgattgcattggctgaacataagtctaatcatacagggagtcaagtgagttcagaagctgaaagggagggaagtcacatttttgagtgtttgctgtgtgccaagcactggaggagacctcagtattgtcaagtagtttttaaatcttacgttaccagtgaagaaacttgggactctaaaaatagcagctaacatttgtgaagtgcatgtaactacgagtagcaattactatatgagtagattctcttataatccttaaaaccctttgaggtaactccattttacagatgaggaaactgagtgaggtttgccaggctcatgcagtaagtggtagaagcagggtcaaaagaagaggcgttctgaagccgtcagtgagtataaggtgttgtaaaccttttttttttttttttttttgagacggattcttgcactgttgcccaggctggagcacggggtttcaccatgttagccaggatgttttgtgttttgttttgttttgttttgttttttcttttttttttttttgagatggagtttcactctgtttgcccaggctggagtgcaatggcacaatcttggctcactgcaacctcca

SEQ ID NO: 112583 - DNA, 1466 bp, Homo sapiens
aacatggtgaaaacctgtctctataaaaatacaaaagttagccaggtgtggtggcacgcgcctgtaatcccagctacttgggaggctgaggcaggagaaccacttgaacccgggaggcggaggttgcagtgagctgagatcacaccattgcactccagcctgggtgacaagagcaaaactccatctcaaaaaaaaaaaggaaaaagagggaaggatagtagaactgaggctcagtaatttatttgtatattggggtgaggggggcaaaatatgaaataaggaccataataaagaatcacgcaattatatttttggattgttatttgatatatcataaaatttgttttggcattttgaaatactatgataataagagaatataaaaacaattcttttcactttttgtgcttataattatatttctgcaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaataccttttatatttgttttttaactgacagtgttaagtttttggtctattaatcattcattcccacccatcttatgactttctttagctacttttggtagcctaagatttcaaaatatggttggcaggatgccttgagagttagcatctttatatccttgtaaatattcaagcacaggctgcatatctatgtcagagttgtcaatgtgaatgtgctagatgagcacatgtagaaacatctctggggccgggcgtggtggctcacacctgtaatcccagcactttgggaggccgaggcgggcggatcatgaggtcaggagatcgagaccatcctggccaacacggtgaaaccctgtctctactaaaaatacgaacaaacaaaaacatctctggaccaatctggtcttaatttcttctatccaggccttttggttctccctggctggccatgggcttcacttctct

SEQ ID NO: 112584 - DNA, 1043 bp, Homo sapiens
ctgaacagcaaagcagacagcaggagaagaatcaaacaaggtacatgctgggatggagaggtcaccttttctcccttttctcctagatcacccttctcaccccgtggaccagggaagccctgtaagataaaaagcaaaccaaaaagatctattggtgtaatagtggcaaaatcatatagaaacaaatattttaggattttacatttctgagcttaaatataacaagaaatggctcaccagtgttaagacttagataataaagcagtgcttagaaacataagttttctaatgtctcaattatctatacacaacaggtttcttgctttttcttttaagaaatacagagtagaaagaataccagaatactagtttgaattctggcaagttcactgatttgtgcagatttgggcaaatcacttacctctctgcactttagtccgttgactgtaaaatggggttaatgatatctaccagacagctgttgtgaatgttaaatgtgatgatgtactacaaagtaccagaatgatgcctgcccataacaggtgctcataaacagtaactagtattacttttggtattctcattattcaggtaatacaggatgagcagtgattgtgtctagaggcatttacttttgacattctctattttcacagaatcatattagcataagatatatagggactaaatgttaaaaggaaaaaaatattgcataactgctttgagaaaaaaacataatatatcattctgtaaggatagcatgtgagaagtatattgattttatgcatatttttcataaataggtcatgctgatgttaagagtaccctcaatttgggaaagtattttgaagtgccactatccactaccagttattaattttatacaagataattgtgtttttttgcttttctgttttatctcatgcaaacactagtgtattttatattgctgtttacatgcacagcaatatatgttctatgcatacctatatgcacagaaaaaaaagaagtattctttttgttatcgatgatggagaccatca

SEQ ID NO: 112585 - DNA, 1095 bp, Homo sapiens
gtctaaaaggtctttagcttttatctagaaaagacaacgtgcttgagaaagttcctttagttttttgtttcagttgacattgacacactgggtcagacttgtcccaaagcaccatgtctaaatggcttcctttatgtggttctaattgggattctttctcaggaggtcaaattagagctcctgcagttggagctacagcaccggcagttgacagcatcagctcagttctgcctcttgagacatgtaagacagccacttagagtttgttcctacagtcctttgacaaatggccctactctgactgtgtacctaatagacagtttttgtttttcttatggatctgtgccaaaaacagggtttttccttaagcaccttacttctgctttgttctctttgctttgccttttgtttgctatgattcagtttgtccaaaagcattggctaattttcttgtttatgaatcatatctggcctacttacataatggtgcctggtttaaccaaattcattctatgtgagtgaacaaaacggaactttggacatctgaattgctctgttggtccgtggatgaagataatgcatgatagattagtctgtgataatttattttgaacatcatagcaataaaaattagttgattagctatgacaggatatgatctaagattcattcattcattgattactttctatgtagcaagacctctgaagagatatgtttagtgcgttacttttaacctatctctctagcattttgttatacaggctttctaggataccattttgggtagctttgaaacagggagcttttataaagattttaaattgcctcatacatctgagtttagttactggaatttaagtaccttacggtgtcctttaaaaaccctgttgttttaaagcccaagaagtaatttatgactgtaaaagtgggagtgataaattggagaccaaagtatgtattgctttttcccaacagcctgggggataacagaggaggtcagacaacttaagtctgtttctctttcttgggtctgtagcgttcttgtagaagaaggagaggaattgtttctgaatagtagaagcaacagtgcca

SEQ ID NO: 112586 - DNA, 1048 bp, Homo sapiens
gtggaataacaatgtctttgatattggtttactcgtttataaatggaagcagcctaactaatagagttgctatgagcactaaaagtctatggaaagatagaacaccgtagtcccctgacaagtttcatttgctccttttgttccttttcttcctatccaagtatttctttttagttcaagttgctttcctgatgggaactctgcctaccttaagagaagtagtcatgattttcttttgcttaccagatgttaaactgtacatgatcatctttcatagatgaatagcacagtaattatctttctgttttaagcatggaatgagttaatactctaaaaatataagataagaactacaaagagatgtaataataaactggttttatgtgaaattacatttcagattgagggtgaaaatttatcttcacattggattcttaagtgcagcatgaagacaagttgtgggaacatgatatatgaaatataaaatcttccaaaccccttacatatctagaaattttatttgtacagatgttatgaatgatataatgatcttttatgtagcaattaggctaggaatttcatttgattgaacagatactattgtgaaaagtacttatctcagcaaaatactgactcatatggaatgacacaaaccacctttttctgtagatagatgagcctagataaaattgttaaggggaacttgtcagtgtggtcaaattagttaagttcttgttaggggattagaagtgacccagagaagacttttccctgattcagttaaccttcttagattccagttacctcaaagataaaatattaaaaataatcacagaatatagactagaaggaggtttaggtatgatctagaacaaccaccttgttttacagaggaagaaactcagacctaaagatttaaaagaagttaccaagacgcctataatgacagtggcaagtcagaggtcaacttaggtctttttaatacccggtattttcactgttttgccacaaaagctccatgagtgttaacattatgtcaaccaaacac

SEQ ID NO: 112587 - DNA, 1056 bp, Homo sapiens
gatccacctgcctcagcctcccaaagtgctaggattacaggcatgagccaccatgcccacccttgatttttaactttaaaaaaatttacaaaaatgcactttataacaagttgaatgagaatttactgaaaataccacttacaataaaaacattgttagaattctgagaggaattttttcctgcaaattctttgaaaaagtttagtgtgatactataaaattatacacttttttcctcaggttcttaacccccatcttaaaatttgaagtaagaaggaaatcattggtatgaaaaatcactgtggtgttcagggttgaagtttttgatgtaaagaactccctggaaagatgctgggcaaatttctcttctgcatagttcatagcaggtgactgacactcaataacatttaatataatgaattacagaggctttgaaaatttaggcctccaaagagcaaatccaagatggtagataggattttcacattactgtgaagacagggtggatgttgacatagttggtcttctgggagtgcttcatcacctaagtgaaagaaccatattcacctaatttattttaccaagggaaagactatttattctctttattagctgcttatttaaggtcaaagagaaaagaaggccaaaggaaatatgtaatatagttttcagctaggtgaagtagaatttagtacactataaaattgggcattttctcttccagcttcctttaaccaagaaccttattttattgaccttcattaaatttacattttagttttgcttttctacattactaggaaatttgcagctaagtatttttgtgtaacaataataataaaaaagaaaaatagcattatattcaaaactgatgcaaaaagaatcttgattattttccattgaggcagcagtggtgtagccagtggaaggggctcaggctttggaaccagacagacctggccctaattctggctcagctatttacccactctctgggcttggcaaattactaaaatccttccagtctcagtttcctgatccataaaactgaaaggc

SEQ ID NO: 112588 - DNA, 1051 bp, Homo sapiens
cgggccgggaagggcgttcggggccaggcccggcccgagggacgggagcgggcgcggtgcggaggccgcggggtccgggttgggtgcgggtagggggcagggaaggcacggcgcggggcgcgcgggggtgggacgcccctggcgtgggggcgggggccggcctgggaaagctggggccgtggctgtttatgtaatgcgaccccaggcccgaaacggcctcgggcgagtaggggcgactgaaaagctgggagcccacgtagtaaaacccagttacctagcctggacgcgggcgagttgccccgagcgaccccttggctgcgagagctggccagaagccgaggccgctgagtgcgtggtccggagaaggctggtgcagccacccagcagggtggattgtgcccttcctgtctcaggaaaattgcttcggttcccgaggcccagcgaacacgctgccttgaggaaacttaagtttgcactcaagtttgtagacaaaagggtgtaaatatgctatataagtgtaactgtaaccctgacccagttcggcctcaagaactgtcattgccgctgcggctgctgctcaagcttttggagtttgcttgtagtgtttgaaagggagcagatgtaaacggatttaaacgaacatctttagatctgggtgtttttcctagctccactttcagagatgaaaaaacgtgccagagttggccctgctttgaggcagggccttcatacaggcagcagccaaatgcagcacgaaagccgctttcatattaaggtcgtgggcttttagtaggctgcaaaatgatggatatgcattccctaatgctgagatttggaatgttcgcggataggggccaagggtggaggaattctccttacagacttcttagtatgtcagatgagaaccttggaaagtaattgactgaatttagaaaaatacctctgtcctgtgttggtacgagaaccaaactgcattagtactctccagatgattgacctgttttatctaatttcctaatgaaaatctgctggactttatgaattagtttaa

SEQ ID NO: 112589 - DNA, 1193 bp, Homo sapiens
atcatagacatatgctgtagactttcaccatccagtgtggtggccactagctgtacatggctgttgagtacttgacatatggttgatcagattgagaagtgctataagtgtaaaatacataatgatttttgaagaaatagtacaaaaaagcaaaatatctcagtaatttaaaaatactgaatacatgttaaaaatgatttacatttgtctttattaactttaattactttcagatacttttttatacattgggaacatttaggtcttgatataaagtatgaaatagtaagcatccacatatgattagatatattagatattcccaccccccatgttttcctggagtaagtacctttctttgataggctagaaagtaaatagacttattctggtgggcaactcacttctgataaatttcagcagctaggacattcctgttatttttaaaagaatgacatttgaatagttgggacataatgattatttctcgtttcagatcatgtagcatggatatgccagatcagtcactaagtgggtagatatttgaacagatttctctaaatctgacttggctcttcattgataaattctactagtgtagagttttctgacactacagtgaaaggtagcagatccatcttttaatatatttaaataggagaaaggaggacaacattttacttttgtcgtgttaatgaaagatcctaacagactttatttccttaagtaaataaattctttcagatgaattattaccatctaaaataatctaagaaaagtaaattatacacctagtaaaatagcgttatcagtattttggttttctgtatacttcttggaattataggaggaatgtagatgatatttttcccttacagcttgactgtgtaagttatttttatgctggccgtagaatatatattacatgaccagaaatgaagattccattacattacttagtacaaattgaaaacaattagaaaatgtatgctttattcttatctcttttataaacaagtattttaatacattattatggcaaggagtgtagtggtacttcctttgtgtacttgtgtcagtggagctaaaacatcttgtcaattttctattaaattatcctttgatttgagatatggcacagatacctgtttccttccacaagacagaaaaattagattccaagataattaaga

SEQ ID NO: 112590 - DNA, 1345 bp, Homo sapiens
tccactgttttatcaggatcctcaggatcctcatcaacaagaacacctcccactgcaaatcacccagttgagcctgtgacctcagttacacagccatcagagctattacaacaaaaaggtatttgagatatttattattgtatatgcacacagacacacatacgtatttatagaagatatgaaaaaaagttacttataatctcaatccaaacacaacttttggaatattaacttacagtgtctcatatatgttttacataattacataccattttgtattttgcttttctttttattacacatagttcttcatatatattgagtctttattgctctttttatggctaattattcattgtgtcaatgtataatggttatttcattcctctgtcatgggacatttatttcctattttttaaaggttattatagtttcttttaggatagagaagccaaaactttattatttagtgactctccatatcctatttgattatttctgtgctttttgttattgataacagaaagtaagctttgacagaattttgcaaatgaaagggggtgaaaatgaaattgtaacccatactcttgcgtcattgaagaactatatgatttattgtttgtttaatattctccatgtgttaagtaagtaaaaggtaataaaatgtgttgttttgaccctgcttccccacattgtttcttttggcagtttttgtttttgtttttgtttttcctgtctggctaaaattccaaagtattgatgtttcaggttaatatatggcattttttatttgatcagagatgattgaactgttttcaagaatctgtagtttgtatttccagagcaaccattgtattattttagggactgtactcactatgtaatgacagctcctaacgttgagtgtgaagaaccttcttataggtctgaaactgagaaaaggaaaaaagcatgataaattcctagggtgatctcattgcttgtatctgttgagtgtctatgtgatcaacagagacctttctgtcaattgatcagatgatacattacacattttcttacttggttttttaggaaaagtaactgcagcaccaaagagtgcctgttgattctcaacaaaccagtgggtatactggaaactgaatttagttcttaaaagtatttgccttcaaagtgaaggtccagtagaagttttgtttatcacaaatcaaaaaagcttttaggatagatcaaagccctaactaaatgaatggtgtcttttcttgtttttcctctacattgatgactgccttccatttcttaaatgtttcgctttttttggcctattacattgcccctgctgcttatt

SEQ ID NO: 112591 - DNA, 1064 bp, Homo sapiens
ctatcatctttttataaataatattttgtaaatggtttgcccactaaacaattgcaattatgtttcttcttttttctattaaaatatattttgaaagtagaagaagctgccatttattgagcacatacaatatatcagatactttatatctcattaattcacatattaatcttatgacatagatattcttccttttttacagatgagaaaagtgagattgacagaggttaggtaacttgcccaagactacaagttaataagtagcaaagcaaaagattttttaactcagatctctctatcttgtattctttctataaaataaagctgaatttttgttgtcattggctgttgacaaactaactcttggtttacctaagataagtttcttgcttaagtaacagaaaatatcatactggggacatctgaattgtagtttttattgttcctttttcataagtaggagaatggcctcttagtgacttctttgtctttggagagatctgagctatacaacctaattgagtcagggctaccacatatggtggtgcgaattgtcatttgcatgaatggagcttcttcgaattgtgcagtgtatcatctgcatagggtttactgtgggcctgatatgaactactaaagtgattatacttaaaaagagattagcttttttcttccaaattcaaagacaccgttgcttagttgttctcccaagactaagcattttttttctgtttttaggggagacatcaaatttttgtttgggtagcccctaaaattttttttataaactacctacttgaacattttttagattgatatctaaaatttttcatcaaaaatttaaatacttgtagttatgcagtttttaacatatatgctggctgacttttaaaactgagatgttacattattctttcaaatgtaccctttggaatgatacctaccatcgtccttttgcaaaacacacaaataccccttctttaacatttgggaagtttacatttttcatttttctatttgatggcatatcccctttccttaatgtaataataaaatatatgctt

SEQ ID NO: 112592 - DNA, 1096 bp, Homo sapiens
tccatgtacatacatttctacagtgggtttcaggctgagctctgggaaaggatgtcatattttaccaccttatatatttgatctgtgtatctcatacatagattttggctcttaaagagaatctgaattagaggcacttcaggaagcattcacatatcctagaatagatgacttggctatcaaccccttgccggctgtagctccccatttgttgtagtctgtatgtgctatacccaacctagagcagggcgccatgcctggctaattttttttttttactttttacagagatggggtctcactatgttgcccaggctggtcttgaactcctggcttcaagtgatactcctgcctgagcctcccaaagtgctgggattatagacatgagcaattgtacttggctcaaatttttgttttaattgggctttttgtcagaagaatgtgccactctgaatttgtttttgatattgtttcttgtattacttgaacctattttacatttatttttattttctcatgaagtgctgggattatagacatgagcaattgtgcttggctcaaatattcgttttaattgggctttttgtcagaagaatgtgccactctgaatttgtttttggtattaagtttgtttcttgcattacctgaacctattttacattgattttattttattttatttacatcgatttttattttattgatttttattttatttacattgatttgaatttgggatactgctattttaccgatattaaaagatgtttcagcaaagctagcagatttttccatgactttttttagtcattgttgaaagatcaaagcttcattcatctacagtttaacctttgcttctaaactaaaattttattcttaatagtttttttcttactctagtgatgagttgtttatccatgctaatcaagtatgctagtcacctgaaaaaaaaataaagagagcattaaagcactatcgtgtgattttggtgaggcagggcttcattgtaccccaatattaggaaatgttcttaaaaatccccactatgtttctggctttcttttttctttttttttcaaagtagagccatgagatt

SEQ ID NO: 112593 - DNA, 1315 bp, Homo sapiens
tctactgttagcagagaactatgccgaatacagtttttttctttaactgtgattcttcttctgttatgggaactgagtttaccatcaaggtaacattagcagaaggaaggggtaccacgtatgtgttttgtatgctgtacaaaatcagttcactataaatgatcactgcccaccaaaaatgcacaatcccaaaggaaatataccacagggccataaggtcaaaggagataaacatgtatagagctcagtaaacttttcagacaatattattgcagcttcctaaatactaactgttttggacaatacatgatagataccttttcacacttaagccagtccatattaaagctgcttttactaaactgctttgcagagattttctaatggttctagttttgataatgaatttgctaatattaatatgcatgttgggatgttctttggaatgtcagagttctttctcacttttaatgcaatgtcaaatttttatttctcatctttcctgttggtttgactcttatgtttgtgctttccactttacaggcgtgcagtatggtgaatatgttaataaccaagctagctccgcaccaactcccttgtcatcaacttccgatgatgaggaagaggaggaggaggatgaggaagcaggtctgctttagctttacaccagttcttgatcttttcctgctcaagttttctttttgtttccacagtcttacttagccttttaaaaaagagtctttgaagatttagcatgatgaacttacgaggtttgcattatagaagatgtgtcacataaaataaggtgtttgttttgtttttcctcctttaggcatctttgccatattgtaaataatagaatcagaattcctctttcatgacagtagagtgcattcttctttcagaaatgcattttctcccatgtcacatgcaaaataatgagtactgactgaagcttttggctgatgattgctctagcatcgttttaggaataatgcttcattttctgctttgcctgctactttagtctaatcaaaataagccatgtggattttataatagggatagagaaataggacagtgtttcagtgaggtccttttggcttttcttgtcatgtatttagaaggcccagaatttgtagttattttcctgcttcatgaaatagtacatatcttgctagctgaagaagttgtgcatatggttatgtgttgcaaactgtttaatatctttttctgcctttgataggtagaacactgctaaaaaattaagcagttcagttcctccattaattctaatacaggttgaatatccctt

SEQ ID NO: 112594 - DNA, 1032 bp, Homo sapiens
gtgacttgtcatatgaggtcaggtgtggaattttccacttgtggtgtcatgtcagccctcataaaattttggattttgaagcatttaagattttggattttcacattagggactctcaacctatagtttaagactgaaccaataactgatgatctttcaagttattatatgtgaccacaattctcctgttctaaatgtgaagatctgttctgcaaacaatcattttaaccaaaaatttctatttcctgtgcatttaaaaatatttaaatcattatatgcgactcgggataaaaattgggggtgacaggtgggaaataatttttcttactctaaatacgtaagtacccatctatgtttctgaaattttttttgtaattttaaattttaacaaaatttcaaactcacagaagttaaaagaaacccgcatgtacgctttacccagataaaccatttttgccacatttgctttataattctctatcaacatatttttgctataccatttgcaagtaaattggagacatcatgaactttacccctaatactttatgtttcctaatcataaggtcagtgtcttaaataaccaaaatacagttatcaagaaatagagcattgatgcaataatatctgataacactgttcattgtcaaatatcagttgtctgaagtagatcagctataaagctgttttcatggtccaggatccaatttggatcatgcgttgaatttagttgtcatgttagactcctttagtctccaacagttcattagcctctttccttgcctttacattttcaaagagtacagaccagttattttgtaaaatgttccccagtgtgggtttatctgaggtttcctcatgattagattcagaccatgcatttttcggaggattaccactaaaacaatgttgtgttctcagtgcatcctatttgaggcacatgatgtcaatttgttctcatattgatgaggttaacttttattatttgaataaggtggtatctgccaggtttctccactataaagttactgt

SEQ ID NO: 112595 - DNA, 1051 bp, Homo sapiens
taggtgttattatgaaatctgttgttactaatgaggagcagctcagagatgtcaggtgtccattttccctcaactgttagggagtggacatggagtttgagttatagccttttcatgttttgtgcaggttatgaggaaatctcaaattatctggctaatttcaagtttagcaatactagtaagtatattgcctttgttgacccatattgcttgtcttttagagacagaaaacagcttaagcctttttttaaaggcttaattgctttctgatactcttctctagcttcaaggattctgagctattcttctgatctgttctcctcgttacttctttagatttcagctccctctctttttctctttccttttttcttctttcaagctgtaacatagagccagtagaagaatgagagaaaattatttccaagtactgcatttcatacttgacccccatttgatctcagaatacttattatcagtaattgtagtgtgaagtgactgaggcaaatcgatgctatccaaggattaagcatgggacaagtaccaaagccattgattcagtggaaaccagcttgtatgctgaaagcagtattttgcttggtatcaggattccaaagatcaatatattagcatagctctggccatcaaatacgtataatatgatagggaaacagataccatatgattacagtacaacttgaaaagtgtaagcaggcgcggtggctcacgcctgtaatcccagcactttgggaggctgagatgggcagatcacctgaggtcaggagtttgagaccagcctggctaacataacgaaaccccatatctactaaaaatacaaagattagccggccgtggtggctggcgtctgtaatcccagctgctttggaggctgaggcaggagaatcacttgaacccgggagacagaggttgcagtgagctgagatcacgccactgcactacagcctgagtgacaagagtgagactctgtctcaaaaaaaaaaaaaaaaaaagaaaagtgtattaattcaggattgagaatgtgctcctgcat

SEQ ID NO: 112596 - DNA, 1029 bp, Homo sapiens
tgtcactaacaactatgaagcttgtttctggggctattattttttgttgttataatactctttatctttttctaaaagattttcagtagcctttctcttctttccccttctttttaaagaataactactccttaaataaattttatatttctattgtcatgcttaggtctttgaatttgaattcttttcaaccagcctctgagtatagtctttgactctttgctccctcaatggcttctggctgcttctagtaggtaaatagatgctaccttcaacttgggggtaggttttggagacatcacttttaaccatatctggaaatcactttagccattacattcaagtacaggagtagatagtattgaaagaaaaaactatcatttcattttaatatactgtgatttttcttgccctcctgtctcctatcactgacaacctgacaactgtacctgatctctctctctcttttcctaatgattccaagcttcaaaactaacagaaaaagcagttttgcccttctttttatttcttatctctttgttgatgatccaggatgaagtttaattgaagttggaatgttctatacttaaaaaaaaaaaaaacccatgctatcttgctatcactattctatgaatcagtagaaaactaatcttttcagctcagtatggaattcccttgtaatattttaaaaatacttgaataaacgactcagttttttgtagttaaggatttttcccctaggaattttgtgtgtgtgtgtctgtgtgtgtaagaagttgtaaaccattccaaaaacaatctcttatcaagatcttctagaagagttgcttcatttactaaaagatgaacaaccatatagtatcccatgagctctagattaatgtgaaatgaaatgtctagtgtagtatagttgaaagattctggccctgcagtcagactttggtttctttgtattcattcagtcaacgaattctaatcttataatgaactatgtgttgagagtatttcagtaaccttggacaagttttc

SEQ ID NO: 112597 - DNA, 2266 bp, Homo sapiens
atatgtttttggaaagggctctggaaacttctttgagaaagaagagtttgatgctggagcagtttcagctcaactttgtgtatttttagcttggagtaggtcagtagtctcctctagccagtaacaaatgaccccactcctcagtgatcttagaagtctcacaggagtgaagattagtctgtggaaacatcataaatattcaccatactggtaagctgaacatccacataacttgtagctttctgttctctgaaatgctcttgacccaccttgcagactatatcttaataccctgatcagtcatccatagcagtgataatgcttcttgcttcgatgcatattctattttggcatcctgtagtatccaaagatattttaaaggcattgctaaaacaataaattacataactgaagttaacatagttggtagtacttagtaatatgcttctgtgagatgaggcatctatcttattaataaagaaagcttgacaggcagtgaaatggtaattttttctttgtattgtagcatcgacttttgaaaacagctctaacagcattttaaaagattaatgatagataaaatgtttcagtgttcataaatgtggtttttgtgtaaaattttacacattaaaatctgatttgcagtatattcaatcttttcttggaaagtacttatttgtcattctgcccttaaaatgcttaagcaagatatactattgttctaatattggaactggaagtaagttttcaccttggtcttcttctctgatatatatttgtttagatagggataatttttctgtcccctgtagaaaagcatatgtgtaattatccttggacttaaattactatttcattattttctgaaatgaaatatgttactgagcactctgaatttaaaattgtcatttttatctttaggcttcctggagattcacgaacaagaataggattcatgacctttgatagcactattcatttctacaatttacaagaaggattatcacagcctcaaatgttgattgtgtctgatatagatggtaagcagtcagtaaaataaaagcctttctaactacggactttgaaatgggggctactttattttaatatacaccttgctatatgctgtgaggataatgtcatgcactttagtatttgttcaaaataattgtttttctggaaatacttgattctaagttatgcctatgtattacacacatgtatgtataatatatacagagtgtgtatatttaataaagcaatattagctgggcgcagtggctgaagcctgtaataccagcactttgggaggctgaggtgggtggatcacctgaggtcaggagttcgagaccagcctaactaacatggagaaaccccgtctctgctaaaaatgcaaaattagctaggcgttgtggcgcatgcctgtaatcccagctactcaggaggctgaggcaggagaatcgcttgaacccgggaggtggaggttgcagtgagccgagatcatgccattgcactccagcctgggcaacaagagcaaaactccatctcaaaaaaataaataaaataaagcaaaattatagtacacattacatgtatgacctgataaaaactaagattttctaatgtattcttttgttcgatttgttgattaaaatatgtgttttccctatagatgtttttctacctacaccggatagtttacttgtgaatctatatgaaagtaaagaggtaagattgatttattttcttaaagcataaaaatatttatattgtgactggtaactaaaatatttaacatttgtttacttgatatattagtattacaaataatagacaatataaatggcatatctattgactcctcagtttccagtccccagaaatacagtgacacatgatacactatggaatgttttaaaataagattattcctttgccttctcagtaattcaatttttgatctttgttttctcagcttataaaagacttactgaatgcattaccaaacatgttcaccaatacaagagaaacacacagtgcccttggtcctgcacttcaggctgcctttaaattaatgtctccaacaggtggccgtgtgtctgtatttcagacacagttaccttccttgggtgcaggacttctgcaatccagagaagatcctaatcagagatcaagtacaaaggtattttatgtttagttttttgtcatattcaagattgtgtaattatttgtttattctatttcattaataataaaatactggcaa

SEQ ID NO: 112598 - DNA, 1062 bp, Homo sapiens
tgcctcagtttcttcgtctgaaaatgtagatgataaaaaccatatgagatgtgttatgaaaattaatttgtgtgaaacagtgctggcacataagtgttttttataaagattatctatcattattattatcatagggaatctgcaccaaatgcctagacatttagaaaactcttagtttggtagggaggcagaggatatcctttttgttataaaaatgacatgaaaatatgagcataaagattgctagctcttactatatgatctgttgacttaggtggtacaacatcttggccctgcaactgatttttataagaaacttgcattagattgctcgggacagcaaactgcagtggatttgttccttttaagttcacagtattctgatcttgcttctctaggtaaggaaagtcatcatgggtacatttgtttaaatgaacatttttaatgcataattaaatctaaactcttcagtaagcattctctatattttagggagaaaagcatgtgcattagatagacaatatctatgaaaactaccagtaaagtttaaagcactatacaaatataaaatgtcacttgtattttgtttagatagcatgattcccttaccattctgctcaacagtaaactttatcatatattttatagatattactgttttctcagatttgtatgttcttattttgatggcttaggttttctcatgacttagatttcttcataatgtagaatctgtactactgttggacaagtaaaatattattatttctatagctaatactttttgtatttctctctaaagcttgcatgtccaagtattctgcagggtgcatctattattatccatcattccactatactcacaatccttcacaagcagaaaagttacaaaaagacctaaaacggtatctcacaagaaaaattgggtttgaagctgttatgagaataaggtgtactaaaggtatgaagttgtaaaagttatattttatattaaatacttgtatcaaagtcagtgagcattccatgtattgactacctctgactgttcatgatggaagactg

SEQ ID NO: 112599 - DNA, 1363 bp, Homo sapiens
tagacttgttctgattgtcagatttatttcagaaaaaaatgtataagaagacatttgaaatgagggagctgatgaaatgcatttttccatcctaaaaacttagctgaattttgtttcttaaataatgcgtataaattttctctcttatagtgcccattggattctaatggttaaaatacctttcactttggttgctttttagctgtggatcggtccgtttcatcaagtctgtcagatgcaagagatgccttagtgaatgctgtagtggactcattgtctgcatatggctcaactgtctcaaatttacagcactctgcattgatggcgcccagctccctcaagttgtttcctctctatgttttggcccttctcaaacaggtagctttttatacattgctatatttaatattgttttttaaaattctcagatatgtacatgaagaaaggaaatctaggttgttttctaatacttaactagaggattattcactttagcattgaaagagttttgaagaatagaaaaagatcaatggggccatgcatggtggctcacgcctgtaatcccagcactttgggaggccgaggtgtgcggatcagctgatgccaggagtttgcaaccagcctggccaacatagtgaaaccccgcctctaccaaaaatacaaaaattagctggtggcacgcgcctgtaatcccagctactctgggggctgaggcaggagaattgcctgaacctgggaggtggaggttgcagtgagccaagatcatgccgctgcaccccagcctgggcaacagagcgagactccgtctcaaaaaaaaaaaaaaaaaaaaaaaaagaaaagatcagtggaaaatgaaggtatacaaatacatgatgactttagtgaaaccatattctctcttctttaatgtgtgtgagcagtttgcataatggtgcagtcatagctcactcttaatatgtcctctggaaagagactctttaaggacaggaactaatattaagcatctttccatgtctctggcaccataaaaggtgtcaatgcatcattttatttaatcctttcaacaacctaaagaggtattattttccctatttttctcatgatgacagtatagctcagaggagctaggtaacttgctccagcatcacatacctattaaatgtcagagctgagaattgaatctaggtctgtctgatttaaaggccatgctttttccatgattgacagtgtatatttgttttaatatttgtccaccatatttgtattttacttgaaaacgtttatctttttccttgtagaaagcatttagaacgggtacaagcacacggctggatgatcgtgtatatgccatgtgtcagataaa

SEQ ID NO: 112600 - DNA, 1051 bp, Homo sapiens
acaggcgtgagccaccacgcccggccaattttaaaaattttttttttttttttaagcaatggggatctttctatcttgcccaggctggtcttaaacttctgggctcaagcagtcctcccaccttagcctcttaaagtgctgagattacaggtgtgagctgccagcccagtaatttttaaaatatatactatttttagaaatatgcacttttattttatttgtataaatttacaggatacaagtgtaattttatgagctagattgcaaagtggtgaaatcagggcttttaaatacgtttagacaaatgcccttttctttcttccagagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgt

SEQ ID NO: 112601 - DNA, 1090 bp, Homo sapiens
cagcgctttgggaggccaaggtgggcagatgacttgaggtcaggtgttcatgacctgcctgaccaacatgatgaaaccccatctctgctaaaaataccaaaattagccaggggtgctggcgggcacctgtaatcccagctactcaggaggctgaagcagtagaatcgcttgaacctggaggctgaggttgcagtgagctaagatcacgccactgcactccagcctgggcaacagagtgagactccatcttaaaaaaaaaaaaaaagtaatatatatgaatcaatacactttcattagtctgtggacattaccaagtacttattctgtttgtattctaaaacaaatggtgctactttcaaaaatattcttaactagtaagtataatcttaaattgtctttcttatttacattagatatttttgcctgcacacttatagcaagaaaattttagtaacacatatcactatcccatttatttaattgactttaagattgccatcttgaattttgaaagtgattttcttctgatcaagaaacctctcattcactaacaacttatttactataaaaaactcttaaggatccattagattatgggacataattttattctgtacactatgaaagtccccatcaacaaactttggaaggaaaaagactctgccaggcatgatggctcatgcctataatcctagcactttgagggaccaaagcaagcggatggcttgagcccagaggttcgagaccagcctgggcaacatgggggaaaccctgtctctacaaaaatacaaaaaaattagccagggattgtgtgcacctgtagtcccacctactcaggaggctaaggtggaaggacatcctgagccgaggaggtcaaggtcgcaatgagctctgaccacaccaccgcactcagtctgggagatagagtgaagccctgtctcaaaaaaaaaaagaaaaaaaaagaaaaaggcttgctgtgtagtgggttatttttactgtttttgtgctttcatggatctcatttctttggataaaaataaaagtactctcacattccctgctggaaatgagaggttaaatgactcaccct

SEQ ID NO: 112602 - DNA, 2027 bp, Homo sapiens
ttagtgattatgtttttcaaataaaaagaaagttaaaacactgattaatcagtgctattttaaaagacttttatttgtctagtttaaacaattgggccaggcatggtggcccacgcctgtaatcccagcactttgggaagacaagtcaggaggactgcctgagtccaggagtttgagaccagcctgggcaacatagtgagacctcatatctactaaaaacaaacaaacaaacaaacaaacaaacaaaaatagctgggtgtggtgttgtgtgtctgtttaaaattaaaaattaaatttaaaaaatttaaattaaaaatgagctggccatggtaatgccagctactcaggaggctgaggtggaaggattactttagcccaggatgtggagactgcagtaagctatgactgcaccatgacactccactctgggtgtcagagtgagaccctgtctcaaaaaaaaaaaaaaaaaaaaattgggttaaacagttgaatgcaaacaaaaaataagatgcatgagactaaaactggaaatctgtagatatatatgtgtgtatgtaaatatgctacaggttgtgagagtttggtgatttcatctagcatacatttcagtgctcacgagggatatgcttgttgctgtgctgtaatgtgtaacataggtgaaaagagcaatgcagttgcccaacagtaatcccattttcttgttttgcagcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacatacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctg

SEQ ID NO: 112603 - DNA, 1011 bp, Homo sapiens
gaggtaggtagtgttatccccatttttcaaggaaggaaacgatggttcagaaaacagtaacttgccccaagtgagcatttagcctgactttaaaatctgtgttctgtctattatacagtattctccaaatagtctcatattatagccctgattctaatatcctaataattcatgtcaaggaagaaatctctgctgcaggtaatcttgaattcacagcctctgtatccctttgcagcttttggctaaggtaaactagctgtaaacctgaagcatagatagatttatttcctgttttctgatttaagaagaatgtgaaaccaatcatcttgtaacctcctatttaatagtcatagcctctccacttctgtggttggttgtttcttaatggcaaagtcttttggagaactttgaaaatgttaagattttgtaatgacaagtttcttccttaacatgaatattttgaaacgaaaagtatttggataactaaaagccactctgtgctatatctctgtaagtgtaacatgttaagataatctcacctggatgtttcaggtttcttagaataagaaaagtaaataaattaccttttcatagtcttcaaaaaatttaaaaacctaactggggccgggtgcggtggctcacgcctgtaatcccagcactttgggaggccttggctggtggaccacttgagcccaggagtttgagagcagcctggccaacatggtgaaaccccatctctaacaaaaaatacaaaaattagccaggcgcctatagtcccagttactcagaaggctgaggtggaagaatcacttgaacccaggaggcagaggttgcagtgaaccaagatcatgccactgcactccagcctgggtgacagagtgaggtgagaccttgtctcaaaaaaataaataaaataaataaataaataaataaataaataaaataaacctacctgactggggaaaaatacttttgatttatatgctcccatatccccaagtcaaattagga

SEQ ID NO: 112604 - DNA, 1021 bp, Homo sapiens
ttggaaggagaggccacaaacactttgagtatccaaaaatcatacttacctagcccctggagaatctttaatggacttagcctcatctttctttttttaaaacttatgttttgtgttttggacaaatggaaattttgttactgacaggtaactgtgagtgttctaacgctgcagaatagggagcagtgaggcatagctgagagagtaacatgggtgggtatgggtaagtgtaatggggagatttataacacagaaaatatttgtaggcagaaatggattttggaactatctatacagcagtcattatcatttatacctatttagtctatttgaatgcagtacttcagaggagttttgcatttcattgacagtaatccatccaaatgccttttgcagcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcagggtaaggatgatctggtggcttggggatgagtgtactttttaaagttgtatcaaatgctctatgttttagtataggatttaccaatagaaatctttcacatatattatctattgtgacacagacttcaattttctgaggtgaggagctgatgattttataatctaaaatgatttatagtcacagaagcaaaaagcattaggaaaccttgggagagtaggggtgtctaaggctgagagagagaagaattcatctaccttgtgccctaaaatatatctccagtcatcatgtaagaacctaaagtagctaaagtttgaaactctgattccagttgtcttagtccatctggactgctaccatagactgggtgacttatagacaacagaaagttatttcctacagttctggaggctgggaagtccaagatcaaggcactagcagatttggtgtctgataaggact

SEQ ID NO: 112605 - DNA, 1058 bp, Homo sapiens
tgttagggcaaagaaaactatagataaatgtatagtttctcatgatactcctgtgagaaaaactggttactatttgatgacttcacggctgcttggagagaggactcatctgtagtggacctctgtcctgattaatatctgcatcttaagtttgtgaatatctgggagcaacaggcaacactgggtgaataactctagatttaaaaactgctcagcagtcgagaatggtgaactgaaactaacaagattgaatcttatatacaatcttatatttagactcaaaattaaattgcagaagtgctaagcctctagcagtaagtattaaaaagtccattttagaaagaactgatgatttttttttttttactactgtctatgttagcagtcaggcacagctgaaacatactgtgttaggctgttttaatacaagtactttatccagcacaaaaggttaaaaagcccatcttaccctacagtgttcagtctgaggtgctgtattttaaagagatgtgacaagctagaagtcatcagtctttggaggctggctgatgaatgctcaccaagcccaaaagagactctagggcaaacagcagggtttcttaacggataatctccatttataatgaatattccaagccttccaagtcttctgttcattaattcatcacatacttattgtaaaaattcatcacaaagttattccaggcactgttctaggcattgggaatccaaaacacaaaaatgtctgctttcgaggagtttacattttcggatggggagacataataaaataggtagattagtgatatagtatgttagaaggtcatatgtgctacaaatagtatggtcagggaagacttgctgagaaggtgaatgtcttagtctgttcaggctgctgtaacaaaatgccttaaactgggtggcttataaacaatggaaatttattcctcagttctggaggctgtgaagtccaagatctagcatttggcagattcaatgtctggtaagagtccacttccttgttcatagatggcaccttctagctgtgtcctcacatg

SEQ ID NO: 112606 - DNA, 1057 bp, Homo sapiens
cttccgtcggctgtgacaggttctgaggcgcccagatctactggacatagcgcggctcagaagcctcagagacctgtccgcacagttcctgaagttagcaacaaattagtgagtgctgttgcgggccattttgcagccagagaagcaaatgcgcaaatgcgcccagccagtcagcacggacttcaagaaccaacttcattccttgcaaggtgctttagttctggccgttagggcggcaaccaaacagaaacctgccccgcctctgggagagaaggcggatccctaacgccagctatctccaagagcaacattgccgcagcacttccgggacgtcgtgctgcaaaggacgccgctgttatacgtcacttccacggctcagcgtcaggcaagttggcctctctgttgtaaattagtggttaaggttatctattattgccacttttccagcgctaaaggctgttttggaaccagtgttgcttgttccgcgggtgattggcttttttttttggcaaaccagttattcaagtttctggtctttaaaaaactctgtggcggtacggtaaccgaggaggttccagcgcggcggaagtaccccgcgggtgggtgtgtgcgcaaggccagggccagaggggcacgtggcgccggtgagtggccgtagaagccggaggatttgaaaatgctggacgtggaacccaactgccggagggagggaggaaggaaggggatgcggtgcgaagaccttgctgtctgtagggggaggagatactaatcatggggcggcaagggtggtgtgtggtcggtcggcgctcacgagaccatggagaagtaaactcttcacccatcaggttggtggtcactggctgtctgaccgtgggtgaggtgacagggctgcttttgtctcctttatggtgttctcaccgcagctccgaggggttggagtatactcagaggctacagtgatcagaagacataggtcgtttttttttcatcagggaggagagagaatgtcttttcgaggcggaggtcgtggaggctttaatcgaggtggtggaggtgg

SEQ ID NO: 112607 - DNA, 1375 bp, Homo sapiens
tgtctgtacagaaaagaaagaaatacaaagccaagtattctgactccaaagcccatgctttctgttactactcaaaagtagataagtgagaaaacaatttgcttgagagggaaactgccagagaggaaatctagaaaaacacctatttagggtagttttagagtaattaacaatgagatgggaatggaagtcacagaaagtgaaacttactacattaaagaggagagagggtgagtagtgtctaactaagaatggcttggatgagtatgcaggatggtttgaaaggagcagtttctagaataaaaggtcccagcccacaagctgttgtaccagtccatacatgagaccttgagagcctgaatcaggatggtgacagtgaggaaaaaaaaggaagggttagataggagagagatttcaaaggaaacaaaatcggtagaacttagctaatgctgataataaagggttccaggttttgagcttgggtgataggaatgaagacttggttttgcaggaatgtggtattttagtttggggtgacagtctagttagaaataaaggtagttattttgagattccagatgtccttgaaaacaatgaatcattgttaaagaggtggtagtgggaatggaaaagttctaaggcaagagaaaaaaaaaaagaatgaaggctgattctgttaggcattgaagaaaagggagaaccaagagaatgaagcagagttttgaatcagataataagttgtaataacataactgttacaggttgaatggtgtcagtgtgccaggcactgttctaagcacttgacatttgttattccattgagtgcttacattactgtatattaggtatagctatacattatatgttattagtgcatactaaaaatgagacactgaattagagagagggtgggtaacttctcctaggtcaaatagctagtgtgttgtggagttggtataccagcccaggaagtcctaagactgtggtcttctgcctcagaggagagcagttatggtgaagtcccaggtagccaaaaagaaagcttccagaagcagttggtcagtatcgtttgaaatagttctatgttttaacattttcttgtcctgtttcagtattaggagagttcctgcatccctgtgaagatgacatagtttgtaaatgtaccacagatgaaaataaggtgccttatttcaatgctcctgtttacttagaaaacaaagaacaaattggaaaagtggatgaaatatttggacaactcagagattttgtatcctttttcattggaaggcctgataatattcaaaggttgctatttgcatttttctgaggaggcagttaagtataaattaaagttgttgcttcattaaattagaca

SEQ ID NO: 112608 - DNA, 1337 bp, Homo sapiens
gccttcaggtgacaggaaagagtttagaccttagtttcaattgtgttttatttttgaataatgggataacacagttaaatgaatgcttcaaaagaatactgggaagataaaaaggcaccttgggaagcggtcaatattgtgtgagaggggccagataggaggctataatagtagttctaaaagagatggtattttggactcggtagtgacagtggaaatggaaaaaatggatttatgaaagatacaggaagtagaatcaataggacttggtaattgactagctattgaaattgaagaagtaaaaaaatcaccatctttcagatgtctgacatcaacatctttgtgggtgatggtaccaattaatgaaatgggcaacaatgcagaggagggggattgggggaagataatgagttgggttttggacatagtgaggttgaggtacttgtgagacagtcatggtcagtttaaaggaagagtctagactggaaatagaattgggaatttgttaagtatacagacagtacatgaaacattgtaggaagaaagaatgaaaggaaaagagcacctatgaagagttttggggcacctcctaaaactaaaggtctggtagtggaaactcagaagtaattgccagttaaaaaaaaaaaggcaaaccacaagcctgtcataaaagtggtatcacaaaaattgaaagagtgtttccaggagggactgctcagctatggcaaaaggctgcaaagtgttcattggaagacagccacatagacatcagggagtcatggagccagtgcattggtgggcccgggagccagaatggattaggaaatgagagggagacaatagcttgttgtcagcatatggctactagttgtagaaaccttggcaagtactcaggggattgactgcttctggcgtgcctggagctgttgagcccagaaagaaacaatgctgaaaagggattctcatcttgtgacctgaaaaaaaaatgctggtaatagccacttaaattcatcagaatcccttaaatcacttaaatttctcagaattatttatttgggggcttattgtttagttttttgggtttttgctttttaattacagatactaacttgagtacattctacctctcccggtttccataccccctgctatgttgagattcagccctccttacccagcctgcgttattgtgaagtttgtagaccagtgctctccacttgaactttttgtagtgatgggaatccctgcccagtaaagtagctcttagccacatgtagctattgagcacgtgaagtgtggctcatgtgactcaggaactgaatttttaaacattaatt

SEQ ID NO: 112609 - DNA, 1726 bp, Homo sapiens
ggtgggggcttcagaggaggaagaggtggtggtttcagaggtgagtattttaaaaagtctttaaattgcttaatgtttaaaattgatattatctggcattttctgtttttacttaagtttaattttctctgccagcaagtatatagaacaccatggtgttctttgcttagcctaatttgtggtttcattttatatcactttttttttgccttttcttttcaattttttcacctaattctaatttgttttgctttattattaatttgaaaaataaaggtgtaatatgaatgacagttaaatttggtaaagtatgtttgctaaacattattggaactaatgctgattttaaacttgagatttaggttataatactattaaaaatccattttctgtgcccttaatactttaattttctcttaatcagggagaggacattaagtgaaacagttgacagacatcaccagttgacttctgcattaacctgcatgatctgtttctactatggattggaaacttgtttcttgaacaagtcttgaagatcttggtcattttatgacaatggatctaaaatgtcagcatcatgcaaagtgcaacggaatagtgaattttgctctaaaagagcatgaacaagtctttctaatgttttgtacagtgcctggcactctgtgggtgctcaataaatggataggagttttcatttgaagcatatttgaatttttaaaataaagtgttttattcccttaagttatttagagtgtgtttattaaatgaaacccattttttaaagtagaaaggaataactaaagcttaaacccagtgaattgcagatcgaaaaaaggatttgtttatttatattactgatcttttaaaaaatagactactgtagcagtactttaagataatttacaagttgacactgcctttcaaaaccctggccttttatgtatgagaagatagctttgtatttgccttttgtattttaatacataaatcagttaagctgtttctctaattgcaattaataattgatttaaaaattttccatattagtaatgtattaaagatgcagtagctctgttgaagtgaaaactatagcaagaaatttctaaagttaatttttctcatccaacataaatggaatattagaagttttactgaatgttattttatttttacttttttaaagggactctaaaagtttaaggtgttatttactacacgtaaatattcgtgtagtatactacacgaattcgattgcatactacatgttcagattgctgggtaaggatgttagaaatgaaattggttttggtcaccattgctagtggatgtaaagaaatgactgtggtagcaagttagaatgccatgatatggagccatttaccctgccattcatttttcacttctcaaaaggaatgatgtttctatatcgtttgttaaattttctaacatgcccatggaggaacgctcttgaatgctcatttgaggagcatacagtgttgtctttgtcagtatttggggttttatctttttctgattgatggaattgcagcaggatgaataaatacataggccattaatatatatgatgagcaaatgtgttgaaaattacagtttttacaggaataggcagttatgcttttacagcttaggacaggagattatttgatttggaattgtggtgatgaaattttcatggagtgttagggccagggcttttgctcgt

SEQ ID NO: 112610 - DNA, 1157 bp, Homo sapiens
taaaaatgtgagtactggtagctataagatttgggacagataaatcaacctgttcatcttgagtttatacacaggcaagagaactgaagcaaaaggattatcttaggtttctgctgtgccattctaggatttttataaaattaaactaagtgggtaaatatagccctctagtggttctgttttatgcttacactgttaactttggtgcatctaagcatttctctaatgtttactgattttaggaaactgaggagaatcagattttaataatgttaatggcataaagaatatgggaaaaaaggtaatagggataccttattattctaacaaaacatgctcaggttggttttcaggttgtaatgtgataatccagaatatttttattctgtactttacaatatcagtgattgaattcagatactctggcaaagtatacaatgattactatcatcagataatattaattactcatgtgcatatcaaactataggggaaattaacggatggtggagttgatcatattatatccatgctatgaaatacatagctactaataaattagactttattagattctgggtttattaacttggatattataatacagccttatgggaaaacaagttgcattatatatatacatttgtacttatttttttccctcatttttatttacaagaagaaagtggaggaaacctgaaacacttgtatgaatatgtgtataagcagagaaaagcctaagaaaggatatgcaccaaacaatactggtacctttaggagagtgagatttggaagtaggaaggagactacttctttgtcactaatatttaaattgttaagaaaaaaaaaacaacaaaaggagccgaaatggaaagacttgaatggtcaacagaaaacagggaccttaatccgaatagttttagaggactaaggctggctcctatactgatttcctgagtttgtttattgttaaatgggatgtgtgtgcttgataatctccttagatagaagactgatgcccaaataggttaaaatgtgtggtgcttggtatttctttttgttttgctaataagcttttcccttattctgggaattaaagtcctttcctctttagcccaattaaatttgttaagggagggcctctatgaaaaggccct

SEQ ID NO: 112611 - DNA, 1243 bp, Homo sapiens
tgtagaagtaactcttatattgagttcattattttttggattgacttttataaaaattttcaaacattcaaaagtagagtgaaaagtataacacaccatcctatacccagtttataattgtttacgtttcttccttataattcagcgtattacttctagtactggaaattgagttcctcagttaagttttgcgattttagtgacgttatctcgttcatttgaatacctctatgataagtactagacaagttctagtttttttgtaattgcaaaaaagactgagaaaatctcctaacaattacatggaaatactttgtatacaagtgtttggtttagttagttatttgtagatgaccaaaaaaaaaaaaaatccaaaaaacaaccaaaactatccttttttgacctggttacaaaattagcatgcagaaaatattctatttagttcttatctctgtaacagtaataataatagtaatcttactactactgctactaatgttatcatttgaatacttgctatataccaagcactgttctaaaaccttacacatacagaataattcatccttacactaatttagtaagttactcttcagttttatttctctagtttatacagatgaagagcttaagaaacttgtccagcacacacatttactaagcagctacaccaggatttgaacccaggcattttggttctagagccctcacatataaatccaagagtcagctttatcaaggtatacaatgagtgtgtgttgtttgtgtttctggtggatccactgaaggaagcatagctgaactctttatgcttttgttctgcccctgtatcaagcatctatttttctttagatcccctaactttcctcctttaacaaaactcacttaaagttgcaaatcaaaaccaaaactatgaggaaagggtgtagtgaaagcatttatttcattcgttacttttaccaagggcctatttagattttttatttaatttttaatttgatctttcatttatagtttggctcctataaactgttacaacttccagtgcaacagacattttgttaatttagtgtccttgagcactctccctttccccagttaaggctgggaggtaagaggacatggtgaatttgaggatctgaaataaatcattatgtttgaactgtaaaatgaagggtgagaggttgaaaaagatggctgagtaccagacagtgatgagccgtgtaagttttaaaggtgacag

SEQ ID NO: 112612 - DNA, 1047 bp, Homo sapiens
ttattcagattatgagaacatctattactccacattctccttaacatttgggattgtcagacttttaaattttcattttcttgagtgtgaaatgccatcttataatcagtatttctttgaatatttattgtggttgtatgtcttatgttataaacattcaaatgctaatgggcttgtgtgaataccccgttcatcatctggccatttttctattgagtttgtcttttcctcctgttgaattacccatcttctgaatactagtcttttgctggtttgtggttgttctgcactctgttcatagagtgttgtaaagaaatttcactgtaagtcttaaaattttcaaaaaagtccattttagttaatgaaattacaaattactttccataaattcttttattaaaccagttataatttgacaatgaagatgtattttaaagtagtaaagtaaaaaacctttagtatatttgagatatattctaacaatggacaaaaatttaatgtttcttgggagggtgtttagaatggtagagtcttttcaattttggttttcaggtttatgctggattgaatattttttttggaatggcaagcattggattactcacggtcgtggctgtggaccgatacctgaccatctgccttcctgacgtaggtacaacacttttctcagctttcttaatgaatccatttcttgactaatggccactcaatatatatatacgctaaaatataaacctaatggtttgtagttagggtcagttttatttctctgccaataattgttcaaatgtttcaatggcttcttattgtacttagaataaaatccaaatttcataaggctattcacactttgaggtacggtccaagcccaaagtgaggttttcatacctgctgttttgctaggtttggaaagctactcttcctgcttatcctctggctgattcttttctcatttaggtttcagcttaaatgtctttttttttttccagaatgtgaacttatgtagataggcttagtaaaagggagaatatttgtgttacttttatt

SEQ ID NO: 112613 - DNA, 1100 bp, Homo sapiens
ctagggagaggaaggggaagttactgagtagactgagtggacaggggtaaagatttggaagtctactttctttgtagatttcaaccagttctattttgagctccatgtgcacccccacatctagagttttctggtaccctttgttactagaatttctgtagctctgtagtatggattggtctgtatctggttttccctcatagttggctctttttaacgtttatttatttacttatttataaaattattctcatgtttcttacataatttgccacttatccaatggccattttttccattaaaaatatgtattatctaatctctgattctctgtccttatggttttatgtcttctttaacctctgttccataattttagcaggcaatctagggaagcaatataaaaatataatttttccatttaaacaagatgcaagagatctcctttacaaaattgtctgcattgtgtgtaacatatatccagcagaaatggcctgtgttagaattcactgagctcaagataggattgtatttgtttccagattgagtttagaaagttagaaagttacttttgttaatttagcaggtaatcccagtaagagcaaataataatgatggtgataataataataatagccatgccaggagttcatagcataatgatgtgaagtggggtggggtgggtttttatctgtctttcatcaaagtcagcttttgtactctcccctagcacgcagaaagaaagagggcattccttatgtgtgtgtaccattcttaaaagcaatgttatatattcttgatatacccatttcacaaggtcttattatcatcgaggacttcaggcacttgaaaaaagaacattgaaggcagaaaaaaaactcaactatttcctttatgtcatcaaaaacataaacatattcaaattccaacccagatagatttttacccaactttagatatattaatatttaaatattttaggtattgggcttggtgaatatttatttcttttcagatgtctgtgatcatgatctgcatgtttctggtggcatggtccccttattccatcgtgtgcttatgggcttcttttggtgacccaa

SEQ ID NO: 112614 - DNA, 1129 bp, Homo sapiens
ctgaaagagtcctatctttcttccgtactggttccttatcccccgaatcattaagtgctcagtgaaaatgagagggtgtgggatagcagggtgaggtttactaagttaccaagaccctgacagtttctctgaatcctcttactgtaagaatgagtctgaactcacaaccaatgaatagtcgtaaacataaatgaaatcaaactttttttttgaaacagaaaagctaaatttaattgcatctattgaccttcaataggtggtgaagttgatctaaagaaccaagtaacaccattggacatcttgtccaagactagagtgtcagaagataacattacagaatctcaacacatgctagtggctgaaatcatggtgtcaggtatgaataactagttctccaatatacctttggttccaacagtttccatcctaccaatgagaaattttgaattacctttctaacttaatattgcctaagttctacacaaggctaatgaaaccaaaccttggactcaagtctgtctcttctgaatgatgtgcctgagaaagatggctgcatattagtctggacataaacaggacaccttgagagtctttgggtgtgagtctttgttctgtgaagaaacaaagtaacttggaaacaaaagtaaaacacaggacaacatatttgaatgtatttccatccacccctgatatttttggtatttggtccaccttgctgtttttctattagcctgaaaagttgatagtaattgataaacaaatataggttgagcacttcaattgctgcagaaagtccacaaacagcaaatgttggaattcttttcttctgtgttgcacatttgtcactaaaatgccaaatcatgtgttcagtatgtaacaactttagggaacttaagtctttcttgttccatattcacctaggaggtcagtggtttttccagctgggttcagctcagccctagagcttctgcaaaccccatcctttcactttaggtcactgcccttcaagcagtgcaatttgactttgaaacattttatttgtttgtgttactaagtaacactttaacaagatgtatgtggcaaaaaaaaaaaaggaaaatatttcaaaactccacattaggacttttaa

SEQ ID NO: 112615 - DNA, 1049 bp, Homo sapiens
tctattagggaaaatgtaaagtatattttgacatattcattgtagcttgtattttgtttgctgtttctaatacttatgtatgattaattagccaaggcttttgaaagaaagaaaacaatttcacctgagtgtctgctatttgagcaatatatttttaatctgtcctaaagatcattcttcatgataaaactacttctagcacaaatgatgcaataaaaaatttcctcgggagacagaaatgaatatctatattgtatagcttaaatatcagtttctgcataaagcaatttggaattgctaagggtattactacaaacacaaacatctgagtttaaaatagaatggcctttatcatggtcctgatggacaagtctgtcaagatcatgtgtgtctttctatgaggtttttcagtaaaataaacttgactctcgaaacagacaattcccaaatgattagtatattcaaaccctaaaactgtggagtttacatataaaattctaagctaattaaatagtcacttgtcactcaaaagtagtgagtgaaatattactcactagaagcatcaaatgtacacctattcacttgctgtttgattatgtttaggctttgtgctccacccaaatctcatcttgaattgtaattcccaggtgttgagggacggaccaggtagaaggtgattggatcatgggagcaattttccccatgctgttctcatgatagtgagggagttctcataagatctgatggctttataagtgtttggcaagttcttccttcactagctctctctttcctgctgccctgtgaagaaggtctttgcttcccctccatcttccaccatgattgtaagtttccggagacctccccagccatgcggaactgtgagtcaattaagcctcttttctttgtatattacccagtcttgggcagttctttgcagcggtgtgaaaacgactaatacaccgataaactcacaaataaacctttaaaaatgagccgggcacggtggctcacacttgtaaccccagcactttgggaggccgaggcag

SEQ ID NO: 112616 - DNA, 6625 bp, Homo sapiens
aatttagggagctcacaaagatatatgtttgaggggtaccttttatcatgtaccaaagaaaaattatggttttactactctagagaagccttagaacattttgctgggcacttgacttccagtctgtttcctttgattgataaatgatctaagacaagtcaccagtcccctccaggtggtatttcctaaaatgtatagttgagttgggagttggcaacatagttgttaatgtcccttccagatcaatgatggataagattttgtgtgaaataccttgaaagaaacatttgctgcttgcctcctgtgtgtgaagagagccatgctgattatcctacttaatcctcaggtgattccatgctactcttttaaattatcaccatttatatagatgaggaaactagaaatagtgaggataactaacttgtccagggtcacagagctagtaagtaccagttcagggttctaatccagtctatgtaactctccagtcctagctcaggatgtctaccctcttacaaaactgtaagtcatcgttactggtggtcaaggatctcacgtaccttcttcctctttgtcttccaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagatggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaatggtttgagcagtgaacaaagaatccatgcaaaccaagtcatgactggaagaaatggggagtgggggacagtgcaggggaggaaagctgttacatctatgttaaatgattgtgagcagtctataatgtcttgatgttggttcataggtgagacacaactgatggaggaatgtattataaattatgcaaaatctgacatgagctgaaaagacaggtccttttataagagctaatagatgcttaggatgcaaatgttattttgagcttcgcaaatacatgataccgtgcaataagccttttttccttataacagaaaatgagaataattaaaatgaggagaaggccacataacagttgacttgaatttaattgaaggacccattggaggctcatctggttgatttaattatttaattgagtgatttattgcagatctcttaatgcaggttagaaacggaagtgagcataaaccttaaaaagactctaaatgatgcttccaaagcactttcattttggtattaggttcatgtttgtttgtctttacttgtaaaataatttggaatttttgtttacagggtgaatgtcttaatagttttaaaattagctaaatatatctaaaggcatttccaatgtttatcatgggaggaaaaaagccacattttttttaaaacaaaacaaaacaaaacaaaattttggtaatataggttcaatacactgtttttaacatctcagcttagccgctttaatcatatcaagatatgaggctggatcactggcccatgacaaatctgaaacctaccagagaattgactgctgcatagataatcctgctgccagttaacattccagaaaaacttgggcaggcaagtttttatagctgccccactatgctgcaatagagtatctttctattgaagattttccactgcatcccgatcctactatggtgaaagcattgttcttgggctaaaaaaaaatcctttatttcatacacacatgatttcatacactaggtctgagcatcaagccaagtccatgagtttgcaatgaagttctagtgagaaatgctctattcataaagcagggggtttacgtggaccttctagtgttgcttatgggaaaagagtaactaccatattacatctaacgcaaggccaaagtaccaaattaaaaccatggattgaggtggttattcgaagtcacttactcccatccttctaattatgctccactacaaaagtaaggggagaagagggaatactttacatgtacattgctagagggaaaagaaaggcttgattatatcccctcgcttctccacctctctgctcatgtaaagaaactgatgagaaaagagactaatatgtctagactgagttagaaacttcatatgagtgggttttgtagaattgatgggaaagacagtgggaacctagaagaacagaaagagacccacagaatgtctttctttttttttttttttttttttttgaggtggattcttgctgttgttgcccaggctggagtgcagtggcgcgatctagactcactgcaacctccgcctcccaggttccagcaattctcctgcctcagcctcccaaatagctgaggttacaggcgcccgccaccacacccagctaatttttgtatttttagtagagacagggtttcaccatgttggccaggctggtctcgagctcctgacctcaggggatccacccgccttggtctcccaaagtgctgggattataggcgtgagccaccgtgcctggcccagaatgtttttttaaatcagatgtagcatcttcataaggtaaagcctgtcacatcagagtaacaaagctcctggagtacagtgatgctagagtagaatgttccagaagtctggccatagccccagcttctgaattacctgggagagacaagatgctcaggttactattttttctttattctgatagtacagcctctactcagagaccacggtgtgtgtcacacaaccgaggcagctagggcatattctgagggcttttttttttttttggtttccttaatgattctttaacagagtaactggattggccaaggtctgattcaagaggctgtgaggagagtagagaacaaatagactttgcctctcagagttcagagctttaagttgtataagcatggtccatgtccacctcttgtagacacttattccttaaaagtttccatcatgaaaaataatatcatgtcaaaattttataagcacccagaatgtcccagtagtcaaatgtagtgtctttctccagtctctgttttcgataataaataccttgctctcaatttaggatgatcgtaaagcctatgttcatgctgtgagtcattgtctcccacagcttttgaaacatcgttctttgtcttttctatacaacacctgattctttgtgcctcagactcattgctatcaggaagagactttgccaagatccaccaccacatttggccagtagtgtatacacattaaagtgagagctgatgaaatcacaatgctctattttgttccgacaatcagtatgaaggggtaggtcccagtttgccaatgagcaacagcctctgtatgctggtgtccaagacttacacaaaacaagtgtcagtgcagtcacagcattttcttgaatgctgttgtgacagactccagttataaacatctgcgagccatatggcacaactcatagctaaagaggccggtacagggcacatgcacagagctttgaagaacatacacaaacctgttgaatcaagttactttcctcatcctcagagactttgacaattcagagctcacagatggcagggggaattctcaggcttcccttcctcctgattgacactttttaaaggaagtgatgtggaagttgttctagaagttagatggacagtgggagcacattcgtgagtggggcttgggagagctcaaaagtggcactttgattttaggctgggcaggcagaagtctcacagtaaaatatatttcactagacgtccaaaccaacactgcattgtagtaacctcttctgaagtaactggttaaattaataactggtcccataagtcagggtcaagccacatttataacccattcgggccggccatgaagggttctgactcgacattggtatttaaatgctgttactttcccaatgcttagtagcacttgagactttatttccatcgacaaaaactaagaaggccacagaagtagcctaacagtcctccctggtcatactcgtttcaaacaggtctgcctgtctagacatattcaggcaggaggttgcttgctgctatcttgaaaaccactggaagattcagcttcttggggacctcagagcccatattcatatggaagcccacccatataagcctcacagagcaaatcacagcaatgttgaagttgttattttcaagtgcttatttcacgacattaaaaaaaatattttttcctggtgtattaaaattaaaaataaaatcataacttttgatttaaaatcaaactgtgtttctgttttctcttactctgggcaatttaaatgggacatctaggacactgagggttcctcaaatactcagaaatgccatttccacacttgacacccataggcttggggcacagagatgag

SEQ ID NO: 112617 - DNA, 1833 bp, Homo sapiens
ttcaaatactctggagctcctctgacaatggccattcagaggtaaaccgctgactcaaaacaggtccaaaatcagtgcaagtgtctccaagacaagcagatctaggtctttatgtagtcaacatgtttgcctggatgacttttttttcccatgcattttggaggttaaatttctttccagtttttgcagttggaaaatcttgtcgctactatttaattaagagagatttacccgtttggattatttagaacttttcttatttttaggtctcaaattttacctttcaatattctaagattctggactctttatgagcaccaaaaggaaaagatctagtgagaaaaaaacagttcttccatgtatagtactgaaactgtatccccccccccagctcccacaaactcaaactcttgttttaaattgcagtaaaatatacatattattcagattgttgagcaaccattactccatcaacttccagaacttttgcatcttctccaactgaaatgctactcattccacactaactcccccttcactaaactcttaataaatagcaagaagacctttctgtttcagcagaaaaccgtgagctcatttcagtgaattatggggttgtaggccactagaacaagtgagaggaaaagagccactaacctgctttgtgtgccaaatctctgagcacctactatttggattatattaaaacccgctgagattttgttttgttaaaacttggaaatatctgctctgagcccaggtccttgctcagttgagcatgtcattgtttttgaagctctgactcagcagcactctagctagctctgggaagagggactcagctgtatgtgacaaaccacacacacagagtagcctctctgtgtctcttggtggccaagaacaccctggggatttccaaatgcttgttgcttttcctgcagctgcaaaggtgtagttaagaagggacacttgggtataaggaacaacatgccctgcctgaaagctgtctcttgaatgaaaatagttggaccaaaggttagagaaatcatgatacagagaacatgagccaggaggtagctaaaatgacaggactgaaacgttcgagagtctaaagtcccattgcttgtacttggccaatgtccttcccgttatgccaacaggacatttgaacaagaaagattgactgaccaactcaaatacacagtccctctgatagttaacatttctgggtcactctatagcttctggaaagcctgaaattaccatgacttggcatgactctggctcatgacaaattaaatgtgacattatgtggtttccccagaggaaaaataatttgtacctgccagagtggcctgactgatgcatctcagctgccatatccaagaccgtgagaggacttggttagctcttctagagccccaccagtttccccctgcctgagggaaactaccactctttgggtcagcagtctgggggatagtaaccctgatagggtgttgaatggtgctactgatcagctccagagccattgctgggagatgatcaatttcattcccgcacccaccatcgtgcatatgtgttctggaaaaaactcctaagcaaatttaaattaattttgttcttgagatttcgggacatgttttcccctcctcctaccctccactccactcccctccctaaagtaactagaaacacccagtgtatctcagttaaacctgagatataccctcacctccagacaggagaaacacaaagccattcttaactccagaattgtaccttccactttccatcccacactagcccattctaatatggtttttcttaatc

SEQ ID NO: 112618 - DNA, 2936 bp, Homo sapiens
ggggagagagaggcagtgcagagaggccttgtcggtcctgataaaggagttgaggtttttattccaagtgcagagaaaaaccactgaaggattaaacaggatctatatctgtaaaatgacagtaatcctctgcaggacaatttcatacagtggaaagagtaacaccatttgatggagtctttatacctttagagaagctacttacaaagacccaacttaatagacaattgccaggaattaaacttcattattttgatactgtagaaagttgacctttagttctagttggcagatgcgtgctttctggacaggttagcctagtggaatgatttattctagagcaactctaagatattttaagtaaaaaacagtgcctctgaggagaaaagaaggctccatttcccaattcaacagttgttcattcattgatctctcagctgacttctagagtaagatgctgcccttttgggcagaaaaggctaggcaggtccatcttccccacatggtcagccagctctcctttcagtcccgggcatggttcacacactctgggacatacacttaaggggctcacttcgtaatagtggctgcttgttcctattgccaagtgctttcccatggcaggttgtgtttcttgagcctaatgtgttccagaacttcctatttccttaccagttctctgatttaaagaaattgtttattttttcttcactttttcaacaatctcactttttcaacagtctttattgagcacctgtgcctatgtggagattaaacacattgcggggcattgaagaacagtgttggggtggtattagcacaacactggttctagggagctcagggagtgagcacttatctctgcctgagtgggcttcctggaggaggtgacagagctaagcttttgaaggagtctcattctgacatctctgagaaagatggatcagacagtagaaagtgatttggagactgctggagaaatccaaggagggcacaaaaagcctgggctggcaaggcgagtccagaggtagaggaaaagtttgcctaaagaggtaaacaggttttcaggaaatagagccagtagaacttggagaatgattgggcacagggcaaatttgagataattccaagagtttgcagccacacccatctgctctccaaggaatagttcccaagctgaaactcaaaggtcaccagcattcttcatgagatcctgctctgaatctgttaccctttttcatgacctctttttggaacagtgatgaagaggaagtggtatcatatatggtttcagaataaagcccttgagtcattgtattagctcttgtttacagaacattttaagatgctttcaaggaaatacaaataatatgattcttatgcctatttcctgccagtggccaaccagtcttctaagtatggttgatgtgagaagtgaaactattttcctaaatgctgtttcttttctcttttcattatgaagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggtgagtatcttcttccatttcctctccctctctttgtagcaacatatccacagtatttatttagtgagcaaagaaacattttgaaggtcctattttgttggttgcaagaaagttacaatgaatgaatttgagttcttgcctgacttctactttttattgttcgctccctctttccttttaaataattttacattgtgcatattaagagtagatagtttatactgaacatgctgattttcgagctctactaaaaatatacctccacggacttataaaatgtacagagacccctttaaaaggcccactgagctgagctaatattaaaacatgggggaagaaaagagcaacacagctatttccaagtcccatatctgagcatactttcatctgtagagttaggattcagattaggaattaagcttttcatttggggaccctcctgttctcattaacaaatgctgagggttggtctctggtggtgtttgattttaatcatcaagactggccttagggaaggggaatgtaatttaccttccagaaagtaatagaaaatacaggctgtatttgtagatttctataatttttccctcaacccttgaatggtcttgaatgtaagtgtggcacaggttaccagaaatagtaaagtcaaggagttaatgtgggcacagttttccaggaagatgtctttatttacacagaaagagatctagtggtgacaataagctctgagtacatccatgagtaatgctagcaaactggtacagattgtacaggtacaaactggtaaggcaaacctggtcacctctggggttctgggttttttttcacctgcaattaagaattatacatatttagttcaaaagatatcaattgcaatttttgccattgttttcaatggcaaaaccgcagttaacttttgcaccaacctaatatgtattgtcccctctcctgtttctcctaaaaagggagtttggtgttgtactttccttacaaaccacctgcaatataagctatgagcagtcttctgtaaggtgccccttgttcacgccccgtgtccattcagatagaatgggaactgtctgatttgtgtgggccggcaacccagccaccttccactggaagccagaaacctgctgtttataagtagatgacaattggtttgagctactgtcttcccaggtcaaaaacaagggaagaacaacagaagaaaatttttcctgaaaacctttcctaagaggggcagaggtacaaagatagtccaaaataactagataactaccgcgtgcatgtgcatgcctgca

SEQ ID NO: 112619 - DNA, 1014 bp, Homo sapiens
aaatcagcaataatagtaatacaaatagtgatagagtaagaagagtaatataatgaaaactgtttcgttgagcacctgtgtatcagaggcttgatgctagctaaataccttacttatattgcttcaaaaaattcatacgatgaatttgcatgttagatattattctcatttcagaggaaaaaatacttcagtaacttggctaattataaaactgttagtaataagtgattggactgtgattggagcctattgtacaaagggttcgatttgcaactctaatctattgacagtggcatagagtggccgagaacttaaatgtgtggtccagggatggccagaaagactgctgagattgattagcagcatctgctgtgagcctaagtaaggactaggggtagcagaacagcagcatatttgcctgctgcatcacgctgcctctcaagctaatgtaacttggggaggaaggaaagcctcttcaccttaaagtgtattttgttaaagtgtcacgatgtgacactgttgtgataaaaaccacctggttccaaagcgtgcagaggatgaaatgtgcgaggggcagagctagtggctccccacaaataacaattatcccattggcccccacagtgctccccagcagtagcactgtcacatcccaacaatgcgcctttgcccacagacacatgggcccaatggctggcactgacggtttccctgaaaagtgctactgtcctctgttctgagttagccttattgttcagagcttagggaatgaggcacatgtccagatatgggacaataatatgtgctatacacttgctgtcagcaatattataggtcaccatgatatcaaaaccttcaactctacagtgctctgaactgacctccccataccctagccctcaaacttgtgaatacctatttgcccctaattcaaataccacttcctctgaagtcttctaggactaccactcactagccagagttagcttaatgattttttttcactccatcatc

SEQ ID NO: 112620 - DNA, 2826 bp, Homo sapiens
tgtcagtcaacaggcttcagctgatatctgtctcactgatctcacgctggtggattgatttcatttgtgaactactgtatttctcatacaaaggatccaggtgaggaggaggctggctccgcccttctcacgttatgaagttatcagccaaagagttcaccagatattgcaggccctgaaatcttttggaaaatcctcctgaaacttccctggaggtctgtatatccctgtatttaaaatatatttatcaacgaaagatgtgatttagaaaggagtatcttttcataccatctcttttcagtggtggtatttgagcaatcttttaaaacacaaaaccccttgctccagtgctctggagtggtgcttagacgcctggcatccttctgagcaggcagtggatcttggccaagttccgggagggagcggtggaggaaactgtggagggaaggctgggcgggagagggggagccagccatggaggaatcccccctgctggttctgaaactgaagctttgtccccctgcctgaaaagaaggtgatttgccctcactgtagtggcatatcgtgaccagacacttcacagttcacactttcaaatgacctaagttccagagcatacacatacttgctccagtaaaaataactaaacatggaaagaaaaaaacaaagctcttttcagtgaggagtaaggtatagcacagggcctatcacctgagtgcttacaagtatgtgtgaaatgacttcattacatttaccttctttggtatgctttgtgctaataataattcagttactgtggacaactatgaacatctttggaaaaaagaacaatgtgatctttaaaagattgtaaagatggaatggatctttaggttaatgaacccaaaggaaggaactgggcatatggaagagccggagcttatgactctgctacctcccttccttgcagttcacagtttagagctggaatcataaggagtatttccagtcccctcattttaaggatgtggaatactgagggtcaaaatgacttttttccctccctggtttttagttagttgggttgggggaagactctatacagataatgttatatatcatggttcaagtgctctcccaatgaaatttgcattaattatctttattcgtcccttcttacattgctacaaagagctacctgaggctgattaatttataaaaaaaaagaggtttaattgactcaacagttccgcaggctgtacaggaagcatggctggggaggcctcaggaaacttacaatcatggtggaggcgactggggaagcaggcatatcttactggccgaagaaagaggaagagagccaagggtgaggtgctacacactttaaacaaccagatctcgtgaggactcactcactatcacaagaacggcaagggggaagtccacccctccaatcacctcccagcaggcccctcctccaacactggggattacagttcaacgtgagattttttcccccaggaaaaatgtttggtttcctcatgagaacgtgaaacctacctaggactgtgagatggagttaatggagcactgctattatcgttgcactggaattgtcactgtcctaataatttgataatgccctgaaagagattaatagttttctcaaaggaacaaagttttctgtagaaacaagatgactaaccacttttgtgatcctggtgagttttttggcttcaacattaatctttactgtgaatacatgtattccagtttctttttggttcatataagcatcattttaattttctgctctgcttaattgaggtcactattggtagaactttgttctttgttcctattagaaaagtccagaaaccagcacactgttctttccatttgtagttgaaatcagtattcatttggcatggctgagcctccacaggaatgcgttgtggcatctcttccatagttgagtgaagaagaaaaggcaagggaagaaagcatacccaccagtaattaattttgtagaatttagtacacctctttaggtttaaaattccaggagaagggttctcatctaggacaccagggatgtacagaaaggcaccgttctttatcagctgcctaagcagtgtcatccccaggctcatggagtggggttgtagagggagaacaggccagaaggcatcttgcacggtggggtctccaaaggtgtccctaatccacagctggggagctaggacccacaggggctcccaagtcaagattctgagccagttgttatgagatgactcctaggtgttagaattgccttagtgcttccaggtgattgtcatttccagccaggcagagaaacactatcctaaatgaaagcccagtgagttttcaggatcagctatcaggtaaaaggcactgagctgtagacagaagattctgctacttagtaactgtgagaccttgggccagtcctctgccctctctgtgcctgtttctttgtctataaaacagggataatggtgccccatgaggtgtagggagaatcaaattccataatctaggggctcaatcaagttctgtaaatgtgaaataccatggcagcatccagtgcagtgctcgcacagagtcaagtactggtcagccagcattgaagccttgcattgtttagtctgggagatgggctggagcaagcagtaactgcctttctctctggccttgatggggtcgaggctattagtagtgccaaggagatgaagtctttatatctcaaagaaaaaaaaaaaggtagcttaagtgacataaatcctgcttgtttttacaaaatagtgtgtgatatcttcatcagaa

SEQ ID NO: 112621 - DNA, 1092 bp, Homo sapiens
gatgctagctgtgactgtgtgaaaatggagttcggtttttctcatcagcttgctattacccactgtgtgccataatactacaatgcaacatcactatgcctattcaagttttggtcaaattgtttcagggtatcaactcttcattgttggaaactttgatgtgtttcaggaagttattttagcattttcatcaaaagcacatgtcacctacatttggacttttttttgtcccaacattttacaagtcattaacttgaaaatccatttaattggtatatggaagtgattctttaaggaataggagtttagagttagagacatttaaggccatcttccagggatctttttgtgctgctgtggtggtggtggtgaaaaatggataacaagatttatcctcttaaccattttatgtgtatagttcagtagtgttacatatattcattgttgtgcaaccaatttttagaactttttcatcttataaaactgaaactgtacccattaagtgaaaactcctcatttctgcctccccctaacccaacaaccaccattctagtttctgtatctatgaatttgactgctttagatacctcataagcagaatcatacagtatttgtctttttgtgactggcttatgtcacttagcataatgtcctccaggttcttccactttgtagtatatgtcataatcttcttttcaaggcttagtaatatttcattgtatatataccacattttttttatccattcatccattgatacatttaggttgctttcatctgttgccaattgtgaataatgctgctgttttgagcatgtgtgtacaaggaactcctctaaatcctttttctaattcttttgaatacacacccagaagtgaaattgctgaatcatgtggcaattctatttctttttaagaaactgccatactgttttcaatagccatagagccattttatattccctccaacagtgcacatgggttccaatttttccacatcctaacagtaattatttttcatttttttgatagtagccatcctaatgactgtgacgtgatacctcattattttcattttctaatgatcagtgag

SEQ ID NO: 112622 - DNA, 1050 bp, Homo sapiens
tgcttacataactgagacaggtcaaaaagttaaagaggactaaatccagaaagacttcattagtggcttcgattagataggaatatgattttatgagcatctgagggagggaaacactttgctgtagagtttctcaaactgtgacctgtgggtcatttgcatcaagacatctggaatgtttgttaaaaatctccatttctggtttcttccccaaagctataaaattagagccagtaatctcagcactcttgggattactttgggaggccaaggtgggtggatcgcaacatggcgaaaccccatctctacaaaaagtacaaaatatttagctgggcatggtggagcatgcctgtagtcccagctactcaggaggctgaggtgggagaattcacttgaaactggaaggttgaggctgcagtgagccaagatcacaccactgcactccagacaaagtgaggtcctgtttccaaaaaaagtagagcctctggtggtgaagtttggaaatctgcatttttaacaatctccatgttttactgtaattaaagtttcaatatagtattaggaggcttatatgcccctttagataccacccaatgccccctcaccagagtccagggactcttacagtaactgtccccattgaacaactaaaggcttttgggacgtgttcagtagatgagaagttcaatacatgctgtgtttctccagacaggtatcacactgtgattctggtcaactatggcacacttactctttactcatgcatttcttaattgtgcctctgacctttcaccagctattttttccagcactgtggactattaactggatgcttgcacctgagatagcagtgttctggtaacctctcacttgaggaagttgttatctcagttggcttcctgtttggcctcatgccatccatgcagagccatgagaggcaaagcagcccagaagcagcctctcatccctctcctgtgacttcctaggagaagaatattccagtggttatgatttcccctccccacatccctccaacgcatgcacatacat

SEQ ID NO: 112623 - DNA, 1089 bp, Homo sapiens
gtgagtcacttagtagccctgttggtgatcagactgtctttgtgtcacagtgcttgtgttcaagtgactcttattttacttaatatgacctgcaagtgcaatagtgatgctggctacttggatatgccaaagagaagccagaaagtgctttaagagaaaaggtgaaaggtttcaacttagtaaggaaaaaaatactatatgttaaggttgccaagatctatggtgaaaacaaatcttctatacatgaaattttcgagaaggaaacagaaatccatgctagttttgctgttgcacctccagctgcaagacttacggccacagtgcttattaaaatggaaaagccattaaatctgtgggtggaagacatgaacagaaatgtgtcccaattggtgggtttcaggcatcctccaggggtcttggaatgtgtccccgttgggtaagaggagtgtactgtatgcccaaggaattcctcatgttttcacttggggttatctgcacccagccctttgatagaattagtgtttattctcattttcactcccggaaaatgtataagctacaatactctaattagcgctctgtgcttggctttggtgagaacacactctgtgtgtgcacagttcaccaaaacctttgggaatgactgaagggcctggaagtttccaaactgagggtcaaggtcaccttggctttgctatccattatttcttgtttcttttacaggaaaaatcctttgatgttctataaattctaaatacatttgcaatttaaaacactcttcaaaaatgtagtaaaaccacgtatttgtaaccttcacgaaggccggaatctgaaaaaagaaaagacagagccaaattgactctaattgttaaggacaaaatgaaccatcttttgactagacaaagctaccagaaatctctttgattggaagtattttgtgctgaaaaccaactagaaaataggaggttttttttttttttacaattttattttaggtaacaggagctatttaaaaaaaattactccttcattccaccagaagttttaaatgtttcttgatctaaaaatgtagatgtggtttaagtaatt

SEQ ID NO: 112624 - DNA, 1034 bp, Homo sapiens
tagctggaataccatagctcttttgaaacttggttgaaatataaaatgagcattctagaagagattgcgtgttagtttaggatgtaatatacttagatgtaagtataataacacctgcaggcatttgttaaggattgttttgaattaagacatagttagggattacagtttgtataaacttcatgttatctcataaatcctccacagatccttgtttggcagggtttgggatgtgtgcacgtgtgtgtgtgtgtgtgtactacaagatttcgaactaaaaattgaatccttaaaaaattcttcagacttaaggaatgaacttttaatgaaattgcctaattgcataatctggaatgcttcaaatgatgctgacgtccataaataaaatactgtagccacacttatagattagctgaaggaaacattaaagagaataacatggaaaaatactagacttttcttctctggtcgttctcattagtgagcagagaattaactgaaacattgcgagatgagtattccttcccctgatagtccacatgtccttaaagtgtggatatgagtggaggatggtagagaagagtggtattagtgttcattaaagagaaattggtcacccgccgtatggttatatgctgttgttagagcaatgaaaatcattttcctacatataaatgcttttcccatatgaaacttcttacaggcctcttatgacctcggccttgaaagcattgacagttctttcctgaaagctgtcaatttttattctccatgttttaatcaaagctctaaatagtaactgtcatctgtttttgatgatactagggtattgacagatgtcccagatctgacttgattttgcatatgacatagggagctcttgtttcttccttgaaaccggcaactcttgttagccagagctactagtaaatggactaatttcactggttgctagcactccttgaaactcgtttcctagcatgtgtttcaaaaatttgttaagtgagaattggtgctgactgtttgatcccttc

SEQ ID NO: 112625 - DNA, 1023 bp, Homo sapiens
ccctgggtgtgctgttcctaacacttaatcaaaagatgacacttagacatagaccagacactggacatctgtgtcagtattgctagaccagagaatgcttttgctctgcatcttcaaaagcaccctccaccctcattccccgaactgacttgcagacatgtgtttatgtagccagctctggctttgtaaatgtgaaagaactcaacacagagactgtcaggacaaggcctgttctctcagggcatctgtcagctggtgtgcagactcattcctccagaagctttcaggagcatttccagtcttgtattattttgtgatctaggcaatcacaagactaattagcacccagctggtgtccaagcaagtgccaggatttacctagagtgctaacaaaggcacctgttctatttgtgttttgcttgtcaaaaccagcaagttcataactaggcttggggaggaacgggagcggagtaaatgtagatatactatgaaacacaaaactattaattttcatatttataaatattcatttgtattttttcatatattaactgttctaagcagaaatggatgttatcattaaagcttcattagttacttaaagcttattaaaaatgactgaggaagagtatttccattaaactcttatgatctgtgtttttccataatgttggatccctccatctaaaacacccacttactcaccactactgaatatactttttatttcagtgcaatttctaaagccctaggtttgaagtactcatgatttggatctgtcactaaaatctccttccagttcaatctgtatcagatcatgattctctataatataaagaaggcttttcatttttatttacatttaaggttgacagagtatgcctcacctgaagtattttgatatttgtggggaatttatctctatcctaatgaagcctttcaccattttactgatttttcaatattccctgcacctttatcttttgttattttaaattttaacacttgtaagcggagaaaaaa

SEQ ID NO: 112626 - DNA, 1631 bp, Homo sapiens
ccagaatatctttgggcaggggacatctaatcacatgggttgttaaaatggaagcctctaggctgtggccctggattatctggtgggcccattatattcacagggttcttaacagggagttggggggatcagagtcagataaggtgacgtgaccatggaaacagcttggtgtgatgcattttgaagatggagaaggaggcagccatgagccaaggaatgtcaagtggactctagatgttggaaaaggcaaggaaatggattctgccatagagccttcagaagaaatgcaaccctggtgactctttgattttagccccgtaagactcatttcagattctaacttccagaactgtaagataatacatttgttttgttagaagccattcagtttgtgagaatttgttgtagctgtccccattatcggagttctcaaagctattgtctgcaaactttatcctcttatgtcactgaatgagagttcagattttgaaggagcagtatgaaagccccagtcaaaatgttgccatattattattatttctggaagtttttttttgtagagacaggttctcaccatattacccaggctggccttggattcctggccttaagccgtcttcccaccttggcctcccgaaatgctgggattacaggcatgagccatcatgcttggccctatattattatttttaagaacaagatgaaattcagagttctttcttgggtaatcgggtgataatctcataagtaaaaacaatgtttaagtcattttcactcattactaaaaatatatttcttctgattactgccagttttttctcaagcttaatttcttatgtacatttgattttgctgacaaaatcaatttataaactaaccatgagatcatcgtcactgctgagatattttctctaatccagaaatagtatttggggtatattttctcattgcttccccagtttcttttcaaaatttatattgagggaatcattagtgacaggagtatatttatttatccaatagttaacgtgaaaacatgccatgttttccccttcattttattttctagcttttggaattttcagctgtctatgaggtgatttggggaaatgaaaaccctatataaatattaaggtagtggtaacctacaacagaaatggattctcctttgatataaatgtcagtccttgagtacagagaaagtgctcataaacatggatatgtttatgcttgtttatataattgtgcaagctgttatttttcttggttttgatttaaatctaggaaaattttcagtttgaattggacttaatcttataaacctgaaatccggttttcaatgcattgtgaataattgtctccttttgacagtgttttttcacttctagttttagcctccagctctgataggtctattagttataagacgtcctaggcttctttaggataaagacaatcaggaaacaggtttttatattcaactctaagtgtagcctgttagtttgaaagggtgttggtcatccataggggaaggatgagtggcttcagcatttgggtcagtttttaaagaagcccagctgtaccatatgatcaggaactaatgacctccaagttccagtcattatttctac

SEQ ID NO: 112627 - DNA, 1531 bp, Homo sapiens
aaaactccaaagggacatgcagacaagtctgtatgttttaaaaacctttcccagaagccccacctggcaactcctgttttcataatcattgccatagcttcactgcagactaatctctgaaaaagagcaaggcaaatgagtatcatggatgggcattcagtcatattgccatacttagcctcacaattgatccagtccagtgaagctagggttccaatcaaagaacgtcttgtggggtgtatcacttactataacatctatcctggtgttaaggcatctcttgagagactcaaggactttttaggaggtgacagatgacactagggaacaccctgtttctcagctggtaagaagagaaagcaatccagtgtagatgtgtctcacttgagaaatatataaaacaataacagaaatatataaaacaataacaattatttgattcttaaaaataattattaatttttcttaaataggaaagctccccaaatgttttcaaaatacaatttagttttttgaaaaaaagatttatacataatttttctggactaaatctgctacataaagcaagataagcctgtccttttgaaaagtttgcctttgagtactgaatgtgtaggttggtgcaaaagtaatggcaaaaccacaataacttttgcacccacctaaaatcttagtagctcagttacctacttatctatcctcatcagtccagcctttcttgtatcttccaaaacatgttccaagtgagctgagaagtttcctttacaagttctgtcttgttggttggaaatatggatgactgttttctcagtcttgaaactgacattgttgcatgttggtagctgacacatggtgggaggagcataattttatatctaagaacatgataagcaccgaaacaaatgaggaaatgttagatcttgctgttgcccctacgctcacagataagtgtctgagtgaaactgtttgcagaaggcactcgatggacttcatacacccatatgtgtaaaacatttaacgagttgctctgaaatgatgctccagttgggagggtacagatgcaggaacttcctgtaaccgcactgcccatgacgcctgccttatcctcacctacaaggcctgctgttgtctaaaacctgtgccattcccaccagacttactcaagctccagctttcatttcatcagtgagtgatctttatatatcacaaatccaagcacgtgacttcattcatttaaaaccttcattggctacccattactcttaagatgaaaaagaaacgtcttagcatggcctataagagtcctcatgatcttgcttccacttaacttcttgcaccttcatctcaacactctcccacttactctgtaattgaaggtcaagtgctctaaatttcttagagttgtttgaatgtgctttctctctcatgcctctggctctttgcccatactgttccctctcactttctttgccaggcttatactcgtcctgtctgaatatgtctccagaaagccttctctgacccaacaaga

SEQ ID NO: 112628 - DNA, 1070 bp, Homo sapiens
ttttgattttttaaactaggtgatgtttatgaatattatagatattgagtaaatgtttttgaataaacaagtaaaccagctggagccctcgttcatgtttttgagttcacatacgctgtattaacttggatttgttactgataattctaaaaatacccctgtctataaaagaggcagtttagttttctagagaagactgcctatttgtcataatatgaacttgaggatttggagattctatggccaattttgatcaatataaacagataatttgaatagttcagattaaaaaaataatccacacaactctggatttcagcatcccaaactcttctagcccttctggtgactcatgaaaggtgtcccacctctctgtaactcagtttctgtcagtgtaaattagaatcatactgtgaagcaacagggattagaacatcaacgcaacagatatttcctaggtacttcattattttcagttcaatgtccaaggtgcagaccttacatgtagtacagtcaatgataatttagaaagcttccttacctgtaaaaaattctcttatattcaaataaactagtgcagccagagcttttatataggagtgggagttagagtgaagtatctaatgatctttatatgtgttaaacttacatgtttccttgaaagaaatgtgtacttacctatgtttgtatgcatttaaatgcctaaatacagacccatgcacagatataaattttctgtctttgatatcctaaaatgactgatggtcatgtgcataaaagctagtctgagaaccctggagcctgccagacaggttgagcttctgagtaagcactgtagctattgcagtgctcagcccacacgatatgttttgcttaaagggaactatccaatccttggccggatggatgatggtggacactttggtttaatactgcttattactgtgtcactttaatttgcctaaaattgttcacagaacgttgtccttatatgtttctgggagttacttttccttgggctactgtgttggttttgctttagcatccttggttcagtcatttttagtact

SEQ ID NO: 112629 - DNA, 1040 bp, Homo sapiens
atcagcacagcctttaaacactttataattgagcttaaatctgaagcttgaagtattatgtttatgtgcctattcctaatgctgggtgttttccgactcaagggcaaacatttgagtcactcatgatatgtcaaaaagtgaaataggaatttgagaaaatttgtctagaaatctgagaccaaaataacacaagaaatttcaaacatctagaatcctaacaagtgcagctcagtttatgaacatgcagtctttgtgatcaatgctttaagaagcccatcataagataccttcaatattagcccagacttaattattaacatcctaatcacatatccaagttaagaaacaaaaattcatttttctactagactcacacacactcaacatccaatgaatctgaggaagttcttgagatgttaaggaaggtagagatcagttccttccaagccttacattaaattgtgatcagtcttctctcttctagaattttttattttgaccctttgttcatcttgaaggatcttctctgaacaccaagttgtctgtggtgcctggcactggatcagaccattgctgataataggaggattacttcattattcccctaggcagccttaattgtggtcagttactacaagaggagacagaagggaaagagagacagtgcttgcttgcagttcgtctgctgattggcttcttacccactaaggtctttacctgtcccttgaacttacctatttaaacaattttagtgtctgacttttttccctaggctactaccctgctaccctgtaagtgttcctattgagcttcatttcatgtgtttctgaccttttctcgtatttgccaactaaattataatttttgccttctaagttgctgactttggctttgaagtcatacagaagccagtttgaactgagacctcactccatttcttacaagttatgcaaacttacgcaagttatttaacacagtatgtgctgcatttctttatctgcaaatgggggatggtacacatacctagtgaagttagtgtg

SEQ ID NO: 112630 - DNA, 2943 bp, Homo sapiens
aaagaactagggcctgagagtcaacatccattcttttttagcagagcaggggatagaaactgctagggatctgacactgagcacaaagtttaggaagtaagcagcaggaagcaccaatcaatcattgcagttgcagaaataaaccatgtccacaggcttcccctagctttatcatcttgtggaaagaaaagtaaaagaaaagagacccaactttttcacctactgtgaaacacaaagtcaagtttgggggcttatatagaaaagtactagccctgcctatctccaaagtggcatgggcagtaaaggactgtaaagccagcggcaacctgagaagcatgtcagccagtcccagctaaggcagccagggattagggaagtcatagataatcaccacatggtaggatcagtagggaataccaaacagaccagtgacacagccatccgtccctgatggtgcttaatgactagtgtaaggggtaggttctgtaaggtgtcctgccagggaggggattagataggacaagcgcaccttaaacactagagattacaaaataatttacaaccaagtgggaaaatttgagattctttgctagcaagatccagtaatggtagacattatttcagttatgttagagggtggtacctgtcgaatgagaggttggctgaagtggacttgggaaaggggaggcaggggtaggttaaatgccagcaaaaaaaatcttagataaacaaagctgacttttgcttaaaaactgttaaaacactgttgatgagaagaggaagtcagctatatagcaattctctcctttgcttccaaaatacgtctgaaaaaagacaaaaaatggagatatatattagagaaaaagtccaggtctagcagaacaagaggaattttttgtgtgtgcattgttattctctaaaattatatatgtaagcaaaaagaaaaaatctttaacagggaaaactacgatagaaataaaataaacttaaataagagaaggaaagttactgaggtcactgtgattatctacatgtgtctttttatcgctgaaaagtaaaatattgacagactggagccccaaggggatggaaatgtatccaattcttactcaaataaaaatgtattgagctcagttccagagaacattcttggatttgatgtttttagctccctaagttaaaacagctgaaatttcttcttattaggctttcatagaagaaaaacgttttcattttgttgtttattttttaattaaaaatatacatatacccacaaacatgctaatcccccataataccacttttttcttaaaattaaaaagaaatgaaagttgccacaatcttcaaccctgcaagataagaacttttaatatccctttaaaacttttttctataccagagacacatatctatatctatccactgatgtatctatatcaatacctaaaattatatataataattttacttcatgcagatcttcattgaaaagatagaatactgtgtccttggcttaggtactatgggtgtaatgatatttttatatgtttaatctgtaatcatttttggattaccacacagttattcaggttgtggctgatggaaaccacaggagtctgaggacacacttaagagctgcgtgggactcacccctgccccccaccccacatccacacatcttatcacacaagtgaccattgctcagctccttacatacaccaaactctagtgttcaggctttccagtatgcactttcttttcctttgaatgttcttccttctgctcttctcaaggctggctatttctcattttttgtgatctcaatttattcccatgtctttagggaggcattctcattctccatctaaaagagctcccctccacctgctaacaccgtctctttgatgctctaattttccttcaaaacacatcgtagtgtgttactattaatttgttgattagtgtgtatctctctgcttttcaatgaaacaagctctgtgaggctcatttgtacccattttgttcagtactgtgtatccagtacctagcgtaggatctggcagataagaaatacccagtaggatttgtggaattaatgaggtgtatagaactttattagcacaaatccacagacatatattactagcttgctttacaaccacaaggccatgaagaaagaggttgctatttcagtggtgtttattagacatatttacaagttaaaagttaaaagtgaatccttagtgaaatagttaaatcagtaataaattatagagcatgttgtattaggtcactgctctttagaaacctaagcaataacgtggaagaactgctctatgcatttctgtaatgactttagcagaagctgtgggtggaagaaagaattggactcactttgaacccagagttcctctttattagccagttataagcaagtccttttttgagccccagttttcttgtctgtaaaaggcaataagtttgtctgaagaatgatgtaggtgctacatgagatacagttaagctctgccctaatcatgtaaatgaatgtgcacagttctgttgttttgaaattaaagtgggagcccatgaagctagatggctggagttccgtagccaattgtgttatttctaaaagtttgttatggcctcagagtgtgttgttgaggaatttatgtaatgttagtgacttgtaaagagccatccacatttatggtcctatcattactattattgttatatgcttaaaaaaatccacattctattaataaataagataaatctgataagactgagcattagctttttaccttttgaattcagatagatttagtggaagcataaacttaactgacatggataataagatctatagtaaagtcaaaacagcttatcaaatcttgaatgaaactaatcttgaaaaggggctactgaaaatggccc

SEQ ID NO: 112631 - DNA, 1049 bp, Homo sapiens
tcttaggatgggttattctatacaaaactaacatttttcttctgaaaatcagcatgaaatcagaacatgaaattttctgaccttattctcagatgcaggagcgccattgaaaaaagattgaactaatgaagtaattggatgataaatattatacatctaatatctcaaacgattttttttaccgttaaaaatcatatggtaaagataagttaaaaaaaaaagcactacagtctaatttgtgtgaaaatctcacttctatttatttgagctgatcttgatgaaatatgccactactagcaacgtcaaatgaggtttgttttgttttgttttgctttttaatgatgtgtctttggcatatcctggaatcaggagtttgatgtttctcacacaattttctaagaaattataagtcaacatgtattatgttccagcccacagttccttcctggtagagaggtaggctattagcttctaactggtagatttaaggatctgtggaagtaagcaaagggccattccttacgtgctgagggacgggagaggggaattgcatgggggctaatcaacaagtcaacaatcattttagaagatttagcactggcataattaataacttcttgagaaggtaaaaccacaatttaaagatgagttatattgaaggattggtatgttataggactgtgataactagaaaaaatggcagcatagccaacaaaactcccagccaaaggatactcagtgataaaagaaggaattaactagaagttgaagtcagtaattatgttgtttacctgttcagtgtaagtgaggaaatggcatgatctacctgaaggaggaaggacccatttgattatccagagagcaagagttcattcttactattggagacttcaacttcctggttattccattaagtcattcatttaactgttttttcaaaaattccttaggcaaactaaatgagtagactgattacattaaatggcagtaattccacacagtttagacagggatagatgagattgtctgcaatgtttataaattatttt

SEQ ID NO: 112632 - DNA, 1517 bp, Homo sapiens
tttttagtagagacagagtttcaccatgttggccaggctggtctcaaactcctgacctcaggtgatccgtccacctcggcttcccaaagtgctgggactacaggcctgagccaccgtgcccggccctaaaactgtatttttattttaaaatatgaatatctattatcactaagtaataaaattaaagcttggaaatgaaaggatcatacaatgcaagagtatctaaagtcatttaaataatgtcaagaataatgttttaattattctgctcttagaattttaagcatttttagttttaaaaataaaaatggagtatttttgacaatattttgcttaacattccctaattgctgagaaatcatctgtttcagaaattagccattgacagataatgagtttgagattcccttttgccagaaaaaattgtagtaacatacaataatatggaaattgccagtatgtttgggtatttattagattgagaactatttcaaacacatctagatcaatctgtaagcaaagaatccaaaacttgtgagtttatttcttgtcgcctgtctgtttaagtctgacagtttaggcaaggagaatgtcttatgaatttgagtataatgaatttgtggaggggttttactgaatgcattttcaggattattttgaaaatacatgaagtagactgaacacggtggctcacacctgtaattccagcactttgggaggccgaagcagaaggattgcttgagttcaggagttcaggaccagcctgggccacatagtgagacggtgtctctatgaaaaactaaaactaaaactaaaaataaaatgcatgaagtaaatgcagaaaaaaaaagaaacagtttccattcaaatttctacttttcaaatctgaaacacataactgttcactctcactacatgatgtacttgttttaaggggaagaaaaattcaagatttaagaaggcatttatttacgctctcaaaaatctataggatacagtctttgaaaatgaatacatttattaattatttttggggtgcttacaacatgtttttctatgttggtcttttctaagtggagatttttctatgtaggcagataaataccagtattaggaagagatatatatttatactcatggagtacaagtgcagttttgtcacatgaatatactgcattgtggtgaagtcaggccttcattgcatccatcagtggagcaacacacttcgtacccaccaagcaacctgccatcatctatcaccccatgcctccaagtcttcattgtccatcatttcacactctgcttcttctgtacaaattatttagcttccacttgtgagaacatgtggtatttgtctgtgtctgaattgtttcacttaagataatggcctccggttctatacatgttgctgaaaaagacatgatctcaatctttttatgactgagtagtattcattgtgtacacataacacattttctttattcggtcctccactgatggacacttaagtcgattcc

SEQ ID NO: 112633 - DNA, 1059 bp, Homo sapiens
acgctcattattcagggcagtggttctcaacatgagctgtgcttcccgtgttgtaattgtctgggaaccttttataatcaccagtgctgaggccttgacatctgtggaagtgggggtgggaggttaataaatctctccaggagatgtgatgagaacctgtggtttaggaagatgttagatacgaggaggttgttgatctgcccccaagctctctagcaattctgattattttaaatgtacctgcaatatgtagccattgtatcatgcatattgaactgtctcggggtctagatatggatatatgaaccaggacgacttgggactcttactgtctggaaagaatggcattgtgttagaggaaaaataagtgttccaaaaaagctcaatcgcatagataaattctgatatttgtgatacaaattgttaaactttgattttgtaaaatattcaatttgtaatacaacctatttaagtatctttgatagattgaaaaattatttttttctgactattgtaaataataattttttttgctatagattaggagtttcctatgctctcagtctctagggctatcccttctgtattagtataactataactatataatatgtaataaatagtatgtgaccaaatgtaggaagatttttaaagccatgaccattatgatttgattcttaaaaaacaatcataataatttataattgaaaaacttttaagaagtaaaagttttggtctatgtgagtgtggtcaataggtacttcaaaattaaatgttcatagaagtttaaaaaatatattactagttatgccccaaatttgctaaatatttattgggcaattatatattagtatataatagcagtatatgctatgtagattgtatagtacaatatattgtagcaagcatatattaagtgcctaacgtgcttaaaatatattgctcatttaattctcaaataatgctgcaagaatcagtcacaggattgataactgtcaaaaaagtaaaagttggactcagatctctctttgtggaaagtccctgttttgacctctagca

SEQ ID NO: 112634 - DNA, 1087 bp, Homo sapiens
tttgtgatcttcaaaatggggtttattgaattatagactgtgcacacaatggtccactaggttgttctttactgtagttatctatttctgtggagatggatgaatatgtagtgatgtggaaagatgaacttttcataatataaagcagaatagggttgtatagtatgtttggatttttgttaataacatgttaaaagtgtcaaattgccaacaagggcaagagcataatataatgattttctgaaaccatgtgttaaagcataattaactaacttgacaaatacagtttcaatgtactatatccatgaactttggtttatctttgtgtttatatataaagtaattggatatttaatgattatttaaatgtatttagttaattcttcttgtacctagaaaaggatttgccctgtcaaagacaaagtgctggtccacttcttcatgaatatatatttcctacttttaataatttgcttgtcaatataatgagactaacaaagtgccatttaggctatttcaacatgtgtagttccctgagggcacatagctttacagcttccatagcagatactataattccttgaggtagttggcactcagtaaatgtttattgagttgatgattttcttaaggaaataaaatatccaagaaattttttttttttttgagacggagccttgctctttcacccaggctggagtgcagtggcgctatctcagctcactgcaacctccgcctcccaggttcaagcaattctcctgcctcagcctcatgagtagctgggactacaggtgcatgccaccacgtgcagctaatttttgcatttttagtagagacggggtttcactatcttggccaggctggtcttgaactcctgacctcacttgatccacctgcctcggcctcccaaaatgctgggattacaggcatgagtcaccgcacctggcctatccaagacatattttagagtattcagtcacttcttttccctccctctaattactgtgtactattatttggcattttaccagctcaaagtggaataactatttttgcttcacattgtatgtaccaaattaatttcata

SEQ ID NO: 112635 - DNA, 1839 bp, Homo sapiens
gtacttcagcacattcattaacctcctgtagggaggcaggaggaaaatggcaactttaattttctggggaaaacagtcatccaaaatatctatatattcaggcctggcacagttgttcacacctgtaatcccagcactttgggaggctgaggtgggtgggattgcatgagcctaggagttggagactagcttgggcaacatagcaaaaccctgtatccaaaaaatagaaaaaaaattaggcatagtggcatgtgcctgtagtctcaacaactcagaaggctgaggtgggaggatcacctgagcctgaagagctcaaggctacagtgagctgtgattgcgccactgcactccagcctgggcaacacattgagaccctgtctcaaaaaataaaataaacccacaacccacaagatgtctatattcagcaaaatggttcagcacagcctcttgaaatcactacattaaagttttactgagtctgactaaaattaagaaaaaattttggttgtctgttacctttataattaattttactatgggtaatctttcaatcatttgctcagttttctactgttagcattcttttagtttattttttaactttagattaaaacaattataaactaggcatggtataaaatttaaaatgttccacaagggtatgcagtgaaaaagtattttatataaaggactacatccctttccccaaccacacaattctcctccctgcggatagccagtgtgctcttcagagatgttttgtgtgcacaaaagcaattacaaataatgagattctcattattccaggtagatatgttctgtaaagtcaccgcaaacactgaacttgtgaatatggaacccttgcacttagggaaatacagcgttagtttcctgagagcttttggttacaatatttctgatcaacacataacctagttttgtgtgtgtttctgcttaaaataccttatttaacatatattgttgattccttaacatggaactcacagccaacagcactaactcatgcctgaatgaagcttatctaacatacgtagtttctctgtaagacctgttgaagccttctcgttcttaggaacatgagatagcagtaagcttgggagccattttaaaccgtgaaattgccaacacaaagcacaaaaattggaaagacatggaactaaataagactgcaaaagagacacctattttgcagtatgagagctgaacaggaggcagtgtgtcaccttgctccacctcagctggggatgtgcaggtcaggcaactccaatttttcatccctctgtgcatgtttgaaaatgaccatgaaagtgccatcagtatagacttggggttaaattttcataagtaggagaatttgcaaatacagaatcagtgaatgaggattgactatatatttttttcctttaagaacacaaatgctagtatataatacatagcattttgtatcttactctatggacttaacagtgcatcttgaagatattttatacatacacagacatatttcatttgagtaaactacgagcttctgcattctatattgttcaggctgtatataatccattacatgggcgtttgtgtttttttccagtcttttattacttggattacattgcactggaaatgttgctagatactgtcttctgtaatggttgtatattatacctctctaccaccattacaagagggaatagatagcattctttcatgtagcagcatccattgctaattgtactggataatgacttgaattctatttattctttagtactgatctactctgttggagaaaccaataaggtgcaagactccactgaa

SEQ ID NO: 112636 - DNA, 1051 bp, Homo sapiens
tactgcactccaacctgggcaacagagtgagactctgtctcaaaaaaaagaaattccccaaaacaagaaattctttcatcagaaataaatgagcagcctaccaacccacctgccttccaacctgagtgtttttttttttttctttttttttttttttttgagacagggtcccactttcacccaggctggagtgcagtggcgtgatcatggctcattgtagccttgacctccctgggctcaagcggtcctcccacctcatcctcctgagtagctgggactacaggtgcatgccaccacaccgggctaatttttctattttttgtagagatgggctttcgccacgttgcctcagcttgtttctgccttggcttcccaaagtgctgggattacaggcatgagccacctcacccggctgtgcttgctttcttgtgacaaatgttcatggcatcttgtggcagacttatgaaagctgagttaggtcaaagtgtttccttagtgcctagctcagaatactcatgctatacaaaccgttttactttttcctttcctagggtggccttggcttcatcttccctcaccttaacttgtcatcagggcagcagtgtatcaaactctgggacctgtggattcagacacagtttcaattctgcctttgctacttaatgacttggtgaacttgagcacattcattaacctccctaggcccccatttctaagtgtgaaattgagataatcaaattaggctgtagtaataattaaactagttaaggtgtgtcaatggcttacaaaatgtccagcactttctaggctctccatgaaaagtagcttttactggcatgactctcagcagatattttagtattattttgctttcaactgagtaatgaattcctagccaacatttttgaacttctcattacacattcagaaatgtcatgtcacaaccagggctaagaacttttcattgctcccaaattgcctgtcactatgactcagatttacccacctgataaggaagattccttgaccttaactcaccattcgatcttac

SEQ ID NO: 112637 - DNA, 1047 bp, Homo sapiens
gtgttcattgccttctggcagcaagggcaaaagtggaaacacaagaattttttcttttttttgagacggagtttcactgtcaccaggctggagtgcagtggcgcgatctcggctcatttacaacccctcctcccgggttcaagcgattctcctgccttagcccttctagtagctgggactacagggcgcgtaccaccacacccaggtaatttttatatttttagtagagatggggtttcacggttgttggccgggatggtctcgatctcttgacctcgtgatccacctgccttggcctcccaaagtgctgggattacaggcgtgagccaccgcgcctggctgaaacacaagaatttaagagaattcttgttatctgaaaagaaaggtgatgtctcattattgctcaagtaagttaagaacaaaccaaggtcctagcccaaagacaacaacatttgaaggaaaatcagggatataatgtcaaagaacactgcagtccaggggcgaaatgaatgtgccttgagcaacttctctaggatctcacttgatagcaggctgggatttatagtacccaggggaaggctgacagtatctttcctccagatcagctctgagctgggcttttgttgataagctgtcccaggagtgctgaggctctgtcactgacagaggaggcagatgtattgaaagcaggatcgtgggttgataatttgttagggatgtagagaagcctaactggttttcttacgtggaaaagaccaccctcttttcccacttcccagatgtgctaaactcttctggcagaggatataggattgtccttggggaattagccttgggttcactccaatgcatgggtaaatgtttggttttgcaaggcaggtgttacctggccagctccacatactttattacaaaaatcctcctgttagttctgacaggaatgcatcataattgttattttatagttgaggaagctgactctcaaagaagtgattaactcatctctgtgtgtgattcagatgagattagaaccgcccagctcctgag

SEQ ID NO: 112638 - DNA, 1049 bp, Homo sapiens
gcacaatgaaagcacgtgagagcagtttttgaaaaagttctgattgcatccattgaatttgactttttttttttttcttttttagacagtcttgctctgtcgcccaggctggagtacaatggcacgatcttggctcacagcagcctctgcctcctgggttcaagtgatttttgtgcctcagtcacccaagtagctgggattacaggcatgcaacaccatgcctagctaacttttgcatatttttttagtagagacggggtttcgccttgttgcccaagccggtctcgaactctgggcttccagcaatctgcccacctcagactcccaaagtgctgggattacaggcatgagccatcacactggcctgaatttgacccttactctaatgatttatagccatataattctcatgcaataagctaaaaatacacctaaaaatgatttactctcaaagggttttaactttttttcattgaatctcttttatgttcacttaaattttggctctgttcataaattgatacaaagacaaaatttccactaaaatattaatcttaagtagtagacgttttctaactataccttccaattggaattaagcatttaatctaaaattatatatcaaaaatacaagaaagaacttccttaattgcctggatatgtttctgcctctcaaggcctcagaaagttttgtacaaactgttagaatagccctaatcatggagataggtgttttattttttctctccaaaagcataagagaggttgggtgcagcagctcacgcctgtaatcccagcactttgggaggccagggtgggaggatggcttgaggccaggagtttgagaccagcctgagcagcacagggagaccctgtctctacatacaaacatacatacatacatacatacatacatacatacatacatacatacatacatacataactgaggtggtggcaggcaccctgtagtcccagctacttgtggaagctgaggatcattgcaccactgcactccagcctgggcaacagagtgagactctgcctca

SEQ ID NO: 112639 - DNA, 1003 bp, Homo sapiens
gcactttgggaggccaaagtgggtggatcacctgaggttaggcgttcgaggccagtctggccaacatggtaaaacatggtaaacccccatctctactaaaaatacaaaaattagccaggtgtggtgtcacacgcctttagtcccagctacttgggaggctgaagcaagagaatcgcttgaacctgggaggcagaggttgcagtgagctgagatcgcaccattgcactcagcctgggcaacaagagggaaactccatctcaaaaaaaaaaaaaaagaaagaaagaaaagaaaactaaatataaaatgaatataagcataaattcataaaaataaaaattttcttaaaattagatcaaaaatttttgtttcctaagggagaatccagagagaactgggaagaagagtggataatttccaaacacctgtgtgtgctcacacacacaccgtgaatccttcaccattgttttaatatggaagatgattggagtgtgttttctagaaattctgaataatacttatttaaagacttctattgggctggccaggcatggtggctcacgcctgtaatcccagcactttgggaggctgaggtgtgtggatcacctgaggtcaggagttacaggccagccagcctggccaacatggtgaaatcccatctctactaaaaatacaaaaattagctgggcatggtgttaggcacctgtagtcccagctactagggaggctaaggcaggagaatcacttgaacccaggaggtagagattgcagtgagccgagatcgcaccactgcactccaacctgggtggcagagcgagactccgtctcaaaaaaaaaaaaacaaaacaaaaaaccccaaaactctgttggggtcgggtgcagtggctcacacctgtaattctagcactttgggaggccaaggtgggtggaccctgtctctaccaaaaatacaaaaattagccaggtgtggtggcatacacctgcagtcccagcaacttgggaggct

SEQ ID NO: 112640 - DNA, 1035 bp, Homo sapiens
cctaacttttaagaaatatatagaatggatatttctgcatgttgttaaatacttcctgcaccaaactgtaaatgagagaatttgtttctttaatgtaatgttctggctgacacatgaaaagcttgaggagatgcatctcactctttttaggtagcacattattttttaatcatttttagacgacagggcaaagaaaactagtagctttagagaaacacaaaatatactgaataatagtattacaattgttttaagtttgaccagtcaggtacaaaatgcaataagtttcagattattttcttcatggattatgtcatttttgggtaatactcatcagtttggtgtgaagaacatttatgccaatcagggaacttttaggatgttttcaactgcaagtaacagaacttaattaactgtagcctaaaacatgaagacttttaattatttcacataacaataactttgattggaagcctcagtggttgtttagtggttttaataatgttatcaatgacctaggttctatctgagtttccgttttgccattcataatgtgtcaatagttttttcttcatggtcacaaggtggctgccatatcaccaagcttcccacacaagcatctcaagcagaaagaaaggagcagtggcatgggagcctttttatttgctttcttgtcaaggcaaagcctccaagccaacttgcactcagtaagtttataaaaggatatgctcttattttattattattattattatttattaatttattttttaagaaacaatgtttcactctgtcagccaggctggcgtgcagtggcatgattacagcttattgcagtctcatattcctgggcttaaatgatcctcctatcttagcctcccaagtagtttgaactacaggacatgccaccacacctgacaaattctaaaattttttgtagagatggggtcatgctatgttgcccaggttggtcttgaactcttatcctcaagaaatcctccagccttagcctctcaatcactgggattacaagca

SEQ ID NO: 112641 - DNA, 1055 bp, Homo sapiens
ctgttcctataaatacatacatacatatataagtaaataaataaagctttcttaatgatttggcttattctttttaaatccagcaaatgttaattctaaactttagttctgctgttagagtgagacgagattagcacattatatctgctatctgggcttagattgtgggtgttatttcacacagataattcaggcaaacccgagatttttagggggtgaacttgcattatatggatacaataagcacactcacaatagaaaactatgtggcatatactaaaagaaaaaactctaccgtgtttttgagaattataccatggataagtaacagaaggctcatcctcagagacctaagagtttgtcttctgactaaacattttatggctgatatttcttccccacagagcattcagtgtccagagactcctttttccccagcaatgctggagggatgaggaatagggagtgtgaagctgatgacatgttctaccttttcatgatggagtacagaaaataactaaaattaggtgctaatggttgtccttcttcaggattaaattttactcagtggaaagaatataggttcttttatgtttatagtttatcatatctagatgtgctataatagatttaaactgttttctctaggtagttacaacataacagctccgtatgtcttgtttatatgcaatatctaggacatttggaatgaagtagttttccaaagcattatataaattaagttttcattgaccttaggccagaccatcaatagcttgctagttgtctttaatattagcttaaattgtattttttcatgtgaaaatgaaaataaatattcttgttttctctttatttcatttgggtttaatgatttaatatttttgcccttttcttttgaaatggaattttgctcttgttgcccaggctggagtgcagtggcgtaatttcggctcactgcaacctcagcctcccggtttcaagcaattctcctgtctcagcctcctgagtagctgggattacaggcatgtgccaccacacccagctaatttttt

SEQ ID NO: 112642 - DNA, 1023 bp, Homo sapiens
attacaagcatgagccaccgcgcccggcctccctgttccagttttctataatctgttcatattatattctgggtatatgtgggtggtgtgattatccatgtggtcttattttcacattctttgcattaactataatgtacttaatgttttaagataagtttcattctacaaagatgtatgtacaatacctggtatcaggtaacaatcttaaaaaaactaattcatttaaaaataaacattaaaattagcaatacaattaaacataaagacagtttgtgaggacattgaactgcccattcttactccaaatgaatttgctttcttagactgaggaggaggggccatattgttgatgtcacaataaacttgtttctccttcttcaataataaattacataatttgatttttttaataggaaaggatcatacttcaagggaggatgataaaaaacattaatttaactttagaattacaacttttacatgtgggcccaggaatgtatctaatgggacaaaggttccccagggacaaaagtcatctaatctaatacagacaaaaggttaagcataaacctgtccctagagtgagaaaaaaatgaatagaataattggctcagggaccttgtggcacctggaaacagatgctgcacacgtacctggagtacgtggttaacaaatatcttcagtagtactgcagaatgcctaggagatagtgtctggttaagaggagctagaaagattttgatactctctgaaacgaagtttagaaggggccagtctgtctagtccagaggccaggctctgtggatccagagagcctggtatgtgtgatctgcttgggagcaatgtgacagggctttccacaggactgctttgtgaagcagatcatactggtctgggccatttctagtcttctagacttcctttctgagagaagaaagatggagaaggttacctttcagtacacagaaagtagatgttttgttttgttttacattttattttattttctctcctctcctc

SEQ ID NO: 112643 - DNA, 1428 bp, Homo sapiens
ggcttatctcagggattcagatttagcagatctgtggaggggtccagacaagtgttactgtgaaaaaccttcccacttgccctagggagaagcactgctctgtatgaaactgattccatctctcattctttgggtttgtcttctcaaaccatcgattttacagactgaactcttccttagctaatctgctttacctgctttgtcatctatgtgggaccagtacatagctcagcatgaaagtactcatctcccttttctcctacctgtaatttacaaccaattcctgtgtgagttggctgtcagttccctttttctcggttcattgtgcttgccactgacttcctttagctccccaggactacttttagtcttctagattcctacctcccattgtctttctgagtcactgatctgatcttgtcatcacaatggttaaaaaccttcagtggtttcccgttgttttaaggtcattcaaaatctggcaccaaattcccttcttaatgttacctctagaagcagcccttgtccagtgcctacttagttgaaatttgaattccaaagccttcttctctccacccatctatatctattgctctttatttgtggttcactggcacttggtttataaatagataaatattttctctgaaatcagtgcttaccacagaatttggcatattcagtgtttgaatagttgaatgaatgcatgcatggacatacgaggctgttcattaacttttaaatgtatctgattatattatctggcactgctttgtatttcgttaagtgaatcatgggagattgtccagtcccttaaaaatattttactctcttcatctgatctcatttttaagaagaaaacataggcatttaacatgactaattatcagtgaatccatgctaactgttggggattattagtccttttctagatactcaaactatctattccaatcagagagagatgatttttttattttatattttattgattgattgattgattgagacagggtctcactctgttgcctaggctggagtacagtggtacgatctcagctcactgcaacgtctgcctcccagtctaaagtgatcctcccacttcagccttccaaatagctgggaccacaggcatacaccaccacgcatggctaatttttgtattgtttgtagagatgggatttccccacgttgcccaggctggtctcctgagctcaaagcaatccagattgctgggattacagctgtgagccaccgtgcctggctgagatgacttttaaaaaaagacttctctaaagtagaaggaagggtggaattgtatgcacaagaagaaaaaaacctggaagaaaaacatactaaagaggtaaaaaaaaaatagatctgtaaaggtggtaaaacaatggttattatttatctttgttgatgaaa

SEQ ID NO: 112644 - DNA, 3596 bp, Homo sapiens
gcctcttctctccattcactcagtactgagccagacaggtctcagccctcgtgggactgaaaatgacaaaaatgtgccaacgtatctactcctgttaggttctgaccactgtttcctcctagttctttatctgtacctttcttctggcaatatcctttactgttatatacatggttattaacttacagaccatcagctcttcaggttacggttcttgtcatcccactcttgattctgcaaagcacctagcagagtgctttgcataaggcacattcttgagaaaatgtccagtgagttgaaatggtgattggtgcccattttattgccagcactactcgttaatacccgaaggttaacaggctagaacttgcataccgtggcagagtcacatcttgggatttttcccttcctggcttctgctctctgttgatgttatgttcttagattgcttattgcagtcaaagaaccctgctggctgttacccctcccttgcaactcttcctgaccctaattgtcttactttcatgtttttttttaaatgccagattttgtgcatttctcccaatatcccagggtgcccaattttatctctcctccctccccaaaaactgtacagccaaaaagactttaaacactttttaaaatttaattttattagccgggtgtggtggctcctgcctgtaatcccagcactttgggaggctgaggtgggtggattacctgacgacaggagttcgagaccagccaggccaatatggtgaaaccccatctctactaaaaatacaaaaaaattagccgagcgtggtggcgggtgcctgtaatcccagctactcgggaggttgaggcaggagaattgcttgaacccgggaggttcaaattaaagcttttagtttttatttttaatagaatccagctaatgcaggacaaaaagtcttgaaccagattttcttttcactccctttttaataggagaagggaactccataaccaaggcttagaccctcttgaggagagaggaacttgaggaaaccataaaatcttacctttttcagactcattaacttaaaatggtttgaaatagcttctggaggaaaaacatgatatagtgaagcttctactctgtcttttgggaatttatggttgtccttataaatctcttcttagtaacaggcaaaacttgttaatttagagaattaaaacatcctctctcaaaagtgaactacattggcttttgaagaactgtgagaatggccaggagtagtattttgccagtatgctgcctttgctaactagcatcatttaagaggacctaaaataagaatactttattaaacatacgctataatccatacttactaaccatagcgcaaattaatgttaacataccctataatccatacttactaaccatagcacgtgttaatggaatggggcccgacttttggagtagcatttgtataaaccctaaagggttcaactgaggctagttttcaagtttattgctgctttaatgaatcattaacctcatactcattggcctagccatgaaagtaaatactgcagactttttttactttgctagcaaaaagtttcatatataataggttagaatagcaattgaaatgcaaagtaataagtgtattcccttgtagaatcatcctgggcctcatcttgaaactacatgtccagtgaaaaatatcctgtctggttatattatctggtcaatgagagtttattacatgaggtagagaaaaatgtctgctcataggtccaaataggagttttgaattctaattttcactgaaaagtccttgcaattttacaacattgaaaatagagacattttgctcttttatgagatgtctggcctttacctgtttttctcactaagagctgacttaagttggaagtgctgctagccagggagcaaaatcacctggtgattgctaaggcgacatataattcattgagtgagaagggaagctgggctctctctgccttctctttcagcagcctgccaggtttgtgctaacagcagtggatgctagttgctccagttgtaattgtctagccaatgatgattatcttctgatgtcggctgacacggtgcccaccaataggaaagcaggaggcctgtgctgactgctgtaacattatgtatgtgaggtgacgtcttcaaagggcttgcctagaacttcatgaaaccctccccctctcctggcattctccacacatccagcctttcaaagctttatatatttttctgacttttctccccactcactcccttggtggtgtaaaagggtttacttgttttaacattttgtattctgtattatagagtctataagatagtataggaattttaagaattaaatgctgttcagctgaggaagcctttttattcacaaatttgtttttaccaaaggtaaaaatggagtgaaacattttattttattttgttttatttttgagacagggtctcactctgttgcccaggctggagtgcagtggcacaatcttggctcactgcaacctctgcctccgggttccagtgattcttatgtctcaacctcccaagcagctgggattacaggtgcctgccatgacaccaagctaatttttgtatttttagtagagatgggaattcaccgtgttggtcaggttggtcttgaactcctgacctcaagtaatccgcccacctcggcctccgaaagtgctgagataacaggcttgagccactgcaaccggccgtgaaacattttaaaaggagttgtacatctatatcttttttgtaggtgaagtttggaaagtaacacgatgtacaatttcatgattaaagaacataaaaagcactaaaaacctgtgttagcatttaactcaaatatagcagcataaaaaatatagcagcataatgttaatgaaactgttcaaatgcagacatagtatttggctgttgtttttcatttagtgaggattgctttgaattgcttcctgaagtcttccttgcaaccttctacattcatttgtaagaaaaatggctggaaaacagtgcatctgtgactatggaacagagtaggccagagtttcatttcatcattaacattgcagcaacaaatttggtcagctctgtaggaatatagtgtgtctatattgtactcatgtcacttgctgtttattttgaggtatcacagttcatattgatttaggattaaaacttgtgtgaggatcataacatgacattcaataatttttagaaagcactgggatgtaggcatatgtactaggttaagagtgagaagaatgagaaaatacatagagaaaaaacgtgtaatctgtgtggggtcctagaaaataatgtaaagttgtgctggagctttgatatgaactttcatgtatcttttaataaattataaatattcatgcaattcttgtttaggattccaaaggatgaaagccagcttaatgcaaaatattttatgattatattatccatctgtgtatttgtactagttataattagtgcttaaaattttttcatgaagtctttttcacattggaagtaaaattttgtgatcttcagaggattgcctgtt

SEQ ID NO: 112645 - DNA, 2034 bp, Homo sapiens
gggcctgggttagcgtgaatctaagccagagctcccgggtgggggtgggggtaggggtgggggtggtcccagaggtagggcgaggaggtgggaagcgtattcccttcactggtgatctcaacgtagatttgcccggagttctcttgcaagagagctggcaggttttactatttcccaatcgtttactcgccaagctctcgggtccacgcgccgcggggatgcgccctgcaagctgaaacttcattcaaagcaaggcggcccacgaggttgggcttaggggatctggatgacctccaggccacttcctttctctctgcgcccttcccccactcttccaaccaccttcgctgtaaacaaaactgtcccccccgggcggagagaggtcgcgctctttcgcacactccctcgccaagggttaatttctcaaatcgcacgagggggaggagatttccctgtagacgagtaaaaagggtgatggacaaacgtgcgggcactaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggtacgtgatgctttcgcctgatactgttcccgggagccctgcgcgtcttcccggagtgccttaatgtcggtattccctgcctgggcgtgaatggagcgatgaatcgcgggcagccagctgatcgctgagttctcgggtctcccgggtgcaggagacgctgggggggggggggtacatgaagcgcgaggtctgtgggtgcccctgtgtgaaccgcggctacataggcatcttttatatagattatataacacagaacatatgtgtgtgcacagggtgatgtctgcgcgacagggaaggcgggagagatgccacagtccagatcgcctacctgtgctcccctcccctcccccggttttcatctagatttgggttttctcgcttggcctctcccgcaaccggagtgtgaaaggcagtggagggaggaccttgtctcctgttgcctttaaccctctcccgcccgccgcccttggccctggtcctcgctgtctctccatccctcgtgtccttcctttctccttgcagcgctcctacttcaccgtcctcctctgtctgccgctcctcaggcggatgccccctttttagtacccctttccccacgcggttccctttccggtttcatagagagaccgggtgggagggaggaggggacaatgaaaacagtaataaatgaatgaacccgagcgagtggagccacgccattattaagtttctgttttacggaaacgccttttggacacacttctaattctgtgcgtagctgctgattggagttcaggcacacagattaaaagcccctccgtctgcagagtccttaggggctcttccctaggaaactaataatcagggaaaacacctttcttgtttactgtagtccccccgccagaccttttgaaaatccctgtgtgggaggcgatccagtgtcaccttgcaatatttaacagaggagggtgtgctcatctcgcttcttgtagacagggttgtggcagaggcattcctctcctccccttaacttcgggtctggcgatctgtaaagttcaagcccaacgcaccccggagctaggcaaggggccggcagcccgggggatggcttgaccggggagggtcgggccgcagggtctcccgggagccgggggattccgcccgccgcgtgcgcgagcgcgcgtgccccgcgcc

SEQ ID NO: 112646 - DNA, 1118 bp, Homo sapiens
taaataatagttcattgcctggatgtaccagtttattcattcacctactgaaggacattgtggttgcttccaagttttggtaattatgaataaagttgctaaaaatatctgtgtgcaggtttttgtggagacataagttttcaactcttttgggtgaataccaagcagtgagattgctggatcatatggtaaagacatgtttaattttgtaagaaaccgacaaattgtctttccaaagtggctgaaccactttgtattcctactgtcaatgaatgagagctcctgttgctttacactgtcaccagcatttggtgttgtcattgccagatgtggcaaagtacaagttgcaaatcaaaggtcagtctttaggacatcaaaattgcaaatctttaggggtttcataggattgaaatttcataaggctgaaatcacacctggtatgatacatgatattccagataaagggatgagagccatgaaattaattgagctgctttcagaatgcatcagatatcaaaataaagaactcctgactttttttttttttttttaaagttagggtagctagtctttgaaaaggatcaggtactatttggcttgatttccccaaatcagaccacaggtcagactattaaattagttatagagtatatacccctattaaaaatgggcacattgaatttgctcctagataaattgatctatatgaatcttgagaagggttaaagaaaaaaaatccattcatacatacacagaaaaatgattagaaggatatatacccaaatattaaagtaattatctttaggtgataggattatgagtgatttttcttttctctttcttttattttttatcgatatttatataagattctttaataggcagggactaatacattttatttgaaatacatgccaaggccagatgtggtggctcatgcctgtaatcccagcactttgggaggctgaggtgggcagatcacgaggtcaggagatcgagaccatcctggccaacatggtgaaaccctgtatctactaaaaatacaaaaattagctgggcgtggtggtgcatgcctgtaatcccagcactttgggaggccaaggcgggcagatcacgag

SEQ ID NO: 112647 - DNA, 1046 bp, Homo sapiens
atggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaata

SEQ ID NO: 112648 - DNA, 1425 bp, Homo sapiens
acttggctcgacaagcagccgccctggaaggagaggcagctgcaaggagagcccagcgccgcggctacaaagcactagggtggagctgcggaatagcgggcggggtgggagggcgttttcgaaggatcccagaaaacccatagactctgtctttaattacttgccatttctaccctaggccatctaaactttgctcaggcgagaagagtacgtgagaggcccgttcccttgatgtgcaagagagctaatgaaagactgaccttgctcaaaaccacgccgcccaggacccagctctggctctggacagttaaactaaaaccattttcaacttcttcccggccttttatccaccagcatagcctcatgccttgcacaaatgccacccagagagtgtcttcattccctctgatttgggagagcattttggtctttattctttttatcgttgttttcttctttttgtttgctctgctctaaccgggggctttattttttctacccagagcacttaattttttttttttaacagcaaagcctctggatgccgcttgatttgcttgattctgttttctgcttccagaatcctaacaaatttggaatcttccaccgaccagcataaaccaggacgttgctattgggttatttatttgagctcatttttgccaatccataaagtacagatttgctacaaagttaaggtaagccctttttacaaaactatgattataatttagaagagggggtgtgagtttcaatttccagagttcaactcctgagagaagataaataaaccaagcagaaaagtctttcttctttttttctttctccttctaagaggactagtagttgtgtattaaaactttgctcccggagatcacaaaactaggaaatagggtgtgtgggagagacctgaatggccgaaacaaccgtaaagaaggtgtaagaagcgcgagcccaggagggaaaaagctgggccagggccgggacaaaggtttcccagggagggccaactcttccgtgtctctggcgggttttccttgttaaaggctcacaggttggagcctgttcgcggctcttggcctggtagggattttattagctctgctctggcaactgcaagccaggaacacaatgtcctgtgcaggggattgcccatgcagcccagctcgtgagatcgcgggatggcggggcagtgagccggtgccgctctgggagcctgagccagggcggcagtcctgtcggcctcggagagggaactgtaatctcgcaaccaggccgccgcgaggccttctgcctttgcaaagctgcgccccaccggcgccctcccaggcggcgctgccttccacattctctcctggtctacttggcctgtacctccacaacatcctccccccatccctcccagactccgtgctggctcctacc

SEQ ID NO: 112649 - DNA, 1009 bp, Homo sapiens
agctcctggagctgctggctggtaaagtgagtccgctgccgcctttgccgcttcttcttagacgggtcctcggcgcccacgtcctcattcttcccctgctggcttttatctttctctgaaaacgaaacacacacactttcccgtcagcatgcccacctgcaacgcggacgccaactggaccggcggcagaagccgtggaagagctgggctgcctggcgccggaggagggtgcgcgcggcggctccgggccgcgaggagcgctgcgcctgtggggtgtgcaggcgcaagtgtgggtgtccgcgccccatttcctcccctcccccagcgccgcacgttttatttacatgtttatctcactgcagcggcacattcacttttatagcctgtgctttcaagtatatttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcc

SEQ ID NO: 112650 - DNA, 1114 bp, Homo sapiens
tgaagtattatctgaagcagggctgaagcagatgtcttgggagagaaaacagtagcagcataccagcagtgtgagctgccatagtcaggcctgggtcactcagccttaatgagatcatgctgacagccaaccagaaaggcagagctgaaaaaaaaatttcattggaagcattggagccactgttgctaagctaaggccagcttgcacatgtgacttggcagagagttctgcgaattcataaatcttgccagatttagggagctgggggcattgaaaaatgaccaagacccatgtagtcatggaatgcagtctacaagtgaaaatgtcattttgttttttgctctaagcaaccaatttccccaattcaacaattgccaaaatatgcccattacccttttctgacttctactttcattcatcagtaaacatttaccaaacaaacatctataagtcatgtgttatatgcttggcaaaggaagaggtgacatgggttctgacccatgaaagcatgtggaaccctagaagatgggcctgggccactactcctagtctgcttgagcagtttcttctagctcctgttagaggcatgccatccccgaattctcttcacctgtattactgtcaagttagaataatggccttgtgtttggattgagcatggtgaaaaaagatttttaccatcatggagagtgtctgagcagtagtgaaattctactctaattcatccctaccacttcttggaaaaactgtgaggctccatatcccggggggttgcataaagggaggaaaagagggtctttatgaggctcagagttgagttgagggtctagtctcctaaatatcattttataaagatcttttcagtaataaaagaatccctgaggctgtagctcctgggctaggccttccgatgggaaatacagaaggccatcagctcagctgagtacaaagagtagtgattctgcggggagagggttatggcagcggggcagggtggctgaaaggatcaacagccattatttttaaatctccctggatctcttttgtgatacttaaattgtagagtaaagaacaagatgtagtaggaaaacaacactttggagagaaagcacac

SEQ ID NO: 112651 - DNA, 1039 bp, Homo sapiens
aattatgtatattcatatttttgtctgttttattagacatatcatcatcatcattatatatcatcatcatcattatatattagacattgtgaggagtatgaaaagcttaaattttggtcctttttctttaagaatatataatatgctaaaagtgtagattttgaatggtctcaccacaaaaatagaaaaagtatgtggggtgaaggataggtcagttagcctgacttaattattctgcaatacgtacaagtaggataacatcacattgtatcccataagtatatacaattattatttgtcaattataaaagtaaaagaagtaaaaacaatacacaatctggccaggaatatatggccctttcatgttaatgagataacttcaatgctggatgctaaactgagtgccaactaagttgtgaatagaatttaaacgaagtcttaaagaatggtcaaaatgtaaaaaggcagaaatgagaagcgagggtctttcaagcaaagaaatctggttgagaatcatgtggagataaaatagattaaaggcatagctctggactcattaggatcatctgaggagctttaaaaatctggtgtcaaggccacactctagagttatcaagtaagactctctatgggtgggatcaggaatctgtacagtatttctaaagcttcccaggtgattgattccaaaggacaataaaggttgagaactgctggagtgaagcatgttgtaggagctatcagatctgcttgggtacaactgcagtagagaaaagaagagagaggaagcaatttgaacagaaacaaaaatgctaggccattgtgtgaaatcttataaattttagttattgagaatggaatacaactagaaagaagaatgaattactttcctcagttgatggtgactagaactgtgtggcaattaattgtcaaaagaatgctggctatattgtggagatgatgatgacttcagtttaaatgtatttattttaagctaacagtgaggcattctgttaagtatatctattgtctttttgtctac

SEQ ID NO: 112652 - DNA, 1065 bp, Homo sapiens
ctaataagctcgcaaatgatgctgattctgttggtccaggaactatgctttgaatagccctgcaaatcgtaattttttattcgatatttgtaaagagatgaaagaaaattaaaaggcttggcaagcaaaaagaaatgaaaagtaatgtgtactcggtgttcatataggaaataaaacagtgtaatgactacttcgaaggaaaaaaattcttccaaaacgtaggccacatctacccaacagtatgcaaacatttggagaggaaattaattggtacatatggctgtaggtgttcatttctaactaaactaaacagtccatcaaagcctttctttcagacatttaattaagtaattctgaggagattatgtcatttaaatatttcttgtctgggggtcagggacccacttaggttcaggtatctcttctgctcatctctaaatccttgtttagcaactccacccagaccattaacaaaatccagggtaagcttgtcagttaggagtaaaggagagctgtttgggacaaatagtataattcagtttgtaaatgtctttacccttgaagtggagatctgggcaatcatcttaaaacgataagctccctaatggcaagttcaaaggaaatctttatccatccctcaaggctcatcttaaattgcactccctcattaattctttcctgattccatcaacagactgtaagcaccaaatccttatctcactggcagatctcttaagatataacctactaattccgaactgtaatgttatttgttgtattagtgtggatccaatcacacagtgggttacatagaagaagtataatataaagaattattaaactctgataaatgaatatacagaaaaaaggacagtaaaggaaaactataaggaaccctagggctgaataagagtatcaaggaagaacaaagttgtaagggggccccctccccagacctggggttcagacctcattggagaaggtatagtttagcctgataactgaaacagaaaagttcactggtttgcattagcccgagctggtctggggtcactaggagagcag

SEQ ID NO: 112653 - DNA, 1054 bp, Homo sapiens
agggactctcccagagcacgttcttcataaatacagatgagatcaaagcttcagttaaaaagtggagaggcaagaatattgctttcggttataagaggccagccatagtaagggaaaagagaagttgcgtaattttttaaactctctgagtttatctcatttaaataaagtgtgataatgggcattataacatcaaatatcttaaagattaggcaaaaggtttaattttaaaaattgaattgtatgttggatgaattttctacagcaaatacagtatttagactttccaaatacctgaggtaagccgctctttagactcacattaaggagcaggaattcaaatgattattggcctttattacagcctgtactgttaggacaattaatacctgtctctcctcatctttcttcatctgtcctttctgtcacgtttcacaaattccagtatcatcactaaatgcattaatagatgtataccttacattgtttcaataggttacttaggaaacagagtaatactgtgtggcacacaaaatatgccttagcgttaggtttgatcaccacgtggagtgtaatttttcatctgtgacaatataagagaaagtgactcaagcaaataatttggtagcttgttcttcggattcccttcctagtggtttttcccgttaactattcatttgctcaagggcttgatttcctctaacttaaattgcttaactggaaaagtgaagaagacagcacaagaattcctttgggggtggggaggggttgcatttgagcaggggtttccaaagtaaattttcaaatagttgtaagggagcatataaaaatacttcatttaagcttctgtgtacttcattagtatgattatgtagacatcactaatagttgtggtctttccaaaattgcttatggtacaaagtaaaaggataaaacaaaaaatgaaaagtacatcttagaaaacatatcactttgcatacctgcctccttcattgaatgtcatgaaagttcattctcctgtactcctttgaagtgttatttttatcattctgtt

SEQ ID NO: 112654 - DNA, 2053 bp, Homo sapiens
aaatagtattacatgtgtaaagatatttgaggaagaaatgaaattaacaactatggaacatatcccaaggactcattttatttagtttttatttagggagatgatttttgtttgtcctgttggttggtttaaggatacaaggactccagattacaaatggaatatttttgaaagattggtttctaagttaatgatttagaacttaaggtgaacttttccatgaaaacaatgatataaacaggaacagaaccaaaactaattagctggaaatgagacagaggccatcttcctgccgtcttttctacttggcacgctcacttcgtgttccggagtcatggatagcctcatgggtattgagaggaaattagaggcaggagctagcagaggcgctccttttaacccagaaaagagctatggttgtatgctcttgaacaccatagctccagaggcacctgacttgtgctcctctagctctttcaatgattttgtcaacacctaattttctgtattaagtccctttctatttctattcccctcacagagtttgccctttcctaataatttgatggaggtttctttcttgggctatttctcaagctaaatcctcgtccacatacatcccttccttcactgatttttctttccacttctgtctgaaaggttcattccttttcctcaacctggaaagctctttcatcagcttgttattacaataccagaacaaaatgtatctttattttgttacttatttcatatatatatgaaatatataaaacacctagtattaacataggtgttttattactagttaagatattgtctgcatcatttttaacaatttgtctttagatgctactccatttgagcaaaaaatgaaggttcttctgtcattctggcctgagtctttccaggtagggcgattgacaaaggatgcctggttaaaatcaagtcacttaagaaaggaggccttgggagaatgaatcaagtcctgtagatgaagaaactgtgccaggtttgaaataggatcaggtgtctaaagagagataagcaagggaaagaagcaatttcagggaatgtccaagaaactgaagggacaggacacagctattccatatatgtgttggtaattgtgtgtatgagagatgatccaagtatgttcatgagggtgaatgccaggtggctttatgtaagagtttctgtgccctgatgcatagctgaaaggctaaacatctctagtccattattatatgccttaaatgtcaatagcatctgcttagatgtggcacaatgtacaggtcactcacaatctgaaataacctaacatgaccctcttacctagagaatagggaagtcccattatccttagattgactttcgaattattaactctagctttaacgtctttatgattataaaagtaatgtgtgctttggaaaattagaactatagaaagatctaaagaagaaaaaagcctttgaaatcccactctattttgggattttgatatcaaatattttgatatcaaatatgaaacttggtattactacagtatattcatttgtctatgtgtatatgcatatatacacactttttttttgagatagggttttgctatgttgcccaggctaatctcaaactactagcctcaagcaatcctcccgtctcagcctcccgaagtactgggattacaggtctgagcctctgtgcccagccacacatgtatttttaatatgttttaatataaatataattttgtgtcttcttttacaaaaggttgtgtcattttcccatgttatggaaattctatgtgaaaactctctttagggctgccaaataattcattcccctaacaccgcacattgaagttgcttcaagctttcttttataaatcgtgctgtctgaaaatatttgcttgtaaatccttaaacttctaccctggtatagattcctagaagtagaagaactaggtcaatgagtcaaactctttgaagcctcttgaaacatcctaaagaatttaattcaagaaaggttgtactcatttacacttgcagca

SEQ ID NO: 112655 - DNA, 1067 bp, Homo sapiens
tacatgcattgtataatgatgaaatcagtgtatttaggatatccatcacctcaaacatttattatttctttgtgttgggaacattcaaatattctcttctagcttttttgaaatatacaatatattgctgttaactgcagtcactaactgtgctattgaacactagattttttctgactgtatgattgtgctttatcaccccttttccccccatacatacatacttcccagctctgttaactgtcattctactctgtctccaaaaaatcaacctttttagctctcacatatgaatgagaacttgcaatatttgtctttctgtgcctggcttatttcacttttaaataaagtggtcatggaagagctcactgaggtaatagttgagcaaagacccaaagtaaatgagaattacctacttggctgtgcccctcggtttgctttgactctttagtagagtaaagcaatttaagtcccagtcttagtaactatggtaacatatctttcttcaatctagattctcaattctttctcacaatccccacttccagttctctatattttgttgctattttatttgctcctactgtaagcaaacgcaaattctttgtggaaagataggaggaaaaagtaaattaactatggacttatttcagttagcaaatttcctcttttaaagggtgcatttattataccaaagccagacaaagacacatcaaagaaagaaaactgcagaccagtatctctgatgactattgaggtacaaatcctcaacaaaatactagcaaaccaaattcaacaatatactaaaaaggttattcatcatgaccaagtgcgatttatcccagggacacaaggatagttcaacatacacaaatcaatcaatgtgatgtatcaacagaatgagggataaaaaccatatgatcatttcaattgatgctgaaaaagcatttgataaaattcaacatcccttcatgattaaaaaacactaaaaaactggatatagaaagaaaatatctcaacataacaaaagccacatatgacagacccacagctagtatcatactaaa

SEQ ID NO: 112656 - DNA, 1082 bp, Homo sapiens
ttaaatttttttataattaaaaaaaaagaagaagaagcaggctgcaacagccacagcttgcccagacctgtccttactgggtcttcagcttccagtctcaatcccaccagctgatctcaagatctgagataatgtgagcattgctgtctcctcgcctggcctgatttactaactctctgttttgatttaagtgttgcaacacctccttcttcccctgaaaaacccacaagcatttgtagatttaatttattttacaaagaatttaaaccttcagacagtacctaccacatccagattagggtactttcttcgtactaaaaccacaaaaatactgaaaaaaaaagtcttaaaaagcttcagtaacaacaaaaaaaaccccaaagtacaatgagtgcatagattacaagaaattgggaagagtaaaaaaaaaaatttttttaagaactttaataaaaaatgaagaaaaaaaggccagaaacagtatcaacatgctgaacactggagaaatagagagggatgagggatcagcagaattacatactaaatcgaggactcttcaagttctaccctaaagaaaagaaagctttaatattaggcaagaataagggtttttttaaaatgtagtatattgttatggatcatatcaaagtacaagaaacataaaattgacccagtcataatatatcagtgaaggaaaaaataatttagaaatcaattttttaaaaaaagaaaagatccacaaattataacttaagagaaaactatcagtatcaaaaaaggatcacataaatcattttatggattagaaaactgaagttcaggaaaagtgaagtaatttggctaaggtcatgtcactcagttaaagtgttgcagcctggatgtgaactccctagataactctacaacattttgttcttctcactctttttctgatagaagtgaaaatccaaaagtaattttaaaaattatataaaataggccgggcacagtggctcacgctggtaattccagcactttgggaggccaaggcaggtggatcacctgaggccaggagttcaagaccagtctgaccaacatggtga

SEQ ID NO: 112657 - DNA, 2130 bp, Homo sapiens
atttagggcatctatataatgaacaggaaactatgcaagggcctgcgctgaagtctgcttagctgagcctaagacaaagatcacagcagtagtggctgaggattgctcaataataacagcaaacatgctttggtcatctgaggctcggtttcttaacgtcttagtgtcaaaggaaccgtctaaaaagaatcttaccaggacagagcagtcaggccttgcctcataaaacaggagggtggcagaaaagggtgttctgaaatcatggtcactcacaagagaaatacaaacatgattcttcacttaagcagtcatttttgtgcaattccaggatcaaaaagaacattcccattgtgttaacaggtacttgtagaataattatcagaagtatgcccagcactttggaagatgaagaactaaggttcttaaagacgtttacatatttctcatgttatgttcatgttttgtctttttttttttttttaaaggatgttgaagactcacagaaccacactggtgagccggttggagatgactacaagaaaatgggaacactttttggtgaactgaacaaaaaccttatcaacatgggcttcacaaggatgtattttggagaacgaatagtggaaccagtaatagtcattttcttttgggttatgctgtggttccttggcctgcaagcccttggactagttgctgttctttgccttgttattatttatgtgcaacagtaaaacatggccgaattgaattgtttgacatttggtagccatatatgtaattgaagaagttatatatttcactttttgacaaccgaaaaagtttgccttgtttcaaatcatgtgctggctgttttgtaagtaaatttatacatggatgtcacttaaaactaaactcttgatcataacagggttgaatatatattttgaatatacattagcttattcaaaactcttgtttcactactgtgatctctgtctcctttatacacctctatccccatgccaaatcttaagtaacaccaccagaaagtgaacagggaaaataacaggacatggaattcaaatcaagcaatatagttcttataaagagttccaataaaacatttcagaagaaaaagtatgaaacaagctaaaagtaagtttcacttagaaaacttctccccactcacactccccaccaaataatctcatattatttgggaaatatttggatttcaattgtccctacccagcctaaactaaggtaaatgataattagcatacactaccttaatattgtgatgaaaatcagtaaagatagaacgttttctaaaggtcaaaaataatatatttattattactggggaaagctcccaggttaaatataacttttttaaaatgtaacatttggacctagacctactttaatatatcatttgaagtttcagacaattttggtgctaattactttttgtgagtttttaaagtctcatagcctagttgactgcaccctatggtaatgccatattttcttgtatctaacaagttgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttattt

SEQ ID NO: 112658 - DNA, 1062 bp, Homo sapiens
ctgtacagaatttaagactcctacattcaattgcttgcccaatatttatttgcatttggttatcccatagtacccaagactcagcgtgtccaaacgagcgcagcatccttctcccaaatctttaattcctgtttcccatctcagcaaatgacacaatcctttccctaactgctcaagcaggagttgtagatgacatccttgactctgtgtttcctacactacctacatgtaaccaagtaccaaatctattttacttctaaaaatataatctttctacttctattcattcctagcatcactgagtccattctgccatcatctcacctggcatgctgagaatcctgattagcctccctaccttcattttccactttgtagttacagatctttctaaagaattattctaacatgattctgatatccttgacctaaatcttttcaatggctttctgttttcgttatgataaagtccttatgccttaatatgttttacaaggctcttcatgtactggttcttgcgtacctcatctctctatactgccactctccatttccaggattcaactatactgaacttttccccagttcctttaaagagacatgctttcttacttccagaactttgtacatgctttacttctttaactgctccctaccagactgaccaatatctacacagccttaagacctcaagtgagacatcatgtcctccagggaaacttctctgactcctttaaatccagttttggttcttcattatggcttggtttctcaagtgcaaccctgtgctttccaggtcagcacttctcatgctatattgcaatagcttatttgtcagctgctgctttaataattgattaattattaaattaatcaataggcttcacaagggaagagaacatgtctgtcattctataattgcattgctagtgcctaacacaatgcctgggacataataggccatcaaaatatttatcaagtaaacccacttcatctactcatggtcttcatatagaccactaacaaaaaagatctagagctggttgtactttgaagttcttt

SEQ ID NO: 112659 - DNA, 1825 bp, Homo sapiens
cccccgtggctcctcctcttcggcccccggcggggaatccctttcaccgtcccccggcggctggaggtggcggtcgagagccctgctacactcactgcttagcagacgtcagactggtggtcgtcttggaggcccagtctggggtccggtcttggggcctcctcggaaagaggtagaagagggggcggggtgtccctcctgccagggcgccctgtcacgcggggaaggagtcacgggagacatcatctccaggaaacaaggggtagcttcgcgctaatgggctgtaggaccggctccacggcaacctggacacaccctgcgctgagcttaggtttaacgccaaagctagtatccctgtatctgaccctctctttagccctggcagagcaggtgggatctggctccggagttaatgcctcagattgattttaagtagaagtcatttggatgctggagtaaaataaggttccagatactgatgaactctggtagctacaaagacttgctgaattgcagagttcccaatgggcattcagattcttggtgctcataactacagggacaatgtgtaattttttcgtattaagtttttgaaatttcgagaggaattccttgccctgattgctactcaaacgtcctgtaacattaggtaaattgcagtccttctgaacttcacttctcttgagtaaacctgggatattgcttaggttttgtatatgcaccatccacagaatagtaatttcataattccgtttttgtgtttttttatttcatatatattgaaaaaattagagcaaattcctttggggttggctttgttgttattaaatgtccctccggaattcaaacctagaattgaaaatctgaaccaagccagtttgtgtaaggactaagactgttttgcactttctgaaacagattgctaatttttcataatctgttccatttaactaacattattgggtaataagatgttcaacataaataaattgcagtaaatgatcataatttgaatctttggtaatggagatcttataaaatataggattctcattcattaattaggcattgtgtcacctctctgatacaaaatagctaaggttttacactaagtatccctagaatggaagggcaaggatttgcagtttgtgcctagtgtaatatttcgatttccctaatttatgagttattactcttgagtgggacatgacagttgttttatcttgtcatccaggatcatctggtttaagtatttataatttttgtgtgtgaatgaaacttacaaggtcaagctgcttaagtaggcttgcccaataactagatgccacacaatctttggcttttactattatttgtagttgtgttacagggcgttaaattctaactccaagaaagttggttggtgagggagcagtacttacattctaaatggataagcaaaaaactttatatttgactttggactacatgatgtgtctgtggactttagttttgtttttttcatggggtctccgtagagtacggcattaaaattgtaggttctactccctcagctcgtgagcttggcagcacagggaggtggcaggaggaaatccatgaatcagcgtgagtgttaattgtctgtagatatgccataaaaacataagcaggtggagtatttctttctttttttttgagacggagtctcgctctgtcgcccaggctggagtgcagtggcgcgcgatctcggctcactgcaaccttcgcctcccgggttcacgccattctcctgcctcagcctcctgagtagctgggactgcaggcgcccgccaccatgcccggctaa

SEQ ID NO: 112660 - DNA, 1044 bp, Homo sapiens
tagatttccaataattctgtgtgtattcctcgttcaccattctctgacactactttgttttccttcatggcgcttaccactccatgactttgtagactccgagcatttgtttgtctgttgactgttctcccttaatagagtataaatttcatgtggtcagagactttgtttgttcctgtatctccagtgtaccagcggtgcttgccacatagtaggtgctcaataaatatttgtcgactgagtgaatagactatcaagtgggtctacccacatatattcctgaccttttccaatttatcctgcaccctggaatcgaagtgatcttaaatgcacatctgatactctggtttctcttcagagtcaatagatcttttgccttttaaatgcaaatctgtgacacaaatacaacataaattctgaagtggcttaccaaacttgtaggataaagactgaaatcttaatggagctttcaaggctctgtgtttatcttttccttgcctacctcttctttctccttttatttttttatttttgcttcatgtgtgtcacacttttccttgaatctatttctttcctttttacttagatgactcctattcactcatcttgtagatgccagcttaagaattctttcctacagaagtcttccaaaaccatctcctaccctccagagggtaagtctgcacatcatcatggaaccatctgcttttcttctgtgcatgttcttagtttatagtcatactgatatagtgtgattatttggttaatgcttgtctgctgctctcaataaaaaggaaggagtttatgcctgtttttccataccactgaatgaatacccagctctcagttaagtgcctagtacatattacatgttcagtaaatacttgttggcagaattaatgaatacagtatcttgaatatgtcaggttcttttcactcccccttgcctttggtacctgccgctccctgaaacatctcttttatctgcttggaggcctggctcattcctcggcctcaggctgatttttgatgacacctcatctg

SEQ ID NO: 112661 - DNA, 1052 bp, Homo sapiens
ttatttttctcttgtactttcactcttgatactgctgctttcatattacatccccattgggattctgacacttctcccatcatctcttgttttccagtccgtctcccaaaccagatgatttttatcttgtaaatatttctttaatccttccacttctctcactgacaccaccctagtccatcttattcttgcttagcctcaaatttgattgcatacgttattcatacgttcattctatacgtttatccccgctcactgtttaggacttgtatcattcttggcacttgcaggagcagcttcttatatgaaccaaggtttacttctggttcaagtcattcatttctattcctgtgcagtattgtattatatgaataggccataattacttcacccttctgttgatgggcatttagatcatttccaacttctttttttttctttttcttttacaaactacctcaatttgtgcaaggagataaatgtctctttgtacacatgtgcagaagattctttaggtggatatacctaggagtagaattgctcagtcatagcttatgtacctcttcaaatttactagaaaaataaaacttcttcagagtaattatactactttaaacttttaccaataatgaattttcattgttccatttcctaactcttggtattgtcagatattttttcaatctgttgatgtgaaatgcaatctaatattttgtcaaaactttattgtataatattcctatataccagcaacaaatactgcatattataaaattaccttttaagatagcaatgaaaaaatataagagactagtaatcaataatagatgtgtaagactagaacaacgtttttaaagatgccatctaaataaatgcagggcaataccattttcatgggtaaaaagactcactgtgcttaagatgtcctctgcctatttacttgaaatttagtgcatttgtagttaaaatcctaataggaattttgtggaacttaagctgattccagcaattttaatggaagagcaaagagccataaagagcccacaaatttt

SEQ ID NO: 112662 - DNA, 1398 bp, Homo sapiens
tataaatgaaattaatttgagattcagtaggtttagtcagaagttacaaatatgaaagcggagaatactgttttttagcttccttatttttaagcaattatgtttgcataatagaatcttagattgttctgtaccaatttacactataattttatttagcaaatgtaggaagctttgtacaacatgacctacttataggctaacaataggtctaaaaaagtagggtggctattctcctttatttttagattcttaagcagttactattgaaaatagtagatcagattttcttttaactttaaatgtcaccagatttatatactcctaatttttagtgaaaatctttttatgaataatagttaattaataaaataatgttttatgcataatacaattaaacttatttttttcttataagaatgctctaaaagcatataatgtgaacagtgttatatataaaattagcgcacttttagattccaggctacacatattatcagaacatgtatagcagtgttttcagctacagaactgtgatggattgaacatggagggggaagaattaaggaagatctaaaagatatttatctacacttgaccttggatatatgttgaaaagagcttactttttggagtttagatactttacgtaattttttgtactaagtcctcaaaatccaatgcatgtttgacacataatagcctttaaaattcagactagccacatttcagttgctcaatagccccttgtggctaatggttatcattactggacagtgcagatctatccaataggataacaatagttcataggatgattctgggaagcaaatgaatataaaatacatattttaaaaataagcttcgttcctgacccattgtaggtcctcagtaaatgcaagcctctctttgctctccattatattaatagcttgttatgttttgggttttgtagcatatgtagttggaaacttcaagtcaataaaatattgacctttttttcaaattgaagaaaataaaatgttcttattattctctaaactaacagtaattgagagtcagcttttgtaatagatattgctgcttttgctcattttgcttcctatctttccttctaagactcaattttcacctaagattattagaaatgtacgttaatagttggcaccaaatttctggttttaaactgtgatccagtttccttttgtctcatttttttaatgatgctgccctatatacgtctaaaacttcattcttgaaaatattctcaaccagcacctatataataatgaaatattactacacagtacttgggggacttgaatgatgagttatgtgatttttcctgtggctacttttgctgtcccattaatatataattttaggctgggtgtggtg

SEQ ID NO: 112663 - DNA, 1059 bp, Homo sapiens
gcgtggccattactgaaaagttaaaaagcaatagatgttggcgaggatgtggggaaaagggaatacttagccactgttgatgggaatgtgaattagtacaaatttcatggaaaacagcatgaggtacttttctttcatggcaattactatcatctgatgcatttatctatgtgtttattatcattcattcacaaattgttagctccaaggtggcaggacctttatctgtttgttgacagttgtattgccagcatctagaacagtgccaggcactttagaagcacttgataaatatttatgaaataaaagtgtaaaacttgacttaaggtttaatagttgagtacttccattcctttccccagttgttccgcttacccttcacttacattctcatccttacctaggagcaagtagtgaaggattgattgccaagagcctcattgagaacaaaactgaaggaaagaacagaaaatgcaggatagtttattataggaaacattgtaaaaggtgtattccaaatttgctaggcttttaagcatccaataatatggaaagatttgagttttcatttttcatttcttaatagctctccgaaatctgaaatggtcctttcaaaccattaggacgttggctttctaattatttttaaaacatatatattacatagaatatagaaaagtatgtgaaaagttatggttttatatggctggaagttggcaaaatgtcagtgactgaatttaatacatcacatgtctgagggtcctattcagtcatcaataatgtttgaacaagtaaacataattcaagcatacttgaataagtaacttaattcatggaatatatacatgttatgtttcttggtattttcagataagtcacaggataaagctcccctgataaaaatgttgaccctgagtttgccaaatcgagtatttactttatcagtataatcttagcttttattgtggtaggagtcaagatatgcattttgtgaacaaagtctcaatctaatccattttaaaaggaaagcttgaattttttcccaaatatattttgctt

SEQ ID NO: 112664 - DNA, 1934 bp, Homo sapiens
aaagcatctgacaagtgttaaaagtaagccttctttcagcctccagtagaattcatcccagcatcgtaacacttttcaagagaactcgtgattccatggattttcctaagatgctttttgtttggttggctgaggattttttaatttttgtttttgctaacccctcttctcctctctaatttacttcatattttgtgtttggtttagttgaatgtcatcctgttttgtagtgctactttctaaactaatgtggaccatttggaattttattcctgctattatattttaactttcagttatgaatagtttaaatgtgtaagaaataggcataaacctgaataaatcctgaaaatagttatgctttgctttggaggaaaaaactacagataatttcataaccttgtgaaagaaaacaaaaagttgattctcattattgtatttaagttgctgtaaatgctaaattagtgaatgctgaagcattactgcaggggaaatacaaggttaggttcctgcaagcctctgatcacaatatgttcatcaaccaatcagtatatagcctcattcaatgtgcgtttctgtgtaagacactgtattaaacacatattattgattcattaactttgaactcacagccaatagcacaaactcatgcttgtatgaagcttacctaacacacatattttccccataacacacatcatagctttcttggactttaggaacactggaatacttagaggtcattttaaacagaaatcaccagcaaaaaagcacaaaaatgcaaacagtgtggcattaaatagactgtaaaaaggatacttgtttatagcatgagagctgaaacaagaaagcggagtgtctgtcgccctgttctacctcatctgggaatgtgcattgctgagcaactcaaaatttttactgctccatgcctgtccttgaatgaccaagagagctcaaatattgattttgtggttacaagtaaattttccaagtaggcaaatttgcaaatatagaaactgcaaaaaaatgaggatcaactgttaatataaatgagaacatagagaatatgttgtctcataccatactgaccacagttcatttggtatgtaacaaatatttgttaaaaaaaattaagaaatgtccagcaaatggttttatgtaattaagctagatagtaaactaaattttgctttggagaagtagcaaaattttaaagctttttgtttcaaatatttttaatagtgaaatatatttaatagtgaaatgtatttactctgataaaaaatgggtaagttgaaagtatttagattaaataaaaattgtattggttactttaaatagaatttagctaatgaatttgttttaattgtttaattaatttttgtacagggggagagcccaggaagcagtcataggtaaggctttgttaaaaaaaaaaaacaaaacttctatgcaaactgtaagaaaactctcttaagaagtcaggctttatcatttgcttgctttgagacattaaacagtttacatttcagaactttcagatttttctttttataagattgagacaaatatcatatatctcaaaagactgttttgaatattaaagaatttaatgtaagtgcccagatgctttcctgttgtacctgttatatgttttttagttttcttaaaaccatttaatactgataagtacgtttcttttaaattttttaactttattgcccctttctttccttatgcattctaaaacttattctactaaattttttcacatcttttaatagtaactaaaaccttatgctataattatttaagcagcttttaaatattttattaaaattgcatgtgttacttgaagtatctttaagtcaaaagagcattcttaatttcaagagaatagttttcatatacaatgttatattatgaacaaataa

SEQ ID NO: 112665 - DNA, 1222 bp, Homo sapiens
caaatggaggttttttccttagtttcttctttcttccttccttccttcacatggaagagaggtgcaaacagacaaaaggaataggttaaaggtaaaagagaggtactaattgatagaacaaggtcccagagaattgcctggagtggggcaggagagatgggctcaatggtgagtgagtcaagagtgtaaatgtagtaggtgactctgaacaagttaagaacattcctctttagaggatggtgaggagaataggaaggatatatgtaagtaagtgggggttgccacaaagttggggcgattcatggttgatactcctcatttcttaaagtggagtgaaattgccttttaagataaaaaaaagtatgaataaggaacttgagtatgtgaagatttttaatttggtagtgtaggatatgtgaaggaattgccacatatatataaaaggactactgctggggtccgagtgccaaattgatgtcaggttttctctagcagcctgaaacaggaagggctgaacatggaaatgacccagggtcagaatgtgagtaaaccaagtgaatatggaataatgataggagtgtaagaaggtgagtatgttggtaagaaagtagttcagatctgccttggtgtccatattggttgtaagtgaagcaaggccagaagatgactgggacagatagactgagaaaagggaaggatgaagggcctggggaagccagagtgattaagcaggataaaataggaggattaagaagagttccagaatggtatgacggctgagatcagggtgtaatagtgtactgatgtttatattttatgatgagcatcttgggatatggtttggggtatatacccataggtcagatggctgaagcagagccagatgaaggtaaataaaatccacatttcttaaaaggtagctgtaatgctttaaaaactattctgatattgtatcatcttaccagtttatatactagaataatagcaagtgttagaatgtatactttttactcttaacaattgaagttgtagcaaattgctttaacatttttaacagcaaaatttgagaatttcactggctttttgagtgttttatttggacttagactcatcagaagtttttgttttttctttttctcctcctcctttttttctctaggcctcttactgaggaagaaattgttgacctaagagaaaggcattatgattccattgccgaaaa

SEQ ID NO: 112666 - DNA, 1037 bp, Homo sapiens
aaaaataaatgcacacacacatatacatacatacatatacatatatttgtctgtttaatgtgggtatggtggctaatgcctatagtcccagcactttggaggccaagacaggcagattgctcaagtccaggagttaagaaccagcctgggcaacttggcaagacctcatctctgcaagaaatacaaaaattcacccggggtggtggcgcacgcctgtagtcccagctactctggaggctgaggtgggagaatggtttgagcccaggaggtcaaggctgcagtgttggtgccatggtactgcaggctgggtgacagaataacaccctgtctcaaaaagaaaagtatgtttaggaccaattagtgatttcaaaagcattaacgtaagctatacagtagctgttaatattagtctaaagaaaaaaatttgtgttgaaatttgattttcaagttaactttaacatacaatagatattactaaagcagcttatgtgctcttatgaatagcaagaacttacatttgaaagtaattttttaatagtttgatagtaatgaaattaaggagacatgtgcattgatgttaattagatggcaagacatgaattttgtgaaagctgagttcactttggtcacagtgacgtaattgatcttaaagatactggatttatgagggccaaaaccggcaaactagtgagggtgataggtgttggaatgattgtttaaaatgaagatcactgcagattctaaagaaacacttctatatttatacagaatagatgctactgcttcataactcagtttctaaggaattccgtaatgtgttttatatcctttgggttattttgtaaaagaaaaaatttaaacaattgcaaacatttcaattctgttatgctttgtagagatcaattattttttaataatttattttttgttttataaatagaagcattttatttttagagcagttagacaggttctgatttttgttaatccttatcgttttgttcatgtacagttagccttacaagaagagaagttaa

SEQ ID NO: 112667 - DNA, 1050 bp, Homo sapiens
gatgtaggaacacattacagtctatacagcacatactgacacacagacatacactgacacccaccaagtcatttgattttcatgggaaccctgagtttgctagagcagtaatatagctatctgtaatttataggtgaaggaacagtaggtaaaggccatgccagggatatatagctaatagctatcagagccacaactcccaacagttcttctaaatcttagccaattgcttttattatttctgagtcaactcagccagatcttataaatctgttgttgtattgctacttatttcacccagaatggaacttcatgtattgttttaactattcctttcctgctcctcatttttccagttggttggaagttcttgggtatactaagaatgttaaggatatcaatacatatctgttaaaaaaaagttattttttaataacactatgaatattctggccacttctggattacacatagataaattcagaaaaattcttcccataaataaggggatatagaattgaatagtgatggatttaaggaaaaatatatcaacaaaataacttttttttttagaaactagaaaaaaatactttttggtgttgcatgagtggttttaaaatatataattttacaacagagtgattttttttattacattatgtttccaaagcaagaaaggcagagaattgtgcagcaatatcatccttccaacaatggagaatatcaaaggtaaatagtgaaacatatgcctccttccctttgtggtagaacattttattgcggtgtagagcatcattcacctcaagatgtgtatatacgcattcatgtttatgtgttccctaaaaattattccttctaaaagacattgtcttggaagaaaactgagaacatttaagttgaaacattattattaatttaaactgactttattgcatttttaagagtggtctcatttcccatatagatgtgatacaatagctgaatgcctttgggtgagttgtttataccccagttgtttgtgttttccttagtccctctctttcttataat

SEQ ID NO: 112668 - DNA, 1030 bp, Homo sapiens
cttattttttacttattacagattgacttataagattaaaatatttcctcaggtttcaaaagcaaaaactcttatgcttcccaatactggaagcatagtatggtagtggttccttttgaaaatataggttgctttttgttttatctttcttgttcattgttttttgtgccgctttgtaattgactgttaaaaatattatctagagttaatcatatttgaaaagtttataatcatttatatttgcatgtttgctatgcttagatggcaaaaaaaaagagagaaaagtttctttatactgttcctaacagaaacttaccaataaaatgatttccagaattatttcttatgaagctaaaagtaataataataatatttagagacagataattgttacaaaataaaacggctgttgcggtggaagagtagatgagagtattcaattgtatttcgtgtatattctaggactctcatcagatgctacagttttgacaccaaatacagaaagcagttgtgatttaatgaccaaaactaaatcaactagtggaaatgacgacagcacatccttagatctagagtgggaagatgaagaaggtattttataattcacaattttacctgaaaaatttaacgtaatctgtgttgatttatgtaaatctaccttggtctttatttaaatggaaataaattcaaggccttgaaaaatcatataaacactttttagaccattattgtattggtgatgatctctgttgataaaaatttttagaaaattgcttaatttttaatgtttctttagatttagaaaataaatgtcgatttctttaaggtttttgtaatccaagcccatgacattactcagtatgaaggattactacccccttgtggacagtccaaagccagaagttaaatataacttctcttagaaataaatccacagaaacaaatccaccagatacagatctacaaagttatattagtatctagctcatatttttttcttatctatagaaataacttgttttactgggtt

SEQ ID NO: 112669 - DNA, 1381 bp, Homo sapiens
tgtcattctctgggaaatgaaattatgtgggtaggaaaagactttggcagacatactaacttggctatatgagactaacagcagttgaaatcctccatccattctgttttatttatgagtcttcaggaatttcatcttatcggataatcgatgcatcaaaactgccctttggtgactgttaatatttatttttatctgaggcatacttcagggttagaacccaacaatttcccttaagaaggcctccatgggactgggtctttaagttaattcacacatcaagtctgatagttaaataaaaactacattgctaaatttgggagtttttaaatatagctttattatctgttctgagatttttgaaaactctgttcaaatcataggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaactatgaaaatattaagacttttttgttaattctcagccgatgtgaaggaagcatgaggagggatcgtcagattcagatttagaatagtgttcccgtttccagcattatttatttctatgacttctttggattttattatctaatagtaagtacagttgatgtgggtagatgactctaagaaatgctgaagtatcggcattacatgtgtttatttacatgtcctagtatgataatgttgattcaatctgaacaaaagataatataaaaataacccttcagagtttggacatttcaagttggtaataataaaaaataatatttaagaagatatatatatatatatatttagttttttccacttcattttacatgcca

SEQ ID NO: 112670 - DNA, 1055 bp, Homo sapiens
ctcgaatgaagttgtttctgtgggttgaaaatatctcttctgtttctctggtaaccttccaaataccaaatatgtatacaacagatattcagtaaatgcttaaataccattgagaagtttacagatacagtgcatcttatttgatgcattaaacttctaagttagctatgaaagccaagctttaaggaaagagcaggaagcaagcaattattttttgccagtaatagactgtgtaaaagctaatatgtttcacttgcctatttcgatttacttattttttaaaaatttcctgtatcacactgttagctctatactggcaaatattccttcattagctaaaagcaaagaatagaattaacactaagtctcagatcgccatcctccttattagagaaaggagaaaatgagagttcttccgcttgaagaggtaccaaagaaagtaagcagagtggttcaaaaacaataatcatcccctaagccaggtgattggcgttctgagcacatttgctctgcaacttagccgcatttcactcagtcacataactcttacagaaagtgtagaatcctgaaagtctaaaactgtgctcattttccaaatcagcctggtgaaatctagttcttgattctcaaattcagaatttcagttttaagtttaagggcattaaaactgcaagttatagagtgaatagaagaaggcctggttttctaaacaagtctgttggtctctgaaggctagctacaccaaggcctctgtgctttgcacaagccatgaggtgcttaggcgcggtgtcgagaggtaagtcaacaaaaaatgaaatgtgctatcttttctttgcagacacattttgagtttgttctccttaagatcaggcaggactagtagaatcctactgtcgactgcttgtcttacagagtcccttgctgctggcctgtacttagttgtcactctgtgaatagcttggcatgtgggtgtttgctgtctttgcgcctgcaaagtgtgcggacatccaggcggttctccgttaccatctccctgccacttgaggacatgcaag

SEQ ID NO: 112671 - DNA, 1057 bp, Homo sapiens
tctggaattctgtgggaatagtctcattatctgaaacatctggttattacatttccctgagctgtgtaagcaattactgtctacgattcttttacaatacagactgatatgagctcttccttgggccagttattcaggcctagcagtagggacaagttagtattgatcatccagtgaaacccaactgagaagtagctgtgtttacattaggcccatgtgccctaggatgtgttgatccttcaagctctgtggcagccaatttaaaaatatctccaagtcagggtattaattattacacaatgtatatatatgtcaaaatgtcacattgtatcccataaacatgtataattattatatacatgtttgatataaaacatgtatttttaaaaatagtatttttaaaaatagtatttttaaaaattgatttttaaaaatagtatctccaatgtcatagtaataaaatattaataggcaaatagttcatatggaggaataatcatagcctttaggccatggatgagagcagtaatccactgtgaattcccgatctgtgacttctttgtgtttttcttacagggcctctccacgtcgctaggtatactggcagacatctttgtttccatgagcaagaacgattatgaaaagtttaaaaacaatccacaaattaatttggtaattatcataacactgagtggcatcacctgtaaaattgtcaatcgtgtccttggtggttggttagtggctgtctttctcaggagattgggaggcagggagctcagtgctgcgcctcctagacaaatgggaggaatcctggggaggagtcttgtggggtcctatttggctttattatcccagcgcctagcactgtaacagacactcagagagtgctcagaaagttactggtgaatgaatgaatgaatatcaacaaaatgattttgagcctcacttctttcctttcaaagtataacaaaatgcagtttccaaacttgggccatcttgatgataaaggggtaataattttaaaactttgtaatcaccatctgttcaaatcagagca

SEQ ID NO: 112672 - DNA, 1071 bp, Homo sapiens
agagtgttgcctaccacataatgtgagtttggtgcgctcctggttctgagatgctgggtttcacacacattttaaggtttttagatgcaaggaacacaggcttgtttaaggaaagttaaataggatacacatgatacaagaagtggtctcacagttccgagtccagtggggcggtgggagcgatgacagtctgagatggtaggagcagttgtgtgaagatggagtctcccggaggaaatgacaattacctgacaatcacagggccgtcacacctcttcctgtcaggggccgagacattccatacaccaagcttaggtgatgaagaatttgaaatcccacctatctctttggattctgatccctcattggctgtctcagatgtggttgaccactttgatgacctggcagacccttcctcttcacaggatggcagtgcttcagcccagtatggggtccagacattggacatgctctgtgggcatgacccatggcttgatggagcaaggtgggggctcctcagtggaggcttgatcatggacttaaaccactctataggaactcagtatagtgccaacccacctgttacaattgatgtactaatgatagacatgacatctgacttgatggggcatagccagttgaccaccactgatcagtcagaactgagtttccaactgggtttgagcttacggggtggcaccatcctgccacctgcccagtcacctgaagatcgtatttcaaccaccccttcacctactagttcacttcacgaggttggtgttgaggatttctggaggcaaatttccagccagaagacagtggtggtggaagcagggaaaaagcagaagttcccaaagaagagaaaaaagaaagatcctaatgaacctcagaaaccagtttcagcatatgctttattctttcctgatacacgggctgccatcaagggacagaatcctaatgccacttttggtgaggtttcaaaaattgtggcctccatgtgggatagtcttggagaggagcaaaaacagatatataagaggaaaactgaggctgccaagaaagagtatctga

SEQ ID NO: 112673 - DNA, 1012 bp, Homo sapiens
ttggcttggttccaagtctttgctattgtgaatactgccgcaataaacatacgtgtgcatgatttataatcctttgggtatatacccagtaatgggatcagcaaactgtcgaaaggacaaaaaaccaaacaccacatgttctcactcataggtgggaattgaacaatgagaacacatggacacaggaaggggaacatcacacactggggcgtgttgtgggtggggggaggggggagggatagcattaggagatatacctaatgttaaatgacgagttaatgggtgcagcacaccaacatggcacatgtatacatatgtaacaaacctgcacattgtgcacatgtaccctaaaacttaaagtataataaaaaaaagaaaatctatattttgctttactgtgatgttatgaaaaatggaataaagaggagtgttttaatataattctttagcttgcatgctggctcagaaaatgaaagtgaacagttaaaagaactacatgcactaatgaaagaagacctgactcctacggaaagagtctatgtgagaaaaagcattgagcagcataaactggggaccaatagaaccctgctgaagcaggtaagaagtagtagcttcaatttgtttcttgatttatatataccattcagattctcttatttctgttgatgaaataatatttcctttaaataaaacaaactgctatgatagtttatattctactaaggtgcatgcatgtggatccttggatatagtctacccagtgtatgttttatgtttgcttcaaagcattcttcaaattcgtgaatagatccaactcaccatgaccgagtcatcctttctccttctccctgtttactttctttttataggcttgaagaggaaagtatagaggtgggaatagattccttacaagttaaatgaaattagttgtattctaggagaaacagtgatggagaggatctgaccctgagtaaaatatccaaatgaaatttgtgtttgatgctctccaaga

SEQ ID NO: 112674 - DNA, 1246 bp, Homo sapiens
aatgtattttgaagacattaattaattaaatggaggagggagagatggatgaaatatttgttatacctatagaaatttatgtttgaccaggcacagtggctcacgcctgtaattccagcactttgggaggccaaggcaggtggatcacttgagttcaggagtttgagaccagcctgccaatatggtggctctactaaaaatacaaaaattagccaggtgtggtggtgcacgccggtaatcccagctacttgggaggctgagacaggagaatcacttgaacctgggaggtggaggttacagtgagctgagattgtgtcactgcactccagcctgggtgacagagtgagtgagactctgtctcaagaaaaagaaaagaaaaaagaaatttatttattttatgctttttatttttttcttcttttaaaataattaggtgtgtttggagcaggaaagagttacttgctggcagtggtgattttgttctttgtacagctgtttgaaaagagtgaagctcccaccattggaaatgcaaggccgtggaaacttctgatttcttcttctactaatgtggctgttgacagagtacttcttgggtaggcatgacaagtgcatttaagtagctaatgttttgggatattgttgagagaggcaacccactatgggccctgagtgtccatgtactcttgctggttatgccaagaatgcaagacctttgtctctgacccagaagccagcatctatgaaacagtaatgggctaattagcttgtaagtaggataaaatcaaaaccagaactggaaattttggcacagtgatactcatgcaaaaattcaagttcagccaagaacatgtagggctagagaggtattgttgggggaggcagtctgccagcggccctgagcatccctgctgggatgctaaggatgcaagtccctgaccattcttacccaacacatttctcacagtttgtttgcaataagcagctttgactgatgaagtaatgtctccctccaggacaaagagcaggcttgcttattacttgttataagataatggatccccagcctcagtgttcttgccctactcctcaacccacggcatgtgcaggcatctacctggatgctctttgtctcctcatgtgacttgggaaccaagggaaaccaatgcagatatgttgacgattatactgcttcctgtgccataagtaaaagtcctttgtctctgatctagaagtcttgggtctgtta

SEQ ID NO: 112675 - DNA, 1828 bp, Homo sapiens
ttctcatttaagatattaatcatcttaataaattactcatttaagatattttgttatggcagcctgaacggactaataaaatagtcttatgggctagcccatgtcctgccttcttaggccttctgtgggtttatgcaaaacctagggatttccattgtagcaaactcatcttcccatgtgatgtctctgccctccttcttcctcaccctgtaattctgccatctctttagtctttttctgtgtgattcaagtggtactgtattaattgcagaatctgatgctggttcttttgttcagagcactcccaacctttaggttgatagttgatgaattatctttccagaactttacttctcatcttgtgtatgtatatgtgtactatagatatatgtacacacatatgcaaatatatataatttctaaaaatataaaaccatactgtatatgtctgtgtaatatttaaaaatgtttgtcttttcagatgatctttgggtggtttcaaaaaccctagactttgagctggatacttttatcgcatgtagtgctttctttggaccatcatctatcaatgagatagaaatactgcctttgaaaggctatttcccttctaattggcccactaacagtgagtattactatgctcattttagtttatatttaaaaagaatgatagacataagatgcactgtttgattaaagccaacaaaaaggacccaactctagtttcgactgttgtgtacagtgagttcctgaaaatgtgtatgaagttgaatatatagatatttctgtgaggaagaatggtgtgtgggggattgttttgttctaattttctaattagattattctgattttctgttttccatatatttctgtgaagtaattgaggaaaaaatgcaagaaagtgtttaaaaattatacaaatactactctgtggcacaagtgatatgttgattaaaggaaactgctggctgtgaagttgtgctactaggtactaactcaaaacaggtgttcttgttcatttgctgatatatggaagtccaaatatgatttaaattatgcagtttatgcatacccattataaaatgaatgagcagatagcatagtaatttaatgaatataagtttgggatctctgtgtgtgtttaagggtttgttttatgtcatgtgcttaattcagtagctgaactctgagttatgtgggcatttaacacagagtttttatggtccattttatttacatcaaatgtttattttctgcatcctctgtacagtggttgtccatgcgttattggtttgtaatgctagcacagaactgactactttgaaaaacattcaggactactttaatccagctactctacctctaacacagtacctgttaacaacgtaagtcattttttacctttgagtcattggtattaaaaaatggtaatcagaagtaaatatgaaaattcaataaaagtacagtatataaatgttgccaataaaattgtaattatttttcagactatgacattattctctgtcagtggttaaaaagagaaaaggggctgggtgcagtggctcatgcctgtaatcccagcactttgggaggccgaggtgggcagatcaccagaggtcgggagttcgagaccagcctgaccaacatggagaaaccctgtctctactaaaaatacaaaattagctgggcatactggcgcatgcctgtaatcacagctattcgggaggctgaggcaggagaattgcttgaacctgggaggcggaggttgcggtgagccgggtgccattgcaccccagcctgggcaacaagtgaaactctatctcaaaaa

SEQ ID NO: 112676 - DNA, 1006 bp, Homo sapiens
ttatttaattagtaacttacttaaaataatacaataagcatctgtgagcccacaaaccaaatcaaaatctagtacctttataccaacctacatttaagttaaccccattacctcatcttgtctctccaaacccaaggtaattatcattttgatccttgcactcaccagcatttttctttcttctgtgtatagatttatgtaaatgaattcctaaagagctatataaaatttttagtttttttagaccttactaaaatgatgtcattctgtatataatcttttggaatttatctttttttggttagtatgttgctacaatttatccatgttgttctcaaatctagagtctagattatttgttttgactgttgtataatattttgtaaacatgctatagtttattgttttcattgttgtttgggtttctaagttttaccattgtgaacagggtgttatgaatattattcttgtactgtcttttagacatgtatgggtttcttttgaatattactctaggaatgaaaatgctgccttacagcatatgaacatacttcacacatctttagattgtgatgccaaactgatttccaaagtggctctatcagtttgtactcattctaagtataagagatcttatggatcaacccattcaaatgagtataagatgattgcattgtggttttagctcacacttctctgctcaccactgatgttaaaatactcttcatgtgttttttagttacatgtgtttcttcttagccattttactattgggttctttataaccttcttttatttatagaagttctttatgtattcttcatattctttgttgattatgtatattataaatatctgctcatcagatcatgtcttttcacttactttaaggtgtctttagataaataaaaattcttaattttagaatagtcatatttattagtaatcttttctttttgacagtgctttttgcatcttaccttaaaaatcttttcctatgctgagt

SEQ ID NO: 112677 - DNA, 1343 bp, Homo sapiens
ccagactctgtctcaaaaaaaaaggaaaaagccagatatagaaagacaaatattgcatgttcttactcatgtgtggagctaaaaaagcagatctcatggaagtaagagaatagaatgatggttaccagaggctgggaagaaaagggggtgggaaatgaagagaggttggttaaagtgttaaaaaaaaaaaaaaaaggaatacagtagggaaattatagttaacaataatttattgtatatatcagaataactagaagagaagaattgtaatgttcccaacacaaagaaaagatcagtgtttgaagtgatgaatatcccagtttccctgatttgatctgatcattacacaatgtgtaaaggtatcaggatatcacatgtactcccaaaatatgtgtaactattatataccaataaacaaaattaaatttaaaaattttaaaaagcacacgaggtgttctatcttttagatacttttctatctcagtctcttctaaaactgatgacagttctgtgacagttgttattttcttactttgatacagtatatttatattttgtatacatgtatgaaactaggtaaacatatgaaaccctggttcttttcatactgtattttaaagattttcaaaaaacttgcatcttaatattacaattcatttttattttttattcccttttcagaaaaggatttgattttcagagaaaacagtatggcaaactaaagaagtttactactgtaaatcctgagttttataatgaaccaaaaaccaaactttatcttaagctaagtcggaaggaaagatcttcagcttatagcaaaagtaagttgatctgatcatactggcgattcagtctagccttattatctccattacatacagctgtataaattgtttatattaaagaattttatattaaattttaaaagtataatttaatagtaatatgtattataaactaattgtataataaattagaccacttctaaaaaacatatttttaagatattagggctttttatttttatttttttatttatttttatttttatttttattatactttaagttttagggtacatgtgcacaacgtgtaggtttgttacatgtgtatacatgtgccatgttggtgtgctgcacccattaactcatcatttaacattaggtatatctcctaatgctatccctcccccctccccccaccccacaacaggccccagtgtgtgatgttccccttcctgtgtccatgtgttctcattgttcagttcccacctatgagtgagaacatgcggtgtttggttttttgtccttgcgatagtttgctgagaatgatggtttccagct

SEQ ID NO: 112678 - DNA, 4132 bp, Homo sapiens
ggagtcttgctctgttgcctaggctggagtgtaatggcgtgatctcggctcactgcaacctcgcctcccaggttcaagtggttcccctgtctcagcctcatgagtaactgggattacaggcacatgccaccatgtccggctaattttttgtattttagtagagatggggtttcactgtgttgcccatcctggtctcgaactcctgacctcaggtgatccacccgcctcagcctcccaaagtgctgggattacaggagtgagccactgcgcctggctcttgtcatttattaaggaaaatatacagtcactaacataatcattttaacaagttcaaatcatttacaagagtatgaagttataagtaaaagagcttttcccccaattccactcccatcaaaagccactctaacaatttggtatgtattcttccaaattttattcttttattctgtgcttatacaaatatatatattgtgtatatatttgatcatcatattagattttaagatgattaatttctggaagaagcagcagcaaaattaaatgctgttctaacaagaataacatatgaactgtatagctggcatgtatttaacaagttcacttcatttgggagcaatgtcttgaagtttagatcaactatggacttgaggacataagagaaaactgttcagtccttgagtttgcagggatttagaccttcacagctgtaaacatgaggtctaatttggcctgagccccttagaatggcagttgatcttcaggaccaaagcctaataacccagaccagtccaaatcaaaatctgacccacttcaagtaaatctgaaagattttatgctctgtattttactgttattcttgttgattttagtaagtttattctgtcctttttggaagaagttttatagttgttgcccccaccatagctctacataatgtgctttaaatcattatttttataatatagattactagaattcattcaaactaaagaaaaaaatcagaagattttggtctgtagttttgattcttctttctgtataggtgacatcaccagaagaaaacatctctacattgagccctgtttctaccttttctttgaactcaagagatgaagacttcatggtagaattctctgagacgtccctgaaagcaagaactttacctgatgatcttcattttctcaacttggagggtagtcgttaccacattgctctaatatctgtctattcatttaagatgaagttttttatttgagagattattacactaaatatatcttagaaccagattcagtgtcatatcccttgaagcctttccataacctttcttcctttgaactttttctatcatagatagctattccaggtacaatattcccttctagctatctagttccttcttgtttctcctcccaactttgtcaacacagacccctgaaagtatcttctaccattgtcagttcttctcacagctgtaactccagcatctgacccctttacagccctttcctgttccagaggaatgactcattgcaagtgtctcatcaacaccattggttgaccttagcataaccttttagtgtctctttttgctttgggatcctgaactcttcaactgctgctaccacccttgcattcctaggactctaggttttcatatattttggcccttcactatgagtcagcttctgcttcttgatgaatataatactattctctaggatccctttcactaaaatttctttttttctcttttcttataatctcatcaatatatcttcccctgattctgaatttatgttgggtgaggggtgagttgtagatagttttttgattttggatggatgataacaaaaaattctgtaatgtgaattggtagttgggttagaaaaggttttatgggtgtggttggtagaaggcaacaaggtagagaagaatcaaatacaccggagtgggtattcaagaaaaagtgatatggtagtgaacagtagatgattttcacagttataccatgaatcttttactttaatggacttttaacttttctgtcagtgttacttgatcgacttgttagaattacagcatagcactttataaaagaatattcattggctcacctactgctctgctactttccagatgatctccagagtatatttccaacaagatagaaactctgtcaggaaggcacattattataaaataggaatccatagtattgtcagataaaaactataagcttgcataattctgatgcagtattattcatttgtttatatattcaacaaatagttactgcttcttagatttttaggaatatatcactaaagctgctgacacacagaaggaatcattaaactctttcagacagaatttgccatgagtttaccagaattatactcttatcaaacaccattagatcaaaataaagctaaaatctttttttactctgaagggtaacatgataattcatgagtgtaaaaatatataaaggaagttacaatcacatagtcatataaatgaaccatgagcttccgtctctgggaaagaatgtaaagtagatataaaaaactagtctaggttcttatcctgactctgccacttagtagttatgctactgctaagcctttgtaatctcatttgtaaaatgagaatgatgcatttttgttgttgttgttagctttaaagtgctttgaaaatgttaagtgctatataaacataatttagtaattaggaaaaaaaaaggaggagaagaaaaagagggacttcatcaaccctaagaatgtttcagtatatatgaattaagctttgaaatctttattttttgaggttaaaaccattaatttttttttaaggaaataaaataatgtgattttttttttcagagcaagttgctacattttgcttttgtatacccactgttttctagagcctaggtgataactagtagaacatttttatttaatcagcattctgttttctttcagggatgaaaaaatcccgttctctggagaatgagaaccttcaaaggctttcattattaagtagaacccaggttccacttattactttgccacgtactgatgggccacctgacttagactctcattcgtatatgatcaactctaacacatacgagtcttctggctcccccatgctcaatttgtgtgaaaagtcagcagttctttcgtttagcattgagcctgaggaccaaaatgaaacctttttctctgaagaatctagggaagtgaatccaggggatgtttcacttaataatatatctactcagagcaagtggctgaaatatcaaaacacatcccaatgcaacgtggctactccaaacagagttgataagagaataactgatggcttctttgctgaggctgtttctgggatgcattttagagacacaagtgaaagacagagtgatgctgtcaatgaaagctctttagactctgtgcatttgcaaatgataaaaggcatgctctatcaacagcggcaggattttagcagtcaagattcggtttccagaaagaaagtactttctctgaatttaaagcagacttctaagacagaggaaattaaaaatgtattaggagggtctacctgctacaactacagtgtaaaggatttacaggtgaggaaatgtaccggtcttgtggtgcatttttccaatagttattgtctgaatttcaacaaaagaattaccaaaatatactgcataggagcaatttggacagatggctttttttgatcctaactctgagctacagttacatcatcctttacttaaaatctctcgtaatagtagtgaacattgaatgaaatgatttatttgaaagtatctggtgcagtgtctggtaaattatcagtacttaataagtgatagctcctacttttgtttccatcactactaccattacaattattgtttttacttttgactgtcaattgtgtttgctgattaagtcattagggtaaaggtgcatcttatttcacgttaattgtgaataatccttattatagtcataaccagaaataaagatacgtaatgatccattcacatcagttaactttttcctagcaaaaaatatataaaaacttactaaggggcagataagaaaagtta

SEQ ID NO: 112679 - DNA, 1050 bp, Homo sapiens
atcacttgaacccaggaggcggaggttgcagtgagccgagatcatgccattgcactccagcctgggcaacaagagtgagactccatctcaaaaaaaaaaaacaaaaccccacagttactaatggaatgtgtacctctgttgggcactatacaacttctcaaaccttggaatagattaggtaacaccaccttatttcttgttacacgttgattttctcatgataattgctttttatcacagcagtttctcagaacccagcttcacaaaggtgcaatgtcattgaaagaaatgtagcaagatctgatgtagaaacagacctggagttagtagttcattaggtgtcagacagatgtcaggtgacactgttaccctacatataaaacaccttatggagctcctgtgagttcattgtgccacctcagggtaccttgttgcacagtttgggaaccatggtagttatataaaaaataatagttctaattaggatgaattgaaattctaggataaatcatctagatgagtgtttctcactcaatggggatgctgttagcacttttggagggtcagttctttcattatatggcactggtctttctacagacatgtttggaacaaaagaaagtagaatgtttcacttgcctccattttatttttgtttttatttattttgagatggagtctctctctttcgcccaggctggagtgcagtggcacgatcttggctcactgcagcctccatctcccaggttcaagtgattctcctgccccagcctcccaagtagctgggattacaggtgcgtgccaccacacccagctaatttttgtatttttagtagagatggagtttcaccatgttggccaggctggtctccaactcctgacctcaagtgatccacccgcctcaggctcccaaagtgctgggattacaggcatgagccaccaggcccggcctcacttgcctccattttatatcttactttattctttatgttactggtcctttttttccccttttaataatgttgatttttttttcttttttctaaatac

SEQ ID NO: 112680 - DNA, 1325 bp, Homo sapiens
gcattttcctcaaaaacaaccacaaggaagtttaaaaattgctactaaaccaaagtacctaattcaacaggaagagtgtgctgagatgaagagcacagaaaatttatactaccagcatcaatcagaaaataccatgagaaataaaagccggtgggccatgtatttatcctcacagagttcacctatacattcttctactgtagatgggaatgatacagaaaggaaacccaaggcccaggaagatgatgtaaattctaatttgaaagacctttcattacaaaaaattatacagttcgttgaaacgtatgctgaagagaggaaaaagtataatgtagaccagtcagtcggtaataatgatccatcctggaatcaggaagtaaaattagaaattccttcattcaatgaaagcagtagcttacaggttacttgtagcagtgcagaaaatgatggtatattatcagaatctgacattcaagaagataataaaataccttttaatcaaaatgacaaggggtgcattaaaggatcagttctcattaaagaaaatgctcaggaggtaaatacatgtggaacactggaaaaggagtatgaacaatcagagtcatctctgccagaactgaaacatctccaaattgaatctagtaataattctaggatctctgatgacattacagacatgatttctgaaagtaaaatggataatgaaagtcttaatagtattcatgaatctctgagtaatgtaacacaaccatttttggaggtaacttttaatctgaacaattttgagaccagtgacactgaggaggaatcacaggaaagcaacaaaatttcccaggattcagagagttgggtaaaggacattttggttaatgatggcaattcatgttttcaaaagaggtctgagaatacaaactgtgaagagattgagggtgaacatttgccattcttaacatctgttagtgacaaacctacagtgacatttcctgttaaagagactctgccatcacagttttgtgataaaacttatgtgggttttgacatgggaatatgtaaaactgaaaacacaggaaaagaaatagaggagtatagtgacacattaagcaattttgaatctttcaagtggactgatgctgtatacggagataataaagaagatgctaataaacctattcaagaagtcagaattaactatgattttgctttacccccgaataaatctaaaggtataaacatgaatttacatattcctcatattcaaaaccagattgctgaaaacagtaatctattttcagaagatgctcaacctcagccttttattttgggaa

SEQ ID NO: 112681 - DNA, 1050 bp, Homo sapiens
aacattcaaaatagatgaattttcaaatccaagttcaacaaatgtaatcctttcattatatgattacttatataacaattacttatttcctcttgaagaagtttaagaaaagcataattgtgttgttcctttttaacatttattttgttttcatacaggcaattttatatgatgacaaaggagcatgtttggagagtctgtttcttaaatgccttgaggtattttagtgtgtttatcttatttttaagttattatttaaaaatctctttaaatacctcctttatgaatattgttagtgtagtcataatattaatactaatagtatttgttgaacattatagctagactttgtgctaaaaccttttagatattgtttcctttaatctctacaactgattttttatgatctaaaaaaaacctgatttttatagattaggagtgcagtgcagaaaggttaagtaacttgcttatgttcatagagtaacagtggtaggaaggctgaaatttgatcctaggaggtgattctagagtctaattctactacatgattttttcataggcagaggtctactgtgggaaattttttgtgacatattctcatttaagtataatattctctcaccaaaaagagaactaccattcaacccaggagtactataactgggtatatacccaaaggaatataagttgttctaccataaagacacatgtatgtgtatgttcattgtagcactattcacaatagcaaagacatggaatcagcctaaatgcctatcagtgatagactggataaagaaaatgagatagaaatacaccatgaaatattatacagccataaaaaagaatgagatcatgttcttttgcaggaatatggatggagctggaggtcattatccttagcaaactaatgcagggacatagaaaaccaaatattacatgttctcacatgtaagtgggaaccaaatattacatgttcttacatgtaagtgggagctaaatgatgagaatgcatggacaaacgggaacaacagacattgaagcctactgaga

SEQ ID NO: 112682 - DNA, 1009 bp, Homo sapiens
tgagccgagatcgcgccactgcactccagcctgggtgacagagtgagactccgtctcagggaaaaaaaaaaaaagaaacctttggaggagtttgtgtaaggaattggcatgatctgatttacatatttaaatggtaattctatctggagaatcgattataagggaagaagattagaagcaggcagactagtaataaagttcttgtagttgttcagacaacgcagtagtagcttggaccaggtgcttatgatggaggaaatgagaattattcatatttgggatatattttaaagttagagctaacagaaatactgatgagttgaccatgaggtgtaaggaaaagggaaattaagaatgattttaaggcttttgccttttcagcaattttgtaattggtgtttctgagatagggaaaattggtgggaggggattgttagcactagagagtcctattttcaccatgttaattttgagatatcctttagataaactagtggaggtgtcaggtggacagttgaatattggaatggggagctaatgggagaagatagatttgtaaagcatcagcataaagccaatgagcttaaagccaggatcctcagaaagaatgagtgtgtaaatgagaaggaagcccaggactgagtccaatttaggcatcatgtaaaggtgtagggcacagtgggagaggtagggtgaaaggaaattgagaaactgagattgcaaaagggaattgaaaaggaagaagactcgtttggaagctatatgaagaaaatattttcaaggagggagttaccaactgcatttgctgctgagaggtcaagtagacagtggagcacattgaggagcttgtttgcagtttctctagaatggtgatgaggaaaacctgacaggatgggttgaagtaagagcatgaggtgaagaacatggttgtgtggtactcaatgacacctcattgtttttctattattaattctgacctatagttgtgttttatgtcttaagctagcat

SEQ ID NO: 112683 - DNA, 1145 bp, Homo sapiens
ccactacacccagctaattctttgtatttttagtagagatggggtttcactatgttggccaggctggtcttgaactcccccatccacccgccttggcctcccaaagtactaggattacaggcatgagccaccgagcctgagggcctgaggggcaggttaaattgtaccaaattgaattaatcctgctgatacactaacatattaactttttcattttctttagatgttgatatatcactacttgtgtcttttaacaaaatgaaaaaattgactactgatgggaagttaattgccagagcattgagaagttcagctgttgtagaggtaagaatcaagaataactactgtttatatttatagtttataattataaagaatgttaacgtaatgattattatatgattatagcttacaattataaataatattagttttattaatgtaatatactattttaaagcttgatttggaaggcaccagaatccggaggaaaaaacctctgggggaaagaccaaaggatgaggatgaacgcacagtgtatgtggtaagcttaagaacccgggtccccagtcagaaactggcacagaaacaatataattaagttaaaaatttattgacattctgattgtgaaaaactctaatattgcttttaatttataataggagttacttcccaaaaatgttaatcacagctggattgaaagagtatttgggaaatgtggcaatgttgtttatataagtataccacattataagtctactggagatccaaagggatttgcgtttgtggaatttgaaacaaaagaacaagcagcaaaagcaattgaggtaagtccagatcctaaaaaaaaaaaaagaaagaaaagaaaacaagtattaaaatagtaacttttgcaatcatttcagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagaaaaagaaaaagaagaagaaaggccgaatgaaaaaggaagacaatatccaagccaaagaagaaaac

SEQ ID NO: 112684 - DNA, 1690 bp, Homo sapiens
aagcagataggagattttctttttctttttcttttttttttttaagaggaagatatcttgtggtaatggttttagctgttaacattgacatctgtatacttcaaaaaaaaaaaaaaggatccagacccacccaggatcatacattccctgagagctgatacattaaaataacaaaaggcccttgtaatgattctctgagataaaaaggcaaaaggaattcaagagttaagaatagtataaatagaagtggctgaagtccctgccttttacccttctggaggagaacacgaatctttgggaactagttcaggaaggtaaaaaaatttttttcttctaaagttatgccattttgttttctttctcctcagctctaaatactctgaagtccaaagaagttgtatgttgggtgggctcccttcaactttaacatggaagtgctttctgtgactttaaaagtaagtgcttccatgttttagtaggagtgaatccaatttacttctccaaaatagaacacgctaacctcatttgaagggatcccctttgctttaacatgggggtacctgctgtgtgaaacaaaagtaagtgcttccatgtttcagtggaggtgtctccaagccagcacaccttttgttacaaaatttttttgttattgtgttttaaggttactaagcttgttacaggttaaaggattctaactttttccaagactgggctccccaccacttaaacgtggatgtacttgctttgaaactaaagaagtaagtgcttccatgttttggtgatggtaagtcttccttttacatttttattatttttttagaaaataactttattgtattgaccgcagctcatatatttaagctttattttgtatttttacatctgttaaggggccccctctactttaacatggaggcacttgctgtgacatgacaaaaataagtgcttccatgtttgagtgtggtggttcctacctaatcagcaattgcgttaacgcccacactgtgtgcagttcttggctacaggccattactgttgctaatatgcaactctgttgaatataaattggaattgcactttagcaatggtgatggattgttaagccaatgacagaatttaaaccacagacttactttgatagcactcttaatggtataacttcttctcccattttatgtctctctttatgttttttcttatgtttcctttttgttttcaagagagagctatcttttagatctccagtatccttttcctcttcagtagagatttctatatcttgaaataaataaaaaagctctccgttaagacatggggctgtgaaatgggtgaaacagaagccaattaaaacctaattaattaaaaactaattaattaaaattaattagttttatctaattaaaaccttgtagttttacctctattttccttggaagcttctgatgcttccttaatgatgtctttctgaataattttctttacttttgatcggggagctagggattctgcatcttcagagctgcttctcttcctcttccctgttctgacttcaggtaagctagatgcttcaactctgtcccgttttttctttttctttgagcactgcttttggggttcagtggactcaatgtcagagccctcagatgtgggtctggatcttttcattttactgatgctggtgttgcttgtg

SEQ ID NO: 112685 - DNA, 1284 bp, Homo sapiens
aggcaatttttatatttttagtagagaaggggctttgccttgttggccaggctgacctctggtgatcctccctcctcgccctcccaaagtgctgggattagaggtttgagccaccgcacctggcaaaactaactattttttttctattctgtaatatgtgtaaagtagcattaaatataatcaaaaactgtcctagttactattattgagaatgtaatgccttgaatatggtttttcagatatgttcttcttttcatccatcagagtctttgtttgtttttaaggtgatcacgaacaaaggtattggcagaagattttggttgatagacaggcaaaacttaatcagcctcgggaaaagaaaagaggcactgaaaaggtaattgattcatttttgtttttttagactaaactttccttgaacgtttaatgccaaagtcagtactaggtagtcataaaatgatcgtagttttgctattacctaacaaaaatttactgagtatatactatgttttaggttgggagggaaaagtcatttctctagatttcaaaatgtatgaaattgaattatttttctcacaaggatacataattttaatttagattttttctttttaaccagtgatatactttaacagtcttgatatctggctgctatgtcttgtagtttggtgataaatgattatagaaagattatcttcatggtaaaaacacaatgtattcagaatgtagtttataaagataggaggctccatagataagatggagagactttatgcatagtgtttcctatagcaacgataagctttattcctctttctctaagatagtaggtaatacaaacaagcttaaataatttaaagcaagcccctctttcagtaattttatttttctgtcacttaaaatgatactggtctgatcagtagtggaatcacacctgggaatagccactgctttccagcttaggcaacatagcaagaccctgtctcttaaagttttaaaacaaattattatacatgtaaaggttagtacattttaaaagtgcctggaacaaagtagggtacataatacctaatattaactacagtcatcaaaatttagaaatgcatattataaaagtgtaagaaaaatgaaaaagatgaacttccttttttgttaggtgagcaagttaaaagtcctatttcctgtaatctaagcttgttgatttggggtcatatttatacaaaaaaaaaaaaaaactaacttaaaaagcaagtgtttttcatcaaccttcttctaccattgccc

SEQ ID NO: 112686 - DNA, 1174 bp, Homo sapiens
ggtaccaaacactttaaaactatttaaatgaatactcattagaatctatattttttagagaaaaagatttgcatttactccaaagtttaatattttaacttttttttctcaaggaagcttttggaatattttagacattttaaacagttttcttttttattctgtgtaatttcatttgccttccttaaaaatattcaacaatttatgtaagggtgtaagaaataggaaatagtaaatagccttaataacagatttgatttgtaattgatttgacctgagcataattatctcatttgtcatcttctcgctgtttttaaaaaatttccatttaagctgatagctgtgaaattttttctagtcatagttttgtgtgtgtgtgtgtgtgtgtgtgtgtgtgttttgagtatccaatacattttaatttttgatttatttctctttagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacattatttggaaatgtgttgattttgtttttatactgtaaaaacaaaacataattgcaaaaatactacatgaatatatataaagtttagagaaatgtttaacactaaactctcactgtacttagtttgtaacttgcaataccttcaataccttttcatgttgatttatacagacatgtttaatagttcattctattcattccactttgcctatctgagcttccattgaacaatagaccatagggattggttctaattaaaatgttaaatttttaaaagaattgagtttcttcataaatcaagttaaatgttttgttttggttagacaaaataaaatgtattaggtgctattagcacaagaaggaaaaaatagaggaatcaaccttaggcagaactg

SEQ ID NO: 112687 - DNA, 1051 bp, Homo sapiens
ttaacccagtttagtggcaagttctttagcctttgccttttcgagcttggcaatgcgagccacagacttaggacccaggatgttgccaccccagtgacggcagatctcatcgtatctgtcattgtaattggtcctgatagcttccaccagcttagccaaagcgcctttgtcttccgagttcacctgtgtgaaggcgacagtggtgcaggtcttcctgtggacgagacgtcccagtcttgccttcctcttgataatgcactaagggaccaccattttacgacatagggcaggcaagaagacagccagctcgatgggatccacgtcgggtgcaatcaccaccagctgagctttcttgttctccaccaaggtggtgacggtgttaactcctgctcaaaggacaggtggtctcttggtggggacgtcccctttgccagcagctttcttctcggcctgggccaacagccttcttctcttgctttgtctctggtctgtacttgtgggccagcttaagcagctgagtagctgtttggcggtccagggcctgggtgaactggttaatcgcaggaggcactttcagccgcttatagaggatggctctctgctgctgcaacctgatatagcggggccatttcacaaagcgggtgaggtctcttttgggctggatgtcctgtccaatgccaaaattcttaggcctttcctcaaacaggggattcaccactttcttagcctcctgcttcttcacgacagcaggggccggagccaccttctttcccttggccttctttcctttcagcatcttgggctgcgggaggagagagtttttttaattattaatattatatacttcatcatctcaaatacagcataaactctctgagggcaggaaccatattttatgtatttttatttccctcaaagtgtttagggcatggattctatgtaatagattacggttcggtgccttcctccatcttaaaaaaatcacatttgcttctaaggaaaatgtaatgtatacttatttgcaagaaaataatactctcataaagaagtt

SEQ ID NO: 112688 - DNA, 1043 bp, Homo sapiens
tgtttgttctttggcttggtttttattttttattcctaaaaagcaccacattcccacactcatgcatcaggaatgattctcacctcgacgatgtcttaggtgtggcctttttggagagcaaaggaataaattcaataacatctttctcttcctcctgagcatataacattaagtttgctttagagactgaaaataaatgtgtgtggttggaaggagatataaaggggaatttagaagaacagattgtttatttgccctggcacttttctgtgaacacttgatagagttctaggtcaaggtgtatggtgtccccttgagggataataggcaaataattaggctatgtctttaagcattggaaaatctttattttttaaaggaagagaacctagtcttttctatgaatctctgcacaaaccagagactttggggccaaacactgattccagaaacacttaggcattgaagaaacttttgggtgagaaagatgatggtatgaatgcaaagaaaatatgcttagatgagttttgtcctttttttttagccttttgcagtatatggtttaagtcacagaacaacaaacaacagaagagagcatgccccacccagtgttgtgaacatggatgattcccctcccattctattccactgaactgcataaacactagcacagagacagttctaattcatcttttgaaccctgtatgttacaggtacaagccatataaaatgaagacatagagaaatggaagatcctcccaccccaccctactttctcctccttccatattgttgagtgaagctatattcatcttggaaagggtctgcatcactgcttgtaattttgttagccatttcttgtagacgagcacggtgtgaggaattcagaggtagtcttcctgatctggccctccgtctctgcctagaccacacccccttttttggccacatgcctaaaactctctgaaggggagtgtgataaaacgatgctcatccttgggcacatggattcctcggtcacaaaactgaagaggcctgatttc

SEQ ID NO: 112689 - DNA, 1029 bp, Homo sapiens
tagatgtttaacaaatggcagttataaaaggaagaagaaggggtaggccacacgcatctgtcatttcttagtttttgtcattgactgttaggtagggaatgcttatccaatttaatactctttggtcagcaatttcagccaatgctttttcatgcatttagacagactctgaaagtaaacataatctctcaagattcttatgaatctacttatgattgaatggacattctcatatttttaaaaatctatttctcttacagattaataggctatttttcatcttttatcacattctgttttggctactttactgaactcttgaaatgttcaaatatttttgctttgctcttttgcatttataatagtggctttttaaaatgaagaactccatcagtgcctcctataagcttattttgatttgaaatatggaaactgttcttaatgataaattgaaatgatttcaaacttctaatattttctcttttttatccttttaggtaagtaatgaaaagagacatgaagaattggtatttcaaatgaccaccatgttgcaaaaggtacttttggtattttaaatattactttaaaggaatcttataaaaagacacggaggttagaatgtaattaagtactattttggtaaaaacaatttttatgaaaacagatttaaagatgttatagcattaacaattttttaattataagaaatgtaatatactataagacttttctttctgtagtctaggcaattatcattggtatcatttgggaatgaaaaggtaaatagattgtctcttcctcaagatattcattgctggaaaaagggaggtggaggaaagaaatctgaatacaatagacataataaacacattgggatttgttcaccaaagtcatctattttctctaagggcttatgaatttgttttctgtgatcagaacattatcttcataattacttataaaattgattgctataaggttgtcaataaagttatttgattctaaataattcaaatagattgcatccat

SEQ ID NO: 112690 - DNA, 1459 bp, Homo sapiens
aggcgtgagccaccacacccagcctccatcttcagttttttaaattgagttcagggtagaatatgacaaccaccactcagattagtctataaataggtaaatttttacttaccagttaaaatatctttgactcctttctttggtcaaagtcaacttctgcttttaggaagtccatgatttacactactatacttctcttattggcttgaaaatgattgacatcttattaattcattaagtaaatatctgttctaaaaagggattacaatgagaaaggcaaattgccttcagaattatgaacaagtgaagaaatgaaaagatctttatggcagggaagctcctgaacttgttggcttgttgtgaccaatcttcatccattttgaggattcattgtgttattgtgttcatgggcagcactgcattaatctttcttctgtgcttctgttgtggccagcataggcactagccagctggccaggcttagtttttcctaagaaatcttctatttcttgacctcagatgactggtctctaggtgaattcagagataaatgaggtctggattacaatgagtgattgttcttgcatccagagtcaggcgcctccatggtagttctcactctcacaatctgcactgaagactcagccttagttctctctctctctgaggaccacaatcctaatgacgcccctctctgcatgaggacaggcatggtgacttgttctgtcttcttcctagaaagtagtagcctatacagatgttgaaagaaaaattatcctatgcccaggttacgagtagacattacccagttaggagactgtgataggatctgtgattcataaagtacagtctctttgagtgattgtcttgtcacttgtgaaataatgaactttttgcttccaatgtcacataatggagttggtgaatagggtgtgctgaaagggtagaggaatggaaggaggaagatctgatcagaaatgaaagctccctttttttttttaacagccattttcctgctcattgaatatgtttaggctgtgtctggtggctcacgtctgtaagcccagcactttttgggggctgaggcgggcagattgtttgagccaaggagtttcagactagcctgggcaacatggtgagacccagtctctaaaaaaaatacaaaaattagccaggtttggtgtgcacacacacctgtagtcccagctacttgggaggctgaggtgggaggatcacctgagtccagggaggtcaaggctatggtgagctgagatcacgccactgcactccagcctgggcgacagagccagaccctgtctcaaaaaaaaaaaaaagaaaagaaaatgttcaagtgttgttgaggagtgctacctctacccaggcaggggagttatagtatgaggggcacacagggaaggctggatttgactttgtaaacggttaaaaaaaaaatgtagga

SEQ ID NO: 112691 - DNA, 1748 bp, Homo sapiens
atttttagtagagacagggtttcgccatgttggccaggctggtctcaacctcctgacctcaggtgatcctcctgcctcagcctcccaaagtgctgggattacaggcttaagccaccatgcccggccagttcattctttaaaaatacaattttattttaaagttggacattcattaaaatgactcataattcaagaattgcaaaaaggcatactgtgaaaaatctccctccttatatctgtcttccagctacccaatgcccttcctggaagccaccaaggttatctttccatgtgttcttcctgagacttcttaggtgtttgcctgtttatgagctattactataagtagcaactatacaaattatacctattattctaaagaacaaaatttgatgtaaaacttagagttgtttcaacgatcataatatgctttcagttattaacaaaaatgtcagtcttttttgaatgaaaaataccatttggtatccctttgattatatttaaatgacagttcttattttagctttgtcagttgtttaagttagttttataataaatttgtatttgtatataaattattcacacagattcccagtatgttggttgacagttttactaggtcataaacttccaccatgtcatctcgcgtttccattgccttagtaatttgctgcaatcactacagcaaacaagaaaaacacaattacaggcattttactttcatatcaaatatttatttgcctagtaggccaattttggcttaatttcttaattttgctattaagaaaatggtaaaggaaagtcagatacgtattaatttgagaagccgttcttaaatactcttataagcctaaaactgtgctaggaactgtagaaatcacctaattaacttagaacatttgtgggacaaattctacctagggacacacaataaaaggagctagtgacattaaaaaatttggctctatctgaacacacacagagaagatctaattatttttaaaaaattacagacatgagatcactttcactgctgtacttggttataatgagaagtgatgttattagcatttttcagactctctcaaatgccagaggcattgtgtagaaaattagagtagccatcagtatcatgctgttgaataactgctgtaggattttatttagcatacaaacctctgaaccataactacaatgctagctcagtatttacatttttaaacaaaaagacccaaagtgaaggaatctattgcaaatctgtaaactcttttttgcatgaaaaaatataatttttagttgaggcagcttaaagctcattgatttgttcctgaggcatctattttctcttgatgaaagcacagccgaacagggattctcgtgtcaaagagtatgatttatttatgttctgaatcacagccgctaatgctcacatttctattaaaaacttaacatctatgggagaaagggacaaatactttcaagttcctcatgaggttgttgataagattctggcatttttaaagttgagaaaacacactgaaaaattgtgagaagagtttggctactttagcataaaagttactaaatgcacctttaagatgttcatattcttcctttatactgtactctattaaaatcatatgggtagaagaatagttaatatgagaaaatgttcatgttattttgttgcctaaaaaaggatattaaaaaagaacatttaactatatgaacctaattcggttaaaaag

SEQ ID NO: 112692 - DNA, 1063 bp, Homo sapiens
taaatccttattaatttttaatcctgaaatatgatggtgttgtactgagttccaagtaaagaagtaaatgtagtgtcatctgcaccattgaggagggtgcgatttgtgagactgtgtatatgatcttggctcccccttggcaggcataaagactggattagctcttgtgccttcctggggctggaagccaaaagtcaagattaaactaatctaaatctttccttttacaagtgagcaaaatgatgctgaaggaagttaaactactttcccaagttacataatcatgtgccagagctgaaacttgcagcggcagagcccagcgtaataaccttttccctcaccaccatttagtttagagcttcagaagtatttttccattgttcgataatcaaaatagtaacttaaatgataaaaatggcccattgttatctggcttttatcttttaaaaaaatctgtgaaaagggttactgaaatgatgtatacttttccaaaggtgtgaaaacaaagttatcagaggtgtagcaaaaatttgtagtaagtcaaaagcgttaaatgattgaatgtcttctttaaaaaaatcctgtcaaatccgtatatttttgatgttatatcagtttttattttagctggatccttcatttttagctctttaatcacactcagacagatcttgaatgcaaaattgttagtgtgggtggcagaaacagagagatagcagcttgcttattttaatatttaatcatttcccctctcagcttgagttgaaaagacaaaaagcctgtgaatatatcaaggaagactgtggaatccatcgtccttcataaagaaaaatctcctgattgacccatttcatataccatacagacatcttttttcctggtatttgatagttgattacttccactagttggtaaaattagatgatttttatgttttttcccccaacctctcaccttttttattccagggagatttgcccaatcatggaatgtgtaactttcagaagcattgaactttttttcaattgcttattcatttgaaggactttccaatgaaccatta

SEQ ID NO: 112693 - DNA, 1921 bp, Homo sapiens
gcacatatgtccctgctctatggatttttttttaggcttttaatgtcactctattttttaaattgacaaataaacattgtatatatttatggtacacaacctgatattgtgaaatatgtatgcactgtggaatggctaaatcaagctaattaacacatgtattgcttcatgtacttatcatttttgtgtgtggtgacaacacttaaaacctattctctttagcaattttcaagtacacagtaagttgttattaactagagtcaccaggtacaatagatctcttgaatttgtgaaatttctgactgaccaaatctgtgatccctcttatttatattcccatctgctcctcctctatcctccaaaaactactgatatgcaatatgcttaacagatatctaacaatatcaaccctcactacaccttgaaacttttcagatgcagaggtgatgcctccacaaaatcccttttgtgtattttactccttgtagctcatttctagtcaaacacctaaaaaagactccatagaacttccctgttttggagactgtagcatttgttcttttcttccagtatatgtgtgcacaaatattttggtcatattatcattcatttaattagttaattatttttttcattgacaagtaaaaattgtatgtggtatacaacatggtatgtatatatatgtgtatatatacacacacatatatacacatgtatacaaatgacttaaacatatatacacacacacacatatatgcacatatatacaaatgacatatatatatacacacacacatatatatacacacacacacatacacatacattatagaattttgggctattttttttttttctaattttagagtctgtttctcaaaactttggtgtcatttgctgactgttttgtccaaatacataagcacgtggaaaattgtaacccttaaaggccatcttttgagcatgtggtcctaaatgagatggtcttaattcctcacattttattatcagaagctactagaattataaaaagtccattagttaagactgatgttaagacagtgtccaacacactgtgagtttttcagaaatcttagataacccagtggcaataaataatcgccattttcaaggtacatttgcctgttttgccaagggcaaatggactctttcaagcagaagtcaattatgtctgccttttgtaggtgcaattttcccctcacccactgggcccttagggtacaattcaaaagagatttgtgcccaaaatgagtgatggtctttaacaactgttaatactgagtaccatttgccagaagtgtcctctgccttttcattcaacctcagtcacatactagcatccatcataatgcatttgccaggggtttccaggatgactttaagtagtaatgttagtgaatgagaagaaaagtgcccagtgagcctagttagagttggtgctggatgtcttactttataatgactgctgcatatttgaaacatactcattgatcaggtttcccaaattgcattatgcagaactctagaggttcatgagatattaataggtggttggttaaaaaaattagagtgtcatggttaaataaatttgggaaagtgtgttaaataaagttaagcagattcatctgctgtgggatttctgagaaccttccatatgtcattgtgaattttgaatctctaaaataagcatatagtacacagcattgcctaaacatgtttgatcacagcaccctttttcaaaatttaaaaatatccaattgcatcttgcagaaaatgaacactcttctaaattaatttggagaagtctttctgtatatacttccttttgtatatgttttcattgcaaatcaaaatgggagagattggaaaaataactatataacaaagtgagagagaatgc

SEQ ID NO: 112694 - DNA, 1033 bp, Homo sapiens
ttaactgaatgagtctttccttttgaattacatttttaatggaaataaactagggttatagtttcaggatttcccaactgcataggactgtaaacattatataaagctttgtgtgctacactttattagcttttaaaggcagttgagtggagtttattgtacataagacttgcatttgtagttagagaaaagcctcacatgattaccatctgtttgcttttgcaagtgtagccctagaattctgatatgccaatagaaatgttattttagttttagttcacactggaggttttccacaggcaatttaattctcctatttggaagaatatttgtgacccctggttataagccaataggctcaaattttgaaatttacttacatgaaattaacacatgataaatgatataagaatttcagtttaacttatgtttggtgcaaagctggagttcctaaaataagcctttggtatgtggtgtcatatgtgaattaaaaagtgagatgattcttctgcagaaaggtaatatataaatgtatccaaattctatttggaggacacaggggggaaatggtcattttccattttgtatcattagtgggatattttattatttaatagcccagacactccattactgaaagtaagcacaatccttgctgatggtaggcagatgaggctgtgattctatattctgtgtctaggtggtggataggagcagtccagtccagctgtcccacagactcagcctgttcattggggaaaagggctcagtgaccacagctaacaaagaaaagcagggagataaagcaaaaaatcttgcagctgctgatcagctgcttcactcgtggggcctcagagaaagaatttaatttgtcctaaacagcatgttttaagttacagtacaacacacctatccacagaagtatacgtggaaggctgttgggaactggttcttccaccattcttgaatcaaaggttttaaattataaacatgcagacaaaggagaacactgttctgtttaggtttttgtttt

SEQ ID NO: 112695 - DNA, 1037 bp, Homo sapiens
tgaaatgcatcctttaccagattggaaactaagaggaaaagcattacttctattaaaatcaattctagtttcccttcctaaaattgggcattacttatctacatcatatttggtacgcaattccaggataatcacattttccaactggacagggctctagttcaaatgcttcacctttcacagtgacttagaatggtttagagatttatccagtgccttgttcttggtgagtctagcatcttagtcgcatcctgtaagcacttgatcattgcctgccactagacactgagtgtacatggaattttagggtatcgttcattcatttacagcttaccataataggaaaatttagaaagtaaaactataattgctacctattctattaatcttgctgacattctaattcacttaccttgaagaatttaagccagcagatttggtgtcataagaatcatggactatttttagcaaagacttcatatcacttttcattgactggatgatgcaatgatgagacttgaaaaattagccaaattcccatcattgtgttttatcatcctgatggaagcaatgctgttgaatttcaagaggttagcataatcaatacaatgaagttacagcaaaaggggagatgtctctattattgaagttttacaaaaatattaaatgtttggattgattttttttttaaattgcacacacataactctgtggagtgtctaatagtcaaaaataggttgagtgtgatcaggataaatagctaatgcatgtgggacctaatacctaggtgatgagttgataggtgcagccaactaccagggcacatgtttacgaatgtaacaaacctacacgtcctgcacatgtatcctggaacttaaaataaaataaaatattttaaaactaggttgagtatgaatgagagggaaaacagaagtgagccagttcataattataggctaaagattatagtgaaatcagatcacatcttacatttcacattattttttctgtacttagacattaagccctcatttcgt

SEQ ID NO: 112696 - DNA, 1709 bp, Homo sapiens
tgtgatgtaaaaattgtgacagaggaagaaaggttgtatatgtggatttggggaatctgcctgggtgtccccatattccatttcttttctattactccctccacacacatttattttgaagtaggcccatctccactagtattctttactttgtccaaacaaatgtacgtttctctttgtgccttatggataaactccaaattcctggcacataatgttccttctattcaaaaccttgctaaaaatcaatctcttgacactttctaaggcttctcttcaatcatgccttcattccttcaaaatgaatgcaactctctccatatgcagttgtaattagctttgtacattatgtttcttggcttcttgtgaatggctaatgagtacctctctctttttctctgtgaaatttataaatttaaattgctaaggagatctgagggtggaggggaagggggtctcactctgagatcagaaattgttttgtgaaaaagcagcttttgagagatgtagaggtatgggtagtataactaatgtggaggaatggctgctatacctgatagctatgtcactttaagaagtaggcaatgatataaaggtgaacttatgtagattatgtcactttcatgggcattttaattttctagtttataaaatgtaaaacagaaacagcaggttaagtaaataaatgaaactggttgggcccaagaattgcttgctttcttggtcattttgcactttggcattcaatagacaaagcgtatatggtacatttattttccctctttactataaggaaacaacacaaatgccgtaatacgtggccacggacacttgggacctgctatgtggaaagcaaatgccctatttaaaaaggaccgctgcaatttagttctatctgttgtcatgtaggaatgggagcacaatattgacagactggagttttcagaagaagtaagcagatttttatatgagatctcctgacttctaaatgtgaattctaacaaaacccaaaccccaaccatgtggactgaatgaaacacaacaaagccatatccggcccacagattgctgtgatatatgtcctgaagatcctttctgtgccagagaactatgattttaaattccttgataacagaaaccgtgtctactctttcctcttcaactatatcaacaaagcattttaactggagatcaacaactgatcatcagatatttttatcacatcaaaactttcattggattgaatttttgtaggaaattttgacctatagaggtattttcagtggacagggagcattggtaattctgaggacaactatttataagaaaaggctcaaatgctgaactgtggaacatagaaaagatttagtagcatgcaaagaaaatagatcgaagtagctggagagaatgggatcatgtctgggagtgcaggacgatgagtaatcaaggaaaagggagttattcataatagtcagctctgctgactggccttttgaaggaaaaaaataaaaaatgattagtatagggaagaagcaatttgatttggcttagaggaggttattggaaaccttggaaagggtggcttttttcagtagttgggatggaagccagactggagaaggttaaagggattagaggtgagaaactgggagatccagaggtatgctgcttttccaggaggttggacacaaaggaagaagggctggggt

SEQ ID NO: 112697 - DNA, 1045 bp, Homo sapiens
ttccctgaacccattcattcatcttgccttggatctatttatttaaggacagagaggatgccgtggggactgttgcagggtaatgggcagatgggctgacttcttgcttattagtaagctgggatgatctgactctaaacttcttcctaagggatagaggcacttaaaatgaggtttactcaatcatggaagtataattaaagtaaagatattatttcatctccctccctcccaccccatttctatttttttggtattcttgtttgacttgatgacttagtgttatcactgatgaaaccttaagtagaccagtggtttgttcttttgttcttttgttatcaggatgggacagatgtaactgcagggttcagcaggaggtagctaggagaagcttctcattaaacaagaattgagaaatcccatctgaacacctcttctcctattatttagtaaatggagaacacatgataaataaaacagagacattcttaatatcaaatgcaagggtatgcaaaacctgcaggaaactctatgtgtgcttttcttctttttttccatctttttctttttgaaaacaagacatttgtattcactcaagttaatcatagtgtgttttcaggtaatcataattagatgtaattactgtgtggtcaagttatagcttaactcctcgatgagcccaatcgagtactttagacataaagaacttctcaaacccaaacatcccaaaaatccttgacaggaacgctaatgctatcataaatgaatcaaagcattattttgatgctaattaacagttctacttactgtaccactctaaggctgcacacactgtttgaaaaatatatgcaacttaaatcataagcttgtttgttttttgagagagaaagagatatagaatgttttggattcatgtcttcttttgttgatctaatttttgaattggtttctaatatagaaaagctgttgttagatggcgttgtcccagacttggggcacaaactgtgtggagagccaaggaagggcatgggttaaaaatacagaa

SEQ ID NO: 112698 - DNA, 1005 bp, Homo sapiens
aggaataccttgaagatggtttgagataggattcttgataggaacaccttaaggatgacgattatatcaagagcggaaatcaagataagtttttactggatcacgagtgttccttagattggcaaaaaagaggaatctgctgtttgtttatatttttatttagcttataacctgatgtagtttttcaattaaactaataataactgagtaatcctgatttatctccaatctattcaattgatcaagaaatacacactgtctgctttgtgaccagaatactggaaagaaaatattcaggagaaaagactgcagacaatataaagaaacctcctgggggtggttttaactttcctaggtttaagtgaaagtgggaacacatttttcagtgagaagagagtacctttttatgcatgtccttgagggcaagaatcatgtctaaattatctttttatctgtagaaaggagaagagaagctggcacttagcaggtgcataataatgtttgctgaagaaatattgacaatctttctgggaaaatgtagagagtgagtaaattacctgattattttccacttaatgacatccttctcttttctccacttcctggcttaggctaccatgatggggaaatgtagtttggtaacactactggagtatgaaattcattttcctatggaagaaatgtttaaaacaacagtttagacattattaaatagacataataattattttccattagatgtaattgaaataataatgattagatataattgaaaactgttttgcagagaacaaatgtttctgtgggctatctaggaactcaaggcatatataatgtaatttctaggaacaagctttgtgttcaaaccttgagaacctcatcgtttttctaacttggcttgacatctaccttccattttttttccttttttcttaaaaagtaggcttttctactattctagatgttatgagtctgtggaagaaataacagataccaagagtggct

SEQ ID NO: 112699 - DNA, 1049 bp, Homo sapiens
gcaagtgtttagaatatacatatgtgcatttgtacaaagtatattaggttctggttgcatctacaagtgtgtatatatatatatatatatatatatatattttttttttttttttttttttttttttttttcaaggcggagtcttgctctgtcaccgaggctggagtgcactgggggcaatcttggctcactgcaaccttcgcctcccgagttcaagcaattctcctgccccagcctccccacacctggctaattttttttttttttttgtatttttagtagaggcagggtttcatcacgttggccaggctgttgtcgagctcctcaccttgcgatccacctgccttggcctcccaaaatgctgggattataggcatgagccactgcgcccagcctacaagttaatatttttaaatatacaagtatggccaccttaatcaataagtgaatttgggtttcttgttataaaaacaagccccatttttttaaaatcaagaagaattccagaactttatagtatacaccccttgagaggagggattgtgttttattcatcagtcaatagacacaattaggttaagaaaacttttgagataagttataaaatattgcaactccattagttttttatgtttttattactgatagtgtcttagatatttaacaagccttgattaactgcctttaatgtgccatggattatgcttggttctgggaaattcagttctccccctacccagacacacacacacacacacacacacacacacacacacacacacacacactcctgatctaaagctcttggcctatcaagaaaagatggttaggtatctgggcagttgtgtaatacattgtcacaggtatactgtcagaagcttacattggaaagagaaggcacaggagaagagagtggttggggttatctggaggttggagaagctgttctcaaggctttatgacagaagtcatccttgagtgtagtttcaaaagattatattttaaaccaagtgaatgacatctgaaaaacatagctttcttatattcac

SEQ ID NO: 112700 - DNA, 1087 bp, Homo sapiens
gaagttcaacggcagtagtcagaggagaaaaagacccaagaaggtaaatcgccggaattaggaatgtctgtgtataaatatgtatgtgtgtgcatgtgtgagtgtgtaatatcagcaaggctatggaaaccgtggagcattatgagtaactgtagacgataacagtgccaagccttgctttttaaagaggcaggtgcaaactgctgctttttgagaatagtaaaggagccatggctcataatggatacactgactggagcatggtgaagtgaatagagataaggtgtgttccacatgtggattactgaggaccgtggccactgatggattcttctggtgttaactgggtagagagagtcgttttatttttagtgtgtaaaaggaagagtgttaagcaacgtggattgtgaagcaaaaggcagatttttggccagatgcgtttgctctatgatgatcctgagatggctagacagcaaaagccttttggtttcatgctaagtgtattcctcctaaggagaaaagactgctgtgacaggagaaatatcatccccagcatgatatttctttggcttgcttagctcctctgcagttttcccagacattagtgtgatagctctttcaataataagaaaaacagctaaagatgttatggggtgggggctcttgggcacacaaagcagtctgtaggatttcttactgtggcatacattcccacaccctcgattttcatggaaatgatagcagcgagaaacagtgggaaaagatgcaaactattcagccccacccaatgccagcacttctttctttatggcctgactccttctggtaaactgttgcagcctcacagagcttccctgagcctcacctctgaaagagatgctctataaataaattctcctaaaatgcatttatttcctggagcaataatatgggcaggatattagatatgattgtaatgtaaatggctttcaacattagatggttttggattttgaataagcagattgcaaaaaataataagcatgaacaaatgaatatttttcattttgctaatgaagttgcattgtgtttcaaaattctagatgtc

SEQ ID NO: 112701 - DNA, 1050 bp, Homo sapiens
cctgtgctatgtgaatacaacaatcttttacacaattcaaataggattaagaattaaagaaataggagttttgtttatgtcccaaacctgtttcactcatatgccttcgctgattggtcaattggtcaatgaatctaaaaagcttttttttttttttttttttttcccaaatacggtttaaaacagaagtataaatccaaattagaaaagtttttttatgtagttgttgactaagattattagatgctttcagaatattcaagccagatgtgaattctcagactcagctgtggaacactgaagaatgaagctttatagttggtatttccatctgcacttcaactgtatttgtcaaatggctgacacccttagcatagcctctctaatataagggggaatttgttagtgagttcatgttgcttgtcctaattcaaaaggtcactaatctatcatgtgctccataatctcattacacagcagggacctctttccagttgttaaagaaccagtaggactgattggcctattacatggggcagtcaggcatttgtttactggcccatctagaaactggtgctttaaactgtttttttggatgggtaggaggtctgttccatctggaaccttggtacctcttccagatgaccctgccccaagtggcttccatgtttgatttgtgaaggtagttcttgagcactagcaacaggttaggtgtggttggggaacttacacttactgtaacaaaacgccttgatcagataaaaaattactgttggaataattttctgaatcactgaccctcatccagtgggagactaaagctcctcccctgattgctttttcccagtaataatttaaatggatgactatttttggtaacctttatttatagtttgtcaaaatgagcagaatattagctaaaggaagtatgttttcctttgtggagcaattaatttttcgtttcaaaaaggctgtcaggagataatttttgtaggttgcttatataacaacatcaataatttaaaaaaattacatacacacgtacacacg

SEQ ID NO: 112702 - DNA, 1036 bp, Homo sapiens
tgtcttattccatataaggaaatggagacccaaagaagtcaagcaccttggccagaatcatgtacgtagttagtggcagacacgggcctagaactcatgttacttgattcctagaaaagtgtttttcctgtttcttacaggtcatctgaaagagcaatcaaaactagcaatgggagagagaatttcagtgttgattttgggagaggtatagctttagcaaagcccctgatctactgcatgaaggagacttgtgattaacttggcagtgagcacaagccatgtttctaacatcaagtggggtactgagcttctatctacaacgttattacacaaaagctaatttcccaatatttactaatcaattgcttcatgagaacttgtcgtaccggtgctcccaaactaggtctgttgttcagctgtgatttgtggatggggcactattttactatagtcactactctggtgtccccaggaaattagatggcttcacctggttcaggtatatattttataatactttaagaccatctttaattagaactaaaacaaaaaaagtagttgaaataaaaatattatgaggaaacaatatttgggtttgttgaaccattaacacatatgtcctctaaaggtgtttggtttaacagtgtgtgtagttttattttttagtctctttctaccttgattcaagtaccctcccctcctccccccagccccacaaaacacacaggcgtgcacgtgagcgtgctcttaggcctcttacagtttttgcaagccgaccacaggggctggactcattctgtaagtgtttgaagttcaattactatggtactcttattacgaagggttactggtggggtgccttttattcatctatgtatttatttattcttcacttagcacatttattgaatgccttttaatgaccagacaccgtgccaaatacaagatacaaaaatgacagagacatattccttggtctcaagaagttcacggttcataaaggcaaacaaatacataaatagatgattactatgtg

SEQ ID NO: 112703 - DNA, 1448 bp, Homo sapiens
attgtggagatacacaaaaatggaaacaattagttttgtctaaacttgctgtgctgcatataagtgatgatataaattatgaagatagtgactttgttaagtttaaatgatttggatactggaagtccttggaggatctttaagcgtatgttacccttgtttgcttgtaccattgaatatgttgtgaatgtcatacaaactcacatcccatacaaactttggaaaatttcaactttaaaacatataatgaaaagcaaataaaaatacctaacaccatttgaatacttgattagaaaattgtacagcgaagcacttaaatgtaatttttagattacagatgtaaagttgatatcacataaggataaagagaatgattagaaatgactcacatgattgtatgtttgcattacagagagaaatgacatggctaagagtcaaaaactgtagacaataaagataataaactgccactttaggtttagggaaacaaaaaaggtatgaagtcaaataagagatgttagacggaacagattaaggaagttagagctgggcatggtggctcatgcctataatctcagcactttgggaggctgaggcaagaggatcgcttgagcccaggagtttgagacaagcctgggcaacatagtgagaccctcatctgtacaaaaagttttcaaaattagctaggcgtggtggtgcatgcctatagtcccagctacttgggaagctgaagtgggaggattgcttgagcctgggaggttgaggctgcagtgagccatgatagggctactgcactgggcaacacagcgagaccctgtctaatgaaaagaaaagaaaagaagagaaaagaaaagaaaagagaggagaggagagaattagaaatgaggatcaaagtcctggaagtaaaaggtgaggtaagcacagaagagattctgtagaacaaggagagagctgctgggcaggtaatcagtgaggagaggagaacgcacaaggtcagagagaaatgaagagaagaacatttatgccctaattagtgagcaatttgttataaaacagctttgccacctggagagtagaatttaaaaatttattggcacgaactaccaaatcagccaaattagagcaggccatcttccaggtctccagcacaggctacagtggacagtgtgcaatagcaacccttgtcatgaaggcggagagaagaggaagtgtacttcaggaaagcacgggctaatccaatcaacgaagatcagcataaggtcataagagttccatgttgcaatcagtcttttaaaagccaaaattaccttttgcctttggcactgctatctgataccttaaatggagtattttgctaccaaatgaaactaaataggacaagaaagagctgctcatctctttattgcaccatcattgatactaaacttttccacaaaagggtaatgttt

SEQ ID NO: 112704 - DNA, 1452 bp, Homo sapiens
aaataaaaataaaaaagctgataaaaaaatatatgaaacaacctcctgttcatagggcatataattctttcttctagacttacagaagcactaatggttttctgaaacgtaataatatgtggtattttttattaagtgttttgttgttgtttgtgtgtgtaaaatcaaacagtgagtaaaagttgaatggaatcggttttccattctttgggcagttaatagtattacagccagatgtcctcatacaaggaagtctgtgaaatcatatcttgggaatagaatggttttcactaatgcagaaattcctaactcaaaagactttcccaaagagtgagattcctcagttaaatctctttctaagaatctttctaactttgaatatagatttcataaaaatctcaaatcattgataagctatagttttatgaaataaattattactctcaactccttacttttctaaaatctattttttttgcatctcaaaatattattacagtttgctaaaatgagttttaaaatggaaaacctacatagtggtatgaaacagatatcctcttgattacttctttttttaagggatgaataggtgagacgttagaactttacttaggaagaggttcttgaaaattaaccctgaactatctgttcttaaatggcccaaataactgacattataaagattaaaagctttgagtttggtccttttttggagttgcttttatatatacatatctacttaagttgcgttctctaccatgaaatctggggattagaaaatacttagaccaagccacaggcatattcgtttagctcacattatgttttaaaaattgagttagttgccaatgttttaatcagaagattttatgtaaaagtcttaaattctagcttcgtgataaaagtcagaatacctgataatattgggccagcattcccactctaatataatgttttgaagctgaatagaagttaccctcgttagacgaggcacatgcaacctggttaccattattttcactttccatacttttataatctgcctggttgtcctaggcatttgagtttgagacaatgacagagttgtggctgaaggattcaaacatgcctctgacgtttgataaacaaacacaatttgagggctacttctgggcatatcagtggtacatcagtgacaaaggattgagaccctcagatggatgggtgcaaagagaaatgaggaacttaagaattccatatgccacctgatcaagctctgaatagcagtggtacaggttctgcccatctttgaaccatatcataaaacctgattttggcagtaatacttcagcacagattgtacctgctgtttttaaaatactgcttatcagtcatttttagcatcatattgatatcaaggccaacacagcctaaaattttgacttccctcaatgctgctgaaagctacaaaga

SEQ ID NO: 112705 - DNA, 1534 bp, Homo sapiens
agagaaatgaaatggatcagcactacagaaaattatcaaaattagcttttaatagcagtagctaacgttatgcagtgcttattatgtgccatccctttgagatagatatccccacttttagatgagaaaattgaggcatggataggggattaaatttgtctaaatttgcagagcatgaggatttgtttctaggaatttgtttaaagattatacaatgctttgcgatggttatagtcttgttttatagattaagtgcttttaatcgcttggctccaccctctttcagtttgcgctctctcagacatacgtgacagccaccactgaatttcacaaaggtctttttttcagacattgtaagaatgtgcaggagtccaatgttttttgggctttggggacattctgtatgaaacttaaggatttatagtcatatgtattgtaataacagacaaaaccaaaattcattaatatgaagattggtagaaactgtggattttccttataaaacaaaatcatatatttccattttaaatgtcatttttttctcttctgagattgtttgaatatagccaatgtgtgttcttaaatttagtttttaaatgtggtaatgtacaaagatgaaaattacggtgagactatttggatttttttaagaatggcatctggccacagaattgcaatccatacactacacaacataaaaaacatacattacagcactaaatatagttcaggcttgcctttgcttctgacttcaaggactgaaccatataaacacaaggcagatgaactagtgagaagtcacttggtgtagaagtccttgttaattaaagtgtccatggaccagcagcatgggcatcacccaggagcttgtaaaaagcagactctcagaccccagctttgacctatggaagcggaatttatatttacatcaacagattattcctatgcacactaatgtctgagaagcattgggttagatagattggattctgccagtctctgggaattagctattcatctttgaataagttactatgttctatgtattttagtttcctccatttcttgctacttactacatgttgatttagagcaacttaattctgtaatcttcatttagttgcctataaaatagggatattaataatacctacctcctattattataaggattaaatgaggtaatgagtgtaaaatatatagaatattgtccacatatagtatgtgattaatatgtgcttgtgatggttcttttagttatttctctggtgcgctatataatcttattgattacatgacaagtggaattagaaatttctttcaaaatctactacacagatatataaatatgcttttaaaaatcaaaaaattagaaggagataaattttccaagggttaaagagtctagtggaaaaaacactggaatgggaattacacagactaaactctagtcccaattcttttgaccttgagcctgacatttaacttttttgatttcatggatattatataagaatataaaatgccttaacat

SEQ ID NO: 112706 - DNA, 1072 bp, Homo sapiens
tgctgacaccgcatggaaaatatataagcagaatgatgcccaagttatagaagttcctcttcctggattttgtcttcaattgtaactgtagttcctaccgtgtggttgtatgtgttgttagtttgtttttgttttgttttgtttgggaaaggtgacatttcatctccaatctaatgagtgagaaagatgcttattctgacaaattttcttcacaatatttcataggtgtgccaagctgacagattggttgactctgtactcttttattttattcctgtaactgggccagtttctgcccttaactaaaactggatcaattataggagtgaaataaaggtccatctcctgcctatttattactttgctttggtaataaatctatttttaaaagaacctattacagagacttccatttggaattatgcatacttggtgtcaaatggtgattgttctttgttgtgtttttccattcgaaacaaagcttttgtgaggcgtccctttattctgattaaggcctggtgtaaatctttgataatgaagcccattaacaaaaatgactataaatagctctacttctatcagggatattaaatactttctcaagcacacatgctcactgattttaagactcattccacagtgttccaagttgcgtgttagattttttttttcttgagacgaagttttgctctgttgcccaggttggagtgcagtagcgtgataacggctcactgcaacctcagtctcccaggtttaaacgattctcctgcctcagcctcccaaatagctgggattacaggcacatgccaccatgcctggctaatttttgtatttttagtagagatggggttttgccatgttggccatgcaggtcttgaactcctgacctcaggtgatctacccactttggcctcccaaagtgctgggattataggcatgagccaccgcgcccagccagtgttggattttatcattaccaaatagtcataaagagtgtgagcttattaatgatgctgaccattcaaagtgatcagcaatctctttgcacacacactatctctggggatgagtc

SEQ ID NO: 112707 - DNA, 1972 bp, Homo sapiens
gcttctctttccacttagcacccataccacatttgtggtagagtgacgatatatgctgttcaattgcatagctgcttctcctgggcagggctagggaaagtgaagggggagattaagttgcatgtggctagctcagttgttattaaacgctgcctgactgatgcctgatgtctgcagaggattttctttggaatttgatcaatggagtgctggacagtgaggacagcaaatggccattttatctcctgtctttaaaataaaatatgccctctctgaaggacagtctatgctggctctcaagtttaaatgtgaacggacagtgtgctccttacctttgaaggcagacacaagtttatcccattgatggtcatgatgctttgtggaaggaatcagcttttgttacgagctcaaaattcagccagaattatatctctgctggaggtttgatgggaagagccttttaatgtggtgcatgcatcatttcaatggctgtgagctcctggaattggaacctggtgccttgtctgtgcagaggtcagctggtgagtatgagctactctctttcctcagagaactgataccaattattttccattcaaatagaaatcatagttaagtttgagcaacacaagtatacaagaaggaaagattttaaaaacatcaatttctcatcagcttactactgaataagctagttataaagaggcaaagttaccactctgtgtaggaatgtctaatctgcctagctttcttaaaaggattatgtgctactatctcctatgggagcaatctgttccttaattaaggaaaagagaaataaaaatcacacactacgaatggacttgtgatgagtttattttgtttacaaatatttatactaattgtctgggatttcctgttttgtgatttgaatagtaagagccctcaatgagggctttttgagtgggttccttttccgaggtgagttgatttaagagccctgaaccttggccctcctgcccttgagagccatcccaaggaaagatacctggaaaaaattatttggcttctagtgtcctcatctataaaaacatggtgactctgcttctctgtcacacttaaagatattatgagaaaatgtaagcaaagtagtgtaattatgattcttaaagatgtggcaatcacagtgctttgtgcaatgcgtatgtcggtcaatctaacatctaacaaactatcacctggttcattaccttttctttatgagacaaagataaaaagagctgtcatacttgtttatagaaagtaaaagagtcttagagactaagactctgttaaccatccctaaatttttttttacttattaagttgaagtttaaaaaatgtgtaaaaatgtataattttcctggcattagaaaacaacataatgaaattaataactgtttgattttacaagagagtctatattgagctcattaaaagccaatgaaataaaaggttttttttgacaacaggaactcctcactttcttctctatctgtgctgatgatttttcactttcttaatgaggtttctagaagaggagaggatattttgatagtgtatcagcagattctaaaggggcagtggaaaggtcttgtgccagaagaagctggagtcaccctcacaacaggaaaaccattgcaggaggcttagccacatttccttgggactcatgctattaagctaaatggacatccaccaatcaagtaagacttgcttgttgcgaacatttttttaaaagtagaaggaaagaaaatgccagatggcattcagaacaccctgtgctctagtcttgctgctttccctgaaccaccttctttcctaatgactgctttgacaccacaacagctgattctccagagtacttcagaggacaaaatgtttgaggtatgctatgtcaagtggtagacggtgactcccctggccaaggagatagaagaatcctccccacatc

SEQ ID NO: 112708 - DNA, 1050 bp, Homo sapiens
cagaagacacagtctgtctggaggagtccccaaagactgttccaattggtgatgtgtgtctaaggatggctttttcaactagtaggatgcttctctgcacttgcagccacccaactgctgaagagctggaagtctagtgctccgccttcccccgggaccatttctgagtgtgggtgcacacctatgcctgtgtgcgtgcaggtgtgtgctgctggaggtctcggtttgggaccttagttcattgtagtgagttgtgggtgctgcagaggctggagcaagattatgacctagctcgggggcggagtggattatcttgtgagtgttctggctgccagccattgccctggtggggaaaatcacatctccatagagctctgaaatcacctggattgctggggagtggaaactgatcctctgctactgcttctgctgatttcctctgcaaaatggctcacgctgctgcttctattaaaaaagttcgagaggctgatctggatgaaaaggaaaaaaatcttgagagagacagaaaaaaacaacggaaaatccccagagaacgtatggaacgaaaaagaaaggtatgaggagcatccttttaaccctctttctctgcagctctgtgtagcaccatcagcctcagaactggcaacttcatcctcccttccttccatcattcccctgcaccatttctaagctcagtttgcagcctagagctcatgcctacatttgctgcattgggaggagatgcttgagcagggtgaatttcctttgctttgaccaagcaaggcaaaaatgcctccacttcatttttctttttttttgtctcaattatctttatttaatctcaaagctaggtgctttatctcttcaggctactcttagtactgggcacagaagaaggaaggggttgatttacggttggagggttaaagtattttcttcttcttgttcctcatctctattactctatctttagcagtgtgtcttctcactgactgtatatttgatgtagacctctagttaagaataaactaaagattttatgtgctctct

SEQ ID NO: 112709 - DNA, 1204 bp, Homo sapiens
gttttctatcattaatcctttaattttcttttctgaatatggcaatgaaatcaaaacaaccaaggttaaacaagggatgaaatgttgattccttttacattgaactattgtttctttctcttaaaatattgttttcctttataatagaaataatcttacaacttgatggaactgaaatactcatttagtcagtgatctagatctataaagaaagacctctgtaaatgttttaattaacaaagtaggtcactgaataatttcagaagatgataaatggcttattacattagcagagcattaaaatagtggtttgtacacaagctgttgttaaacatagctctgggattagggatgcaatggggatccatatacttaataatccatatgctcaatggactctttttttcttccataatagatatgtttacctttcaatttgggggatgttgtctttgcctcacttttggaaagacacttgagaaccaacattgagttgagatcttactgcatagggattcattgcatttcagtttactacttatctcaccaccaactagatcaaatgactgttactaggctacagaaataaaattagcagtatataatgatttcccttctggggaaaactttcatactgcttgtctgacctttaaaaggccgtgttgtttcaagattgcattaattcttttttttagtatcaaaagtattattagccattttgtggaggtcgacttccttcttgacagcgactgcagttctgtttctaatgctctaaatggaacattattgtataaagaattttctgtgattatatcttttttatcttttgttctccaaaacacagtatatgatttcttggctagcggcccttgtcagcattcagctgtgacctagcaactttgcttagctagagtaccatgcatacacctggaaaatcacttgttctcactctggtttgtttctgtatctagttgaatgtttttccctttccaaaccttgataaaaacagaaaaactgaaaaactgtactgttaaaataaaaggtgccagttgttgttgagaatctcagttgcttggatgcttcattgctttagcttgaatccagaaccataggcaagattattggttagtaatgtggtcatatgacaggatcatctggtcttcacatgtagatattatatctaagctagaaccagagtaaatta

SEQ ID NO: 112710 - DNA, 1018 bp, Homo sapiens
tgggcattgcgtggagtagccttcggaaagctatgcaagctgttagcactgtttattaaagaatgttgtcctttatgtaccagaagtcaagaggcagcagtgtggaatgaaaataatagctggaaggaatgtaaaattaaattggttaattgatgtttgtgggcacatgaatagcttggcaatattcattttgattaatctgtgtaaagcataaacagtaaaagtcatttatattgacctcaattagaaaaattatgccacaagtccatatagggaatttagtgtagatccataagttatgcaacagtttccctgattgatcagttataaacagggccaatttgtaaaaatcatgatgtgtttaacttttagtcaaataaattgtattgaatgtacccaaacacggaagaaaatagcatgctgccttgcttattgcacagaatgttccaattttctttccacaggtcagtaattcccaaagacaggagaacttgtccttggattcatgtgactatgtcggcatcgagaattctgcatgcaatagggataaccaaagattaatttaattagataaacgcatttgagtgaaacaatcggtcttgaattatagctgccatgatcaaaaacaaggagaagggcagacagtaatcgaagcagatttctaaattcagcaaaggtaacatagatcttacatattaatgatgatctgaaaaatataaagtattgactaaatatcacgttaggatagtttttttgcacatgatagtttagtttaagagaaactctacatgacctttttaaatttgtgtgatgttcttgaataatccttggatcttggaggagagaaaaaaatttaattcaatgactctgagtgaaacattctgatttgccactttaaagactcatggcaatttttttttcagtctttttaatatgatagcactagccctttaagaataaattaatcggccgggcccagtggctcacacttgtaaccctagcactttgggaggccgag

SEQ ID NO: 112711 - DNA, 1019 bp, Homo sapiens
gaaataataacagtaaaagggcctgggaatttaagaagatattgcaaatatgtcacgtcatggaggctttgaatttcactttctaagtcatgtatcaaattcaagtaccctgctctaagtgtggtcaaacatgcaaatatttgctttctgagtaatttgccctaatgactttgaagcatttttgaaaaacagtggtgacattgttctgccctggcagaaagcatattccttgtcagatgtccacagagatcccgactgtctactggcagattattaaaggatggtgctgcattgtatttgctaagctttccttcagtttgacaaaatgttatgtatataggttgtcacatcacccaagcttctgtgccagacctgtctggcagccacccttggttaaccactggaagatagaactagaaacgttttaacttctgaaataaggtcctcttctacagaccccttacacttttattttttattagaaagtatctgatcgtcggcaaagtttgaagtgatcacacataggcagctgctcataggaaattctgttttcacagctatgatgttttccaggttccaggttggtaatttaaatctgttcagccagaaaataggaaatttcagccatcacagtagcaccaggtgtttgcatttgtctttccttggcctgtccctgtttggacactaagctttagcagtggggttcagggatcactacatggcatatttgggacagtgctaatcataggagtatggatattatattcaccaagcagaaagtttctttattggagaaagcatgagatgatttccccgagatgaagaaaaagaaagaggggggtagaagaaaacaaataactagttatttagggaaagtgtattccaacagttgtcagcatgttacttggttggttcatactctcagtggttttttcgttcttaacaaagcactgtaatttcttttctaggaaaatttaccccaaatggtgttaacctttttttcaaaggccaaaagggag

SEQ ID NO: 112712 - DNA, 1141 bp, Homo sapiens
aaattgagcaaggaggccgtgcatgctgtggagggagcacactttagaagaaggcttgacaggtgagagaaccgcacagaaggagcatgctggcatgttcaagggccagcaaggaagcaagcctgcctggagtagaatgagggaggggaagcgtaggaggaggttggggagagcagaaagcagcattgggtcatgtaaggccttgtgggctattttaaggactttggctttaattccgaatgagcagagaagtgattagagggtttttagtggaagagtgacatacgctgacgagtcttaatagtaaggctcaggctgaaagggaacaagggcagaagcagggaacacttttgtgatactttaggtgagaagtgaggtgttttacagtagagcaacaggcaggagaattggtgagacgtggctggattctagacacatttcaaaaatacagctgattttgttgatggagttaatgtaggatgaaggcaaaagaggaattaggcatgagggttgaggtcacaatggaaagaatgagagctgaagttttattaactgagatggggaagactgtgtgaggagcaggtttgagggaatactcagcaggtcagttttgaacatgttaagtttgatttgtttgtgtgatatccaagatattcagtaggcagttggatatatgaattttctagggtccagaaaaaagattttggcctgaagtgtacattttggcatacccagtgtatagatagtattcaaaaccgtgttactgcatgaggtcaccaaaagagagagagtttatgaaaaatagaataggttcaggggcttggccctggagtactacaatatttagaggtcaggaagatgagaagccatcaaggagaatgggaaagagtgtccagggatgtaggaggaaaacctgaagttgtgatttcttagaagccaagtgaaaacattattttcagatggatgaaatgataaactctgtaaaatgctgttgatccaataagctgaggaactgaacaacagccttagtaatgtgatggaaactggtgacttgatcatagcaattttggtggagtggaggggtaaaagctggactggagctcattcaatggatgacgggcagaccaaggactgcttcaag

SEQ ID NO: 112713 - DNA, 1046 bp, Homo sapiens
atggcatttacataggagagttgaggctgggtatggtggttcacgcctataatcccagcactttgggaggccgaggtgggaggatcacctgaggtcaggagtttgagaccatcctggccaacagggtgaaaccccgtctctactaaaaataccaaaaaaattagccaggtgtggtggcatgtgcctgtaataccaactactcgggagacggaggcaggagaatcgcttgaacctgggaggcggaggttgcacgatgagttgagattgcaccactgcattccaacctggacaacaagagcaaaattccatctcaaaaaattaaatgaataaataaataaatagagttgaaatgttcagtagtaaaattgcaactctttaaattattgacaagggtgactactaataaaccaagctccttttacccatctacttcctaggttttattgtaattcaaaatacttaaaaaaatacatcacttttgcatacgttaatacttttgctagcctacgtaaacgtatgttgaactcaaaaatgctcaattcatctcatcacatttagccaaatcttagtgatggaacattggcagggctgtggatggggagagcaggaatatatacatgtattactgtttgcatgtaactgggaaataataataccttacatttgttttttacttcacaaattacaaacagaattaacctacattgtttgatactcttaaataactatctgaggtaggcaaagtaggacatttcccttttttactattgaagaaaccttaaatcctattgtttaggactggagagacagcacgggagctcagatttccttttgccctgtgcccgtgttcttcactctgccaccgtccctctcagaaccccaaatgtggacacgatttagccaatattctcaaaatgaagaattctgcttcatcccattgtcagtccttttatttgcatcacaacacccatctaaaatgaaaattaagttcagaaaactcaaataagtctaccaacaaaaccatttcttttcttttttaaaaaatt

SEQ ID NO: 112714 - DNA, 1181 bp, Homo sapiens
accctctgatgccttgacctttgcctcacgagtctaatttcagataggatatttaaagtcctaacctaccatgctcatacataaaaacttgctgcttaatactcttagtaataaattttttacagaatgattcatgtcaacctttaggctgaagaaaatattagtcaaataccatgacaaaacaattctgtgattcatggtattgaatattataagcaacaggctcttaataaattaatgaatgtaataaatattttattaattgatttgtagatttttccagattgtttatttaaataatcataacttctgtataaaacagcattttggctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaataaaaaaaaaaaataaataaaacagcattttgtcgtttctttttccatttatattcatagttctctttctcttttcattgcactggctagggattgattgcaatgtcaaatagtatcgcaaacaggaatccttttcttgttactgcctttaatgagaatactgatgtttgcagtggtttttggaacgtttcctctgcaaagaacctgatattcctagttggatgcttttcaacaattattaacatttaatctattgatctatttaatctggaattaattttaaaattttaaaactagccaactaggaatatcgggctgattccagagggcatatttgcagattaaaatttaaattaaatcaatgtaaattatttgcatatattaatgaatcacttgaat

SEQ ID NO: 112715 - DNA, 1046 bp, Homo sapiens
aaggcagtaacaagaaaaggattcctgtttgcgatactatttgacattgcaatcaatccctagccagtgcaatgaaaagagaaagagaactatgaatataaatggaaaaagaaacgacaaaatgctgttttatttattttttttttttattttttttttaagtacaatttccattttatttttctccagagaatagcctgtcttcagtctttaagaactcagctccttacatgggctttggtgggggacgtggggcagcacccgcaggtctaaatcggggtgggggtgttcggtccttgcgggcttcacgagatcgattcctgactactttgctgtgaattgcacaactcacacagtaatgtagcttcacatacagcttgggaagcacataggcatcgaagacgctcgcttcagaaatgtccctgactgctgcggcctccactatgtttcgaatgacgaatttcttaatggccttgtccttgggcacgcatcgggcacagttagtgcagcgaataggctgcacgtggccgcggccctttttggcacgaccattgttccttcttttctttgtcatcttggaggcacggaccggagagaggagccaaaatgctgttttatacagaagttatgattatttaaataaacaatctggaaaaatctacaaatcaattaataaaatatttattacattcattaatttattaagagcctgttgcttataatattcaataccatgaatcacagaattgttttgtcatggtatttgactaatattttcttcagcctaaaggttgacatgaatcattctgtaaaaaatttattactaagagtattaagcagcaagtttttatgtatgagcatggtaggttaggactttaaatatcctatctgaaattagactcgtgaggcaaaggtcaaggcatcagagggtgcttgcatgactaacttcaactatattttttattcttttcaaatcactgggaaatttttgtgtaataattttgaaatgccatgaaatcatatcactgtgaaagtacacatcattt

SEQ ID NO: 112716 - DNA, 1059 bp, Homo sapiens
tgccatagctaaaagaaagataaggaggtaagaatcctgttgattgccaatgaaatgccttatgaaggcaattaggcctgttagggcatcatcttttgaaagcacaataataaatatcatttcagaggccaaaataattattgttttgtgcagtcttgctccagtaaacacatctaacagatcatccttatcagtttttgggggtacattttgaagccaatatacccaggaagaacaacactcagaacatatttttgtttaaaatctggctctgaacacaagtataacgagtgggcagagcatacttaggtccttttaagtaagagctttgaggagcaacaccttcccttaaagttattggggcccaatttgtagcttttgtactttgggatcaagaattttatccatccagatttttaaggcagttcaaacactatttttttttttaaaggaaaggcttgctatagaacgtctttgttggaatgaggcagcttctgtgtcagtaagggtacatcacactctacaattttcacgatttgcatgaatcaaccttgccacatcatatgctaatcagagcttattcctctgatgaaaacttaccttcatttaatagtgattcttccctcgacacatatgagaattcttccaaagaacagccaccggtacactagacagccaactgtgtgttctctgtcctttgtatgaaatcatcattctagatggccaaaaacaaaaagcaagttctcctttatcaaaatatgagaactcccatctctatcacatttcccttttttctgtggctgccaaaagcccaagtgttcaattattgtacctcgttcattctgagttctggttaccaccactagaggactacaactaaagtttgttcggggttgcacttatagccctatcttgactgtagatatatattttaaccatatatatataaagtgtttcaagtagccttaaatttttgaatgtgaatgtatttcaaggtataaattataactaaatactccaaagcagcggttgccaaggaccgattttgttgaagacatt

SEQ ID NO: 112717 - DNA, 1050 bp, Homo sapiens
ttctgtaaaaaaaaaataatgtttttacagggctgtgtggttgattgccatttgatatcctgtgttatactgctaaataccttctacagtcttatgtgcccatgtgtcaatatgcctaaagaagggacttgccctgagctgtttggtagctaatttgcaaaaattaatgactaatcaagacattatgatcactttaaagttcaataattgtgagattattcaatgtggcaatgaaattcatgattgagaagaaatatttgaagtttttaaatttcccataattatggcacttagcattggtaaataaatgatgaaaaatgaagctaccaaactttaatatggatttccttttaattgaggcacttgaacaaatcattccaaatgtttagccttgtcccatgcagtacagattagaatgaaatctacgtggtgaagatccgaggttaaatactaagaagggagttctcagtctctccagtaccatttttatacagtatttctctactctcttccttcttcctaaatattaccaaaattaaaggccaaaaactttttaatgacattctgttctgtgagcaaatgcctcatctctaagaaaaagattaatttcacactcttttaatataaactatcacagtgctgcaggaggtaatacatttaaatatgtatgtgctaatgagtctgtgcttttctcattcacagagcatttaatttgtgccaaacaaagttctaaattcaggctactatttttcatcttaagatactacatgctttactcttccattctgttaagtaatgtgttgtgtttaaaattcagttattattaaaaaaacgattattattgctggtactgcacattgatacaatacacttgaggaaaattattttttcctcagaagtctgcagtgactttaaaaaaattattttcggaaaaaaatggagtagttaaattgtggtaaattaccatcgtctctagaatgcagtcctgggttcaagcaattctcctgcctcagcctcccaagtagctgggattacaggtgcacgccacca

SEQ ID NO: 112718 - DNA, 1013 bp, Homo sapiens
aatattagcattccaatgatacatcgttttataaaacaacatactccagatacatttactttacaaaagtctaaatctgttatcagaaaataagcccattagaggataaatgagtcatcaacaaagaagagaaaattagagtagatatccaatttagtgctttcacaatcaaatcatttgacatgaatttctcataacttcaaaagaaatgggtctccaaaatactgagaaaaaattaactgtgaactatgtgccaaattaaagttcaccttaaagtttctagatttaagggtttgttgtacaaggaatcagaagaaattattctctgcagtttgtcaattaccacaaccaaatttaaaatcaaatttagtttatttggaatggtttactttacttggttgaaatcatccttatcttctagaacagttgtggtaaatcaatctgtaataatttttattccaatatcttattctaactgtaaaattacttgagtgaatgaaaccctgccttctttagaactatatatggttttaaaatatgctgatttttaaaaacctctctcttagagacagtagagtaataaccggctacttgatgagaaaattctcttaatcaaacccttgttcttcatgctacacctaaagccaccctttcctgacaaatgtgtcatattttggggtagaacaaagatacctgaggcatgatgcatggcctacctcaacagatgacactgctgacagtcactttattcatctttcagtggctctctcaaataactgtctataattaaatatgctcattaatcttaaatagaggacctcctgggcaaatcaaatttcttgtctgatccatttttgtctagtctcataacacaaaaaaatcagatacaaaataatattttatttcagaaggaaattttgaatcttgaaatgatttatttatggtataagtggtattaattttttgcaacgtgttgatcttcagcatctagtttctcactgaaatagattcaa

SEQ ID NO: 112719 - DNA, 1030 bp, Homo sapiens
acatagcagcagataaacacagttaaacaaagacattcactggggaggatcagggaatgtttctccaagaaagtcacatctaacctgagccaagagaagaggggaaagaagatttctggtaaatgagagaatatgtggaaaaactcagaggcatgagagaacatgacctgtcaaaataaaggcagctcaacacgatcgtagcatggaatgagagatgaggccttgctacctctcgctctttactgaatcacagggctcttctgagccagtttaatcagttttctgaagaaaacaaagagccaccaaaaagctcatgcagtatcacattatgatcacacagatcttatatatgtatatagtcagagttgctcagtggaatttgattaaccagttgaatttctttgtaaatatatttgaagttatctactgcttttggaaagaaaataattgatgataggttcattatagcctttcaaacaattatctaacatctaggtcaaagcctaaaaaactagacaacctattttttgtactttggtggttttagttgaagatgttactcttatgtcaagggattcatttttttttaaagtttccatgacagtgtcaattgatgcccttaatgtattttcactacagaaactgaaggtttgaatttgacactcaatagtctttaggtgatgttcaaaataatgagatttgaatttttatgtttttggggtacacatatcttttatttatttattttagttggcaaataaaaattgtacatatttatggtatacaacatgatgttttgatacacacacacacacacacacacacacacacacacattgtgaaatggctaaatcaagcttattaacatatctattacctccacatacatatccttttttttgtgatgagcgcacttaaaatctactctcagcaattttcaagtatatactacattgttattaactgtagtctccatgttttacaataaatctcttgaatttatttctcctgtccaactaaaattttgtat

SEQ ID NO: 112720 - DNA, 1284 bp, Homo sapiens
aagaaaagaaagtttgtccacgtagtgtaatgtgttctgctaatcaataatctcaggtttatagttttaaagttggcactattgtaagctattttatgaatatccagcatagagtctaagaaataaataccttaaagtctaagtgaataattagcaaaaacaaacttttcttgggctttttccttgagcaccaatgcccccttccactatctttttttttttctttagcaagataggcttgttaacttcatagtctaatgggatgggagagggcataagctagtggtacacatagagtgccactgaagccctgaggctctagcttcctggagcagatgaaaccaaactgagaccaaataatgagtaacaatggtgaggaaaagtggggagggcatttgaagccttaacaaggtcttgagcaaaggctcgcagggtgtatgagaaaaaagggaatgcagtgttgctggagtgtaagtgtggaggacgggaattatatttgcatagcagggggatccttctgccagtgagaaagaggatgaattttaaaggagagtttcaaagggctaaacctggagattgcagccactctgagaagcaattgttcgtgtattaactgcaggtgtcatgagaggactagcactctaaccttggtgatagtcatggagagaatttcagaaataaaaaatttgagagttttttgagacatgtgtaggaggcaaaactagtcagatttcatgatgaatttcatgatttaggtgaggaaggggaaggagattaaattgagtccttggcttcaataacttagataaagggtgctcccagaaggaggagcccctctggagttccataagctgtcttgatacattggtagatttggaccttatactctgagattcttaaaagatttcaaatttgaataaagtgtaatgttcatggcattgcacaaattgatgataatctatgaacagtcttattactgtcaaccataaagcttctattttttgcatggtctcccttattaagaataagtacttgatttgatctgtttttcttctttcaaagtacttaggttgaggaagaatttagaataatactttctataaaacaggatggatggcttgaatgctcctgcttaaatccaatacttttcagcacataaggtcaggggacatgaaacaaacaagacatactgtgttctccaggtctccacttgcatttctagatcactagatgtattcaccatttccaaaatagagtgacagacagcatctcattttcatggtc

SEQ ID NO: 112721 - DNA, 1305 bp, Homo sapiens
atgtttaataaatattacagtttaccaagatagtaattattatacttttcaataaaattacactttcataccacctattatgtgtccataaagcagttgtaccgtagtaaaataaaaaatataaactaagaccataacaaaacccctagtacatcccctagatgaacagcaagtaaaactttacacttctatggctatgttattatacatttattaactgaatagcagaaccattgacttcatgaaaaattggcaactgtattggaaaatatttaaacttgtttttaatgtcttaaatcagagtgaacaatttctgatccaagggcttaaattattccagacctttgtcatgctggttatattattttagtgagaataattctttagttattattattttagagggaatattcttttagagcgaataacttctctggtgttggaatagtccatctttatttcatttaagtagattatacgacatcatttttaaaaaagcagttagaaatgatacacattgattaaacaaccaattagtatttcagaaggcagtaagtaagtagaggaggctagaatacaacccatagaaaggtagagacactcctatatatggttttgacttattcattgttgctccctctctctgtccaacttttctcactctctgtgtacatatcctaatatctttctctctctactctaatcaattttttgtgattatatatcactttgtctccttctttcttttcttatccctctgtatttctttcctgttggggttttaggaaagacaaaaaacaccaacacctctctattcctctcagtacaaaaccaattgagagatagactcaggtatcaactaaatggatatcaaaatttcacttgtatgactgatataccgattgcaaagtgcgactttactttcatagcccaatgggctctttaataccacattcctgaaatagacagacttgtctacttagccatagtcactccttgagagtggcaattgagacctgattgattctttcaaagtttagacctttgcaatctggcagccacgtcacaaggttttatttgaggtaccattatttaccattcagtttgttctcattcaagctaaattttcattttccctttgagaccggtgtttctgctattccagaagacggttgagcccatagaacagctgtattagaaacagaagaggttggctcctctactattttcccttccttagccaaattcaaaacaaaataaaggtgaatagaatttaagagttgctgatctagcccgggcatagtg

SEQ ID NO: 112722 - DNA, 1050 bp, Homo sapiens
tacttaaatattactttccaggtttacaatgacacagagatacttataggtaaatttatctgcttgcagcttcaggctttaaagtgctattattttgattttcccatctttggtctttcttcatataattttaacttctattaaaatggtttattttgttaaattcaaacttctggtttttgcttactctcattttctactagtcctctatcaaaggaaatcaatgtattaggtctctctatatacattagagcaggaataagcctgtaggagaatatttaacattcaggagagtcgttcccaactgctttcctacatctgaatatagtgattcgaatgaattctgactgctctgattgtccagagactaaagaattaaatttcctcctatgttagccttagacataaatatatacagctcctcacgtcttgcccttttcactaggttgtacattcgcttattcaacagttatttattgactgcctgctaagtgctccatccacactgtgccaggctctagaggacacaggaagaaatatggagaacatgttcactgttattatggcacttttatggctcctatgtgtggacttagtcatttctcagtgaccaggaaagtaagcagttccaagtaatgacgaaaccatcatgtgacatctggggcttacaccatgtactttgtggcagcagctgctatgtctttactttctgtatcctcagttcttagcagggcacttgacacttaataggagggtaacaaatgttgcattgaaaggagcatagaaacggaactatagagcaagtgagaacaaaaagagagtttcaagagacacagtcaatgacacaatcagggcaagtaatctaacctgtagttacttaaacattgttacagtcaggaacttagctacttcaattcactctttagagaatgggccaccagaagatactctacatgttcttccatcgaggctccatgttatataggccataagccatcactggaataaatgtagtggagaggttatagcacacaacatgagcgtggaaac

SEQ ID NO: 112723 - DNA, 1075 bp, Homo sapiens
taatagaaatgaaaaacataattggaaaacttaaaataatatgtttctaagatagacagatgcatatgttattagttatatgtaaatgttttcaaatatactagttttctttttttaaatgttattccaatgcattcaaaataaaaaatataataaatacccttatacccaccagcttaaaatgtaagcccttatcagttcagaagatgccccggattcgttttttttctgataccttgcaatggagcagggtgagagaggtgactatagaagcactgtcctgccgcacatagccatatacacaatcaacttaagactgaagtcattctttccctcaactgcacagtcactctttgcttcacatactccatttccttcctgtactcagtgaccctaccactacagctgttaaaaatgatagggaagccaattttgccatgttcacaaatcacttttttctcttagataattttcctactgaatactttctggaactatttagggcaatagatccagttcatattcttttcaggatctggaatgctggcttattattaacgataatgaaactacttctgtagaacacatcaccctagtgttgctgtttgtcatcctttcctttttctccactaaatggatacttattattcaatactgacttcaccctttttctgatgtattccctaaatatgtattccaacatcaaaaccagcctgggtcatatcttcccaggattaacatgctagaaaggactttctacctgtagtgtctagaaaacagaaggtttttttcaaagtcaggataagaatcatggagactctcaggaaaaaatgtagcaaattactctgaccttcctatagctatggtgtcacccaacatgtataattatgaataggagctttttgtgcacaccaggggctatgagccaaggcagtatttgtaaccattcaatttatgtatgttttctttcagatcgatatgacatcagaaaaaagtaagaatttaaagaaaattgagtttgtttgaaagctggctaccataaaaagaagcatgaattaaaatgcaagctagttgc

SEQ ID NO: 112724 - DNA, 1052 bp, Homo sapiens
tatatttataaaagcagcttggccagttaaattacaaatatacctaatttgcgagctaattagcagtaaaatgcaatgattattcatctaagcattcactttcttttgacattcttgttaaccctggtattgctgttatgcttgtttagaaacccaccctaccgttttgtccatttgttagcaaaacactgtcatctcatcattttttaagcactgacatgacagtatcactttttatgtaatgcaatagtgacttctgtagagagctcattatttttgtaggatacacctgcaaaagtgatactgtctaatagttcttagctgaagctaaccccatccaatgcctgccccctcccccatcactcttttgcactttttactgtggtgaagtgtaaccaatgtctttagagctgaggtctaacagacttctgtgaaaactttctgaaaaaaaaccacaaaacaaaaataaacaaaagtgaagagccaagaatgcaaaattaaaaccccctggataaaattactaatcacaacagcatgttattatagggttaattttaaataatgatgcaaatcccaaacctgatctagtagagagagaactggttttgacagaccttaaaagagctatcttagaactcatttcaggtttgtaatatccaattaagattttagtttgttggactatttctagtgactctctggcttcttgtgtggaaactccagttgaattttacagatttctgcttttgtgccccaaatgctttttaaaaatctgatttttaaagtttattgaatatcaataaactttatttcagagtttattttgatttgctgtatttcacagtatattcccaaaatgagaaaacttagaaccatgtttaatatgctcatgtggccctacacaatgatctgagggcttttttaaagtcctaggacaatgtaatttactactaagttatggaagttgctttgaatgaggcttaccctcatgttaaagcattattcagatctagaatgtttgagattctggatgttttcattggtttatataa

SEQ ID NO: 112725 - DNA, 1053 bp, Homo sapiens
ttatgcatggactcatagggaaataagtacacttcgccacagtaatgttttacatatctgttctaaattcccgccatcctcctgcccatacgtttcagcaaggccgcctctcccagccgttttactccacctttgctttgcatggaaataacttggcttacataaactgtgtgtgtgtcccgtgtgactgtctctgacttgggttgccatgcatcacattttaactttggactcacttataagtttaatcacaattgttgtttctgttgtttttctttcctttcctttatttccctccttggtctgtccattctgtgtctaaacaaggaggttgctccaaggaaaggaccatgcctcgtagcaccagactgtttgtttcattgttaggtgtgaatttcccttagatgaaatgccggtttgcagctgattcagatgtattttatatagtctttgtatattggtagaactaaacatactgaatttcagacttttatatgattaaaaatgtatatacatcattagatgttattctgagcttgctactactggctttctcctagaggaaatcaactttctgcaatttctaatgctttttttcttattttttcctcatggttggttttcttttttttttcaacattgatctgtaacatctgaacaatcttgagatacctctgtgtaatttcactgcgttctttgttttgatatgtagtgtttttttgtgtgtgtatgtgcgtcttgttttagctttgttgtatgtgtggatgtgctacaagtgagaaaaattaagcaagttatttcctgctcatttttccttttcagttgttttttttttcgttagccttgctttgctcttgtaccctgaggccttgtggatctaccattcccagcccattttgttgcccctcccaccaccaccaccacaggaaaagacgctgtgtcgtttcagtcctgattacatttgccaatatcttttttgatttccattttactttcaatgtttttcattcacatcaaagatgatgagacagaatctacagaaacatctgtcct

SEQ ID NO: 112726 - DNA, 1022 bp, Homo sapiens
agtgttagagtgagtattaatcaagttaatacttgcagtgcacttgaaacggtgcctaacatggaataaattttcagtatgtattagctattgtttgttatgatgattattaactgtactcatcttactcttcagattctgtgctttgactgtctcagtcaattcccacttgccattaggtctccttggcatgtaacacactctgcattttctttccaaattctaaccccatgttaggtgctcccacactcattgactggcacctatgacccagttgctctgcactggaattgaccgttacttgcgtggactcttctacatgatccgtatcttgaaggtggacacagtgtcttcttcatctttgtaatccatgggcccatctcaggatgtagcacatttatcttcttattttttttatcctcttatatttattacttaataaatatccattcaatataggtaagcttcaactaaatacttaaatcattctgcctttagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatatttgtgagtttccaaagaaagcctgtcaaatgtaataccaaagaaacaggctattgtggatgccaggcatatataagcataactagtttttaaatactttttaaaatgaccctaccaaacacaagtgccagagctaaaggggaaaaaaaaagcgttaacatgtaagagacataattgtgacagtgtttggggcacagacctacaagaaccaacttccagagctgtgactttgaacaagtcc

SEQ ID NO: 112727 - DNA, 1100 bp, Homo sapiens
tttttaccctgagtgagcacttttcactttccagctaggtctgtttttcagcttgcagacaagattgagaaatccttgaaaatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggttgaagctgtgtagcattttaacatatatatattcacaaatatattcatataaacagtatacattttgaatcagtcatttgttaaagaaaagtatattcaatgaagatgaaatttaaataaaaaaggacagagtctatcctccagggattgaacattttccaattatctggtcttttcctgttgtgcaaaaatgactcattgctccgaatgtcaaaaacaaatgcgacaaacaatggcacttcatcatttaaagtaatgttgccaagagaaaaaatttcctgggagggaggtttcccacaagccaaatctcctaagcctcaaatgctagcactttttggcagttggataggaaatgagacattctttggcagccaaaataagagaggccgatggtgaaactttttgagacaccctatggccttcttgtcaaaaccttcactggagctcaagaaaagcatttctgttgtgttatttgcagtgcagatgatgtctgtgtaacaacataatggttattcacctttttttgattttgatttttgctgtgttatcaaaaacttgaatactgtgagaagaagtgaattttcagttgacgaatcagcatcttgttcccatggtgataacactaattgaatatatctatgagggcatgtattagttaatggaaaaaaaaatacaacactaacaatacatagctgcaatgtgtacaatggctgatttaattaaataaaatgtacaagtgttaaatgtggcaacggtgatttgttcttctttatcatgaatctgtgatttcaggagaataagaggttttaaaaagttgagctagacttgaaaccaacagaaagacacaaattgctttttttct

SEQ ID NO: 112728 - DNA, 1053 bp, Homo sapiens
actgtggtaacaactgcccatcctatataagaaaaaaagttttcttcttacaactaactggtgttttcaaaatatacaattctttaggccaaaaattgttgaaatagtcatttccatttttaatcaatttccagtaaaacagctacttccattgatttaaggtgttatccaacagctgtcatcattagctcttaattagcagttaacagtacaaactgcactcctcgccaggggtgtgggtgtgcctagagtcagtgatgtgtagcagtagttctttccacactgtatacatgtgaagaccgtcctttggtttgtggctgtagccacagtttgcaggacctgtcgctgtatgccgcaatgcctctccgcctcataacccatccagcaccattgttcagagtcacccacttcctcctgatgggtacatgtccatatggtccatctgcttatgtttcccagcattcttgtgcagcacctgttgaagttgggctcctgtatgcccttgtgtcatttctgtcaccatcctgtttccagtatctcacttcagctcaccattcaccacgagcttggatctcttgctgcatttcatccttcttacacatctaggaaagtggagccctttacaacaagcagattctatggctatgagactgtgtgtggagacttcatccttcttgaattcctttttacttttcctgattactaggtagtagtaatgaggatgtttgcaaaagtctcaattaaggacaaagttgttggcacccttattacttgaatggtgattcatgtttgatgacctggatatcgtggtctcagctaatttatagaatcacttgattaatgagctctctgtgtgggtcttctataaatatgtacattagtgaatagtatgatgactgattacccagattcaactattcttaagttctgtttgatcactgaaaaccttcttttctgtgtgggatttcctaaggcagatgatctcatggtactgatcttcttggtatctacatgtaatttatatttcaggacttgtcttgcatacatttctca

SEQ ID NO: 112729 - DNA, 1041 bp, Homo sapiens
taacccagtctctttaatatatctgagttggtttctttacctgtaaaataggaatatgttaccctcattgaattgtaggagggtcaaatgcagtgcactttaaaggaagacaattgacaattgctacttaattaatgggtaaggtcttaggaatgccccaagctctgtcttcctgctacctacctgagagtatcttctaagcatgaactctaaggcatgaactctaaaatgccttgaattagagcattgtcacaaaatatctttgttcaaatctaaatgttaatggaagatatctcagatattttccttgcaataaatcagctcccagcatacatagatctgtttctgctgatgaatttaaaaagcaacagagtggcctgagactcaggcagacacagacaggttttgtgaaggatacaatcatattttttaaagtatttttaaaacatgataaagctatatttttgtaaagatagggggttgtagctaaaacgctgcatttggaccttgaacactagagggatagtgtggcatacaatagtcagtaaccaagggaagcaggactcagcataagggacatttcatactctttctttgcctgcttcatcaaaggccttttccagcctcttctgcctttgtgtttatctctccttgttttcctagtttccttcctattttctactttttttcttcatccctcctgtctacttcataggtaagaggcagtatgtatagtggttaagagaacacacttagcttctcagttcacttgctgtatgacatggcacaaattctttagtccctgtgtctcagttccctcttagaaatggagatcatcaaagttcttgcctcatgggactgcagagaggattttttaaatacagtaagtgatagttatcattgctattattatacaaagtctttatttataaatgaagtttctagataactgatatatgcattatagtaggcttaaaaaacaaagtgtattatataactcagcattattggcgtgattatcagtagaatgccctcatctga

SEQ ID NO: 112730 - DNA, 1073 bp, Homo sapiens
atacttaaagttccagaatttaaaatttgatgagaactgttgtgctgtttcaggttgtgaaaattcatttattcatacacgtaattttacctttgagcaaacttcaaaaagaatgactgccaaaatgtattataacctgttttctcaaatgtttttctcattctcttttttaaaatttctctctaaaaacgtcatagggacaactgtaattaggctaattgcgtccactcatatgtgcagcttatggcaataacagagcagtcatagaaagaacgaggtgcagtatgcttcaaaatgcagcatctgcagtgctgtcaaggccagccatgccgtcagtcttgagctaacagctgtgatgaacagaatgttgtgttattcctttggtgtgaaaatgaattgacagttatttatagggaataattaatgtaacattttgtaaaagtaaacatgattttcaatccttgagaaactgttaaaaaggaaaaaaagaataggaaatgaaggatacttttgaccaacagaaaaggcttgaagagaaatagatgatgtctacaactaaaacactatcttccagaccgtttagacataccatcaactctgagaataatagttgaagagttaaacatttttaaaggaaacaaacccatcctcacagtaattgtgaacatgtggaatgtctctgtgaagactatagtatctacttttgttaatatagtaagtaaaaatcatgacaatttcttataattctgttttttcagttcattatttaaaataagagagtggaaggaagtagggtgggacataggaaggaaggaataaaggaaggaaggaaatatgtatatattaatcccaagtaaatatgatgctgaatatgtgatatgaataacacatttattcataatctcgcatggtcaaatggctggttagacatattagagattattttggaattgtgtgatgcaaaagaagtaaacttggctgaatgatttgtctcaaacccttatcacatgttagctggttaagtgcttttgtatcatgtgtttgattatcatgtttccatctgaacagtaact

SEQ ID NO: 112731 - DNA, 1033 bp, Homo sapiens
cagtggaggtggacacagctgggagtgaggtagaatgttgtgatgggaagatgaaaggatttgttaccggcacattaattttagaatacctattagactcctgagttggagatgccaaagacgtcattggatgtgagtctgaaatctggtagagagttcagggttgggaatataaaatcagaagttgacagcatgcaacaggaatgttatttaaaatatttgataaccagtatgacttgagaaccaaccaatcaaagcagatgcctgctttaaccacaggcatagctgtacagctcctgtcagcaggctatcagtccaatatgcacttgcatttgctaaaacatatcctttctacattggtcattctcaacctttacagataaactacaaattttatcaatataccataaatgcagattacccattaaaaccaaaaaaggcaccaactagaaagcataagcagggaatatttattttctccactattatatttgtccactccctaattcacattatgcccactgtattttcttgtaagggttaagtacaagtatttaacatactaacatatttgtgaaggccagggactagtttgaaagtaccagctttcaagtacaatggacttgtatttgagtcctggatactccattgtactgtttttgcagaaataagctccttttccttcctttttctgaaaataagtctgtaaagctggaaataagactacttcacattgttataaggattagaaattctatatataaaggatctattacagtgcccattaattgcagtacaatttcccacacaaattgtaggattttagagcttgaaaagaccttaacttggcttgtgttcttaataataactggtcaaattattataatatatcacacaatatatgttggatttaggctgtaagctacattcagaaatgcttgggcataaatatgtgcacacttggacaccctgtttaccaggaggaagtataagttcttatcaaaggaaagaatgattttgattatttctttct

SEQ ID NO: 112732 - DNA, 1031 bp, Homo sapiens
tacccaaacccctgatctttcactttttggcagaagatataagcttcttaccatgtgagcatcctcttcaggatggaaatatttggctgtgactgtgatcatctttcttagactaagactgaatgctgctgagtcaagagcagtcaagttgggtgctcaaagtatctgctgaaaaagcaacataacgtctgtagcaactccatcaccacctaactgtggttgagcacttatttctagggtgctttttccccccattctgtccactaaagtaaagctcacttcttaccggtcccttgtgcctttcccaaacatgtatcttttgttggctcaactactttcatttgtgtatatcccatcagacttgcatgtgggataccacatagagctgtagagagtatgaatatatgttttgagtcatctacatgtatgggatagtgagagcatatgaacgtgcccaacagtatattaccaagggggccatagacagaatgatgaaaatgcttatttgtaaaaatttgacttcttttaaggagcaataacaacagccattttcttagattactttcattctgaatatattttaaaacatttaatatataaaacagctaaatttttattctagatgaataaaaggaaattatatttgggaacaaaatattttgagatgtacaaaaatgcagtataggcttctttttacaataataatccaactaccccaattttaaatagggttatatcaatttatactcttagaaaagtaggaagactataaattttaactacagtcttaattttgttaaagctataatgagttactattttgaaggtcattatttccttctgccaatctccttctcccaaataatttctcatttaaaagttgtagtgccaaatgtgcatttaagcttatttgttaggaactctctaagagaactctgataaaacatggttttcaaatgttattctcatatgtgttgattattccagtgaccttttcttttgatatttcttatataaatctgccattcaaa

SEQ ID NO: 112733 - DNA, 1136 bp, Homo sapiens
tgaagtccaatttgttttgtctttcatagttactgctttctctttcttaagtaatctttgcctgcttcatagttacaaagaatttcctcttgtgttttcttctagaagatttactttagctttagatttcagtctttgattcatttagaatttacttttgtgtataatatgaggtaaagagcaaagttctttttttttcatgtttgtccagttgttccaacatcattattccctattgaattattttggtgcctttgtcaaattaattggctatgtatgtgtgagtgagtttctggacactgtactgataaatttgtatatccttatgccaatatcacattgtcttgtttactgtcacttaatcaggaagtgaattttattctttttcaagctagttttatctatccgagcttctttcatttttatataaatttacagagagttgtcaatttctttaaaaaataacctgtcctgatgtttctttgaatggcattgaatctctacattaattttgtgagaatgaacctattaatatggagtccttcaatctacatacatggcattatctctcatttatttcatagcccagaataatgcacaagaaagaacacatgagcggagactagttgatcaattacctctagcaaacatagggtctcctctctcttttaaagtctatttaaacaccaattctaagaaaatatgcgtttggtgttaagagagggtatctcatgtgaaagtgagtgagctatacttccttatattaagaggagcggttaaaacttcagaactgtatcgggtttcaaaaaaaattgttttccaaaaaaatgtgcagccctttgactagtaatatattttctgtactagtgaaagtgtgatctctcgtagtttaattcaattacctaataagctgatatgtgatcactagtattctcataaaacatcacataaaaagcaagcagtcgtggtcaggcttggtggctcacacctataatcccagcactttgggaggctgaggtggcaggattgcttgaggcctagggagttcaagaccatcctgggcaacatagtgagaccccatcttgaccaaaaacaaacaaacaaacaaacaaacaaacaaaaattagccaggcatg

SEQ ID NO: 112734 - DNA, 1374 bp, Homo sapiens
gtgtttcgacattaaaaaggagtgcagggtggggcacggtggctcacacctgtaattccagcattttgggaggcccatgcaggaggatcacttggggccaggagttcaagaccagcctggacaacatagggagaccctgtctatacaaaaaataaaaacttagctgggcatactggcacatacctatagttccagctacctgggaggctgaggtgggaggatcactttagcccagaagtttgaggcaacattgagctatgatcgcaccactgaattccagcctgggcaacagagcaagaccttgtctcttaaagaaaaaaaaaaaagaaggagtgctgatgtcccaagagtctagacacctgctggactctagttgcctaactttaaagatgagaaaccccggcccaaaggagtgaaatgacccacctcacatcacccagaaagtgtttaacatagaactagatctggttcctatggccctgtaatcatattacttctctatacggctgtggacataacaaatgggaatgaagtttatgagagagggccatataaaaagagcaataggctgggtgcggtggctcacacctgtaatcccagcactttggaaggccgaggcaggcggatcatgaggtcaggagtttgagaccagcctgaccaacatggtgaaaccccatctctactaacatacaaagaattaaccgggcatagtggcgcgcgcctgtagtcccacctactcaggaggctgaggcaggggaatcactcgaacccgggaggcggaggttgcagtgagccaagatcacgccattgcactccagcctggaggacagagtgagactctgtctcaaaaaaaaaaaaaaaaaagcaataaccctggcttagattatcttttatactttgaagtgttttttcatcatcaagaaataaaatgataggaaaacttgtttaatgaagataatgttatatagtgcttatgaaaatagtttcatctattacactattaatttttgattctttagaaactcagtaatagcaggagcatcatttgaatagtactcaaactttttgacattatttccaattgtgattttatttctttataaggcctgagaaataattagggaagatttggtgagtgcctctttagacccgggaatgctaatacacagagttataaaatgaatggcctgcggtcattgaccttcttagttctcctaacccttagttctattttatgtccattatctttgtttttactttgtggcatgtctttgctttttggtgttgctttagtgaaagcagatttatgggagagaggtggaaatgctagtcactcagtttggcttttcgctagcacttcttgaaaatattcag

SEQ ID NO: 112735 - DNA, 1053 bp, Homo sapiens
atccacccgccttggcctcccaaagtgctaggattacaggcgtgagccaccacaccttgcctgtacaagtttgcaaaaggcagaattttatatatatttcctgtgtattattctaactgggctcttatatgctatcggtattgtagtttcttggacaggcaaacgtttttattgtgttttgtttgtgtgtgttttacttttttaaaatgtcttgggtagttttcggaatctgttttactcatttggtgattataaatttagaagtttgccatgtaagatagtaaaatgttttagatcatttgggttgatttttctgcttctttttttttttttttccattttcctaaacttaggagtaaaactggtttaaaaaactttttgagacactttagaagattaagtggaatggtcatattatactttttcctttggtttttactttgtattaacatgaaggcatatattgcatttagagaaatatgaacacagtaaaatgttttcccatcagcctttcaaatttgttgtatcttgattatgaaagtgttgtcattttaataactagtctaactaggctgtcagctggttcttggaataaggaagctgcttgggcattagtgcttggacctcccactctcttattgtcaatagataacactgaacaatttgaactatttgatttacatacttgttaagtaatttgtatatatgccttctatttggaaaaattatttttgaagtggataaataaaaaaattactataggaataaaagagaacaatgtaaaaattctactaccttagaatgtagtagaatattattttgcaaatttgtaaattgtgattcaagaagtatttttatgaccttcctttccatttgtacactctgaactagatcaaatgaaaatcatcacgagatttttcatgcccatttaatgttttattttagaaagagttaaggagaaaaaaagtaagttgaaacaactgaactaatctcttgtaaccaacattcagaacaaagcttttaaattactcttcatcttctgtgtttcttagg

SEQ ID NO: 112736 - DNA, 1019 bp, Homo sapiens
ttgttgaataaaacaaaattagatattccatatttttaagatgaaatgaattttatatctgtagttttaatatttaatcatattctttacctgaaaatcgctagccatacttttcgttttcagcacttctctattttgcagttgtgtttcagtgcttttttttttcccactgtgcttagtccttcacgatttatggccctgttatttgtaaagcatagtaatctaagcaggtgattttcagtttaggatttcttctagttccatgttgtatattcaccaagtcagttttagactatatattgtcatgctcagcactcccttacagagataacagatgccaagttgaaattgacttatacagaatgccacacttaggtaagtgtttaggagtgcatagccaaaataaaaatggtacctttggtttatgaatggcagggcatctaggacagtgtaggtcagttcgtattctctggatggacatttatgtaaatattaaaacatttagattagatggaaagatgtatagtaggaacatttcagagatactgtttccttgtagcattgtactatttatctgaattgttaatttggaataatcactatattgattttattttgaagatataatttatttccattgacttgatataaataacagaaatgcatctgcaaggaatccagttcattaaagaaatttacattcgtatctgatttggtaaatatgtgcttgatttgggaatattatataacaaaatatttgtgaaatcattttgtactttttaattgttttgaagaaatttaatactcaaaatatttcaagacaccaaatcatgactttttagttattacattaagctataacttgctttaatgagtaaaaactgtggggctaattttcttccaagtgaaacatcaagtttaaataatgtgcacatgaatttacaaagtagaatcaagtgtgcaaatatgctatatgttctgtaataggttcttgaaaagctgtatataaactcagcttt

SEQ ID NO: 112737 - DNA, 1050 bp, Homo sapiens
ggaagtgtagggcttgttgcaggactttattcaagttacttttaatcctacctctggaaatagccactcaaaacaattttgctaaattgttgatttctagttctggtactacatattaaaaattctatcagggccttgatgaagagtaaatccagattttctcgtatagatgaggacaatcacatggctgaattttgtcgtgaggcaataaggtgattagaaatatacgacctgtaggcttttctaatatggccattagagttataattaataaataatatatcgatatatttcatataacatggaaacagaaatggcctgtacacccacagcatttcaaatatatacagccactggaggccatgagggcacacttgttctctctgacgtcaactgtaaaggatagggattaatctcagcttatcttagccattcttgaatttatccaagctcattttgaatcctcagatcttctctggcagagtcaccttcctaaaggtagctaaaatcagattttagaagtagcttctaaaagatttggtaatcaaggtgtgtctttaccttaactgagtcatttaaaatgttacacaaatcatccttgttctctctaggtcatcatcttttccgagctagaacactccccttctgccagctccctttggttttcatctgggtgatgtctctcttcttcagtcacttgattgaagaagaagtatatgatgaaaaggagctggacgcggtgtcccatgcctgtaatcccagcactttgggaggccaaggcaggaggatcacttgagtccaggagttcgagaccagcctggacaacatagtgaaaccttgtctctacaaaaaataaaaattagctgggtatggtgatgcatgtctatagtcccagctactcaggaggctgaggtgggaggatcacttgagttcaggaggtcgaggccgcagtgagctgagatcacaccactacactccagcctaggtgtcagagtgagaccctgtctaaaaaaaaaaaaaaaaaaaaaaaaaggaatgtcctgtcctgat

SEQ ID NO: 112738 - DNA, 1031 bp, Homo sapiens
aaaacttttatttctggtgaagctaaagaagagaacttactgatttttttcaatacttctgccttccctcagactcagggtgttaaggatttagggatattgactgccatagcagtggcagctctccctgctccttcttgttccagcttctggctgtttgtggggaataacttctagtgtaggtttatttgtttgttgtttgtttgtttgtttgtttttcccatctctgtatgtgtataggcgtgaggaaccaatggaaaatagatctctatgtaagcaaattatttcttgtttttcctccaaccagtgaaagtttttattaaaaagaaacttaatcaaatatttgctgttaccaaagcatggtttcattcttaagaatatcaacaaaagatcatcaaacatttattttaaatctcataatttaatcagagagcccatactatgagtaaggtttgatttttaaaagactaattgtctggtgtacattttaggttttctggacccaaaccaaagaatctaggaaacaacactaaactcatagaatggttaccacaaaatgacctgcttggtaagtcaatgatgtgtggttacttacttggctgttaggttttaattacataaatgtgactttttttttttttttacttcagaggttcatacggtatacggtatgtatgtagtatatggtagagttattatgttttttatccagtatctcaaatcttaaatttgaggccaaaattttaagtctttatttattggaaaacagtttgtaaaatgtaaacctttgggcctctatattaaaatttttagaccagccatcaattttaattatctggaaattatgtacttaatgaactatataaattagtagtgaataagattatacctaattagagtaatcagatgaaagtagaacagttaaaacaataagaatgtagatttaggttacaggtttgttacagatggtctgagaaccaagagaaattagaagttattcatttgtctgaaaccaaagagaagcagaagac

SEQ ID NO: 112739 - DNA, 2163 bp, Homo sapiens
attggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatagagaagtgttgttggaataaaatttttattcagattttatttcataatattatatatattcattttaaacatgtttctaagacaggtctcccaacttttgtatgtatttatgagtgtggaaacacgtgttaaatgtgagacttttttttttattgttaaacagagggagttaccttacaaggacatcgacatggatcttaaaattctgttccagaattcagaatgttaagtgtaggtatttactgatcattgtt

SEQ ID NO: 112740 - DNA, 1033 bp, Homo sapiens
attgctgttctgtcgtccagttgcacgatccaagcctacgtaacatggaacttaattactctctggcttcagaggtgggtagaagattctaatattcaggcctcatgtatgaaaaagaaacggtcgagatcttctaaaaaaagaacagaaaacggagtgggagtggaaacttcaaatagagtagactgtccgccaaagaggaaagagaaatcttcataatctttgcaagcgcattgattaatgtctgcaaaggaatctgctctttgaggtttctttctgcactagagatttttctgtttttgaaaatagttcgtgctcttcggtttttgttattgaactgtttcatgtattttttaaagacatttgaggggaggaggattattatgaatgggaaaaaaagattttggttgagactaaattactcatcgtcaaaataatgtcaaaatagttttggggatcaccactatattttgttttgatttttaacctttcaacattttcctaatgatttgcagagataactgcacaattttgcatatcaatgatactggttcttactcccaccagtgtttcataatactaacaagatggtctctcctagcaagattatgtgtttaatgcttgctttggggtaaaataaaagtacgaaaaaggtggaagtcaaatcagtattctgtaattgttagaatttattttttaagaacttacaactcagaaaagattgctagactcaccaaaataataaatgttctttattttacaggtagtgattattagtgcttcatccccatttaaaaaaacacagtactaatgggtaacacatatggaggtttgctgccatatatattgcatcaaaatatcattaattaatataaaaatattaaaatcattcctgtccattccacttgtaaatgggaattcatgaaattaaatattactttaaaaaggacattgaacttagtcttttttaaaaatgtttattaaaaatgattcctaatgaggccttgtaagatcagtaaccacagcatcttag

SEQ ID NO: 112741 - DNA, 1373 bp, Homo sapiens
tccagtcgatgcattcaccatgtctgaaaatacttcagttatacaaagggaacacttcaagagtaaggatatattataaataagtctctcagcaagatgaacagatgaacagttcaattgcacccacaggagagaggtcttcttggagaatgcttgtttatagaatcttctgtaaaatagagttggctacttctaatgattcgtcttgtactaaaacaatatcataagagtccatgtacttttctaaaagctcatccactctgtcatttagatatccaactttcagaatgtgctcaacattggccactccatctgccattcttaagtctccttgggagtctcccagaagaattatgttactattgtcttttagttgattgaaatattctgtattcctcaaggcaccatcatgtttgttaaatatatgaattagaactcctttaaatcctttgagcaccccagtttcatcaaaatccataaaattggacacaactttgacatttggatgataaacaccagcttgacgaataacctcctctagtacatcgctgattccagccgaaaatatgaacaccgggatactatgttgttggagcttatcaaagaaattcttcatatctttctttgagcataacgtcagattctgccacaatttctttaagtttagcttttggtaaagcttgttgaacaagcaaaccatgtgatttagtataccattccaccatataagggtacttctcttctacagtaagaacaggatcaacttcaatagcgtaatattttttctttagttgcaataacttttttctacattcatctgtaatcagctgacagttgtcaatgctattatgacatgttgggcatcttttccctttgtatgaaaatctactgagtgtcatatcaaagtccgttattatctgaagtttggcagctcctcctttgataagaccacagatcatttcttctactcttgtaaggttcttgattcgaactgaacttttctggaattctggcatcatctcgatgatcttggtcttccgccccgtcttcctcttcaaggtgaatatgtactgagccagcaccacccccgccaccagggcgcacacgctggcgctcactaccgcgcccaccctcgccacggccgcgcggtccatggaccgggccctcatgcgcgtccaggcaggaaaaaaacaggcaactctcggagactgcgagtctcggaagcgcgggatcccagagcaccacggaccataaaattgtcttaaattgagtgttcatctcagctgttaaaactaaaagaacctctaacctcataatctgtacctttcatccatgagtaaggaaaacaagttgaggactgagaccaaagtttc

SEQ ID NO: 112742 - DNA, 1053 bp, Homo sapiens
tttctactgtataatggggcattcttattacagaggtaatctgtgtgtgtttcatctttgtgctttccattgtgtctagatcaatgtttgaatctaataagaggttgctaaatgtattttaatgattgactaaacgcatgaagagttatatttcaggggcatgacttgctttaaggtatatccaaatgtgaatagcaagcctagttttaataaaactacatttggcagagtctctgcttgcaagtaaatgaaatttagacttcagaaaatgtttgaatggccctaaatctttagcaggttttcataagtgatgatgaaatttacctgacacagaacaaaggactattaaactggaaaagaccaggaaggttatctatcaatcttttaatttttgatggagaactagaattccaaaaagattatttagttcactgcaggtcacttctatagtattccgaccagaactctgttcttcctgactctcagttcaccacttcacccgctacaacacactgtttctgcacgcctggctaaattggtcttgacgtgatgtacattccttcttaatatgagtcagtgacctggtactgggaaaatctgtgagtggtttaacatgtcaggctattgtctaagaaaaagcaaaccatctccatgtagggttaaaaagcaaaaaaatagtgcttttgagaaaagctgtaataagcacttgcagttaaggaaaaatgtctaatgtacttttaaagaactacgaataaagaactatgttctctttatcttaatacattgtattgatattacttataaaatggtaagacttttaaatttataaagccaaaacattttatttcatctttttgctatcctccatattagccctatttttctattattaatgttcttcatcactaactgtggtgttagatacagcaggtccttaaataatgttgtttcatttaatatcatttagttataatgttgataaggaaaacatcagttcccatccagggccaatctgtgtgtagtttgcacattcaccccatgtctatgtgggtt

SEQ ID NO: 112743 - DNA, 1264 bp, Homo sapiens
ggctaggcggggcggggagtgaaacagcataggctccgcccctcgcggcgcttcccccggaatagcgtcatcagttctataagagagcgtgtgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggtgagtaataacctgtagcagtttggttgctggttaattctggattgtgaatctccatgtatctttgggacctgtcagccgtggcagtctcccttcctagccatggaagagcatatccttgtttattggcaaagctgtcaccatttaattggtatcagattctgacttgcacaagtaacattcactgttaaaaacctagagggtgccgggttattgggcaaaatttctaaaccgttgttcaatgtttctaggaagctgagctgaacacattacgatggatgatggaaacataaggtacatttcttttttgatatttctgagttaatctgaaacgccttagcggcaggacgttggaaagctaaagttggcccgttttgctggcttttgtagtttgagttaacaaccaactgaattagctgataagatctcaaaacagtgaggtaagtacacagctcggagttttataatgctttttttctcttgcagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtggctactcattgttccttgactgagtgattaatagacggaaaggtagttaatagcataatacctcctatttagtgttacacgctcatgtggaagta

SEQ ID NO: 112744 - DNA, 1113 bp, Homo sapiens
tgtaaaaatgatcttttgtaaaatcagcatagaatgattttgagaaataggtaggggatagatgaggcttagaataagtcactccagtgaaattagggtagaaaatgttcatttaaggattatcacttccactacactgaggcctctgaaaatgttcacaaatttctcaaaagcagcagggggtacacaattttttaccacaacacaaagcaaaaacagatcttgccatttgttgtcatctctgctgagtgctaatagtgggggttcaaagttttccatttgtttaaatgctgctttgaagtttccatgaagaattacagtttggtgacactttttatccaaggtacaaaggctgagactttggtataaacaccaggagaatccttgactccacagccatacccccaggaggtcaccccatacaccacccagctctctccgggccgttcacacatgagtggtcctccgctgtctccctggcagctgtccacgcgtttgtgttcatggaggtttccagcacaaagcattctccctgtaaaccgacccttataacgttcttcacaaaaccttttaggaagtaagggaatggctgcttgttgtagtgttcttgaataggctcgtcctactcagaccaaacatctgattagtggcattccagataaccatcgcaacatttaacagttactgagcatgtaatagttatgaaaataaaatccctgttgtggcattagtgtagtttaaaatgagcaatgactaactggtatgtactattgttagctgccttttttaatgttgacacaatcttaaccttcacaaatttctcagtactgaattgtctgaggaataatgaataacatttatggatttgtagagtaaggtgacctaagaaagcatatttgtgcaggctttcgtatttgaattctgtatattaaaaagcatagaatgcattaatgctggtttcgcattagcacatcaattcatatctacttcactgaattaaactgagttctcagtttatgctaaagttctcattagaaccaacaatacctccagaatataagtctcaattacatgcatgcatttcacactaagcaaaatttctccaaataagtc

SEQ ID NO: 112745 - DNA, 1050 bp, Homo sapiens
tctgtttttcctctctggatgaaactcaaaaagtagttgactgaagttgtttatgtaaatggttccaattgcttacagagaagtaaacctcagtagaatcttgcgttagcccttacacatacacaaatactatgtgtactacagaaatagttttagcatgattggtgatatgtgtattaccaaaggctatgttcctaagagctctgctctaccatatactatgtcatgatgaaacatatattaggcatctgacacactgtgttcttaaaaagtaagtcccattacctctgtggccatctctctaattagaaatatctagtcatttctaacaatttccagctactattgcatttctagggcaaaaagtcaatgagataaagtcaggtaaagttatattcttgaacaagtccactttggagtaaaattacagaaataagaaagcccttgtttcaggtacatttattcctgcaaaatcaggtttgttatcagaataagcaattaaaagaaattaatattcaggaatttttgtctcagttatattgctgcaccacaatagacacgcaaggcaatttcatggtacttgtagttacaatctagaatagaaagcaaaaattagcaatttatattatgtaagattcacaagccagttacaaaagaacttaatttaacaaagtttccaattcaaattgccaacaggctactgcattccatgtgtattgcattaacattaagaaaaatgtgaaaaatgagatagcctttaaatagtgatttaccaactacttcaggtgcgcttgttacattggcatggaaatgtgtgaaagctatgagggaataagagttgagttacgaaaactttgccagccttcacataaagcacccttaaagagactactccacatgaaatgagtgtaactgaggctagcggcattatggcattaatatggcagagtggaattatggcattttgatctcatcctcatcaggccaccattcctagattattctgatacaaagattatataaaagagtgactatgctatgaaggcaaac

SEQ ID NO: 112746 - DNA, 1017 bp, Homo sapiens
gagattacaggcgtgcaccaccacacccagctaatcgttcatagttttggtagaaactgggtctcgccatgttgcccatgctagtctcaaactcctgacctcaggtgatccaccctcctcggcctcccaaagtgctgggattacaggcgtgagccaccatgcctggcctaaactgcattgtttatctcgattttcaactttggattctctaagtagccatgattcaccctcactggatttggagaaagcaaaaaaatacatgaaaatattttttatcttagactctaagatcataacgagaagcttataactaagcctgtcttacaaacacctgcgataacctgctagaaatgtcaatatcaatatacaggccatgtctgcacctgtctagttacaactgttggctgcacatctggggaaaccgaggaagaacacaccccaaagtgcggggagcctgatgagttcaccaaaccccaggctaccaggaggaaaggaaatccctggagccttgagttagggggtttttaaataaaacagtgggcagaattattttatgcttcaataggaaacgtatgggcatcccctcaccaagaggctctatgtaatcctgctgaattgcttgaaaaaagaacccaggcaatccacgcatgacagtcataatgttttgtgagagaaatgaaaaggcgtttggggtgtgttgggactgacatctggaagggaatcacgtgctgctccgtgctctattcccgtgactccaaaatcagagacggttggcagaaacagaccactcacctaagccaggggcggggccaggagaagacaggaggctgatattcgttgctgaacacccatcatgcgccacatagtgaagtggaaagtggttgctcacttccaggtttgtctgtctcaaagtgagtgtcccgctgctccaaaccacgcagggtccggctaccagctgcgcccgctgctctccagacattgaacagggagctcggcagtctccaggcctcagggtca

SEQ ID NO: 112747 - DNA, 1034 bp, Homo sapiens
aatcaacacttcagaaactgtaatacaccaagggaacctgctatcctgggaaagagagataaaggagaagtcagctgactgtcctccttcagactagctcagaccaccccaacctgcgagggccctggagacccctgtggcgcaacagatcccttactgggtcccttccaagtggcgtcacatagcaagcgtccagaaggaggcgggacttccgggccaagcgagccaattccggccgcgccggaagtctctactgaggaaagctatgaggatactctgttcgtaagctcccggtgaattttgttccacagactcggaagaaaggttggataagagttcactggagattgacaagtactcgggatagtgaaaagccggagttggaacatggatagccgcttgcaggagatccgggagcggcagaagttacggcgacagctcctcgcgcagcaggtccgcggccctggtgtcccctgtgggagggatcgagaatgcgagtgcgcggccgcctcctccctccacaccccgcctttttctgtcccttctctacctgccgctgttaaggcctttctggtcctgcgatcttgatccctggttctgcctttgtagttctcaattttcgcggtgtcccgaatgtttttccagttccttccgcggtctttgtggtgctaaaccgaatgccaggattagcctttaagctttgtggaactcccaccgagtgtctggcatgttcacgccaggatgagtgtcatgttatcccctacatttctcttcactattaaatggtcatctatttctttcttttcttcgtcgtcagccccaaattcttgagattgtggtttcattatgaaatacgtttacagtattttctttgacatctttctgaagacaacactggaagtagcctgagtgtaaattttagattctgcatcttatatagagtatccttgtcacatccacagttaatatttgaaatcttactctgtgttagtcacaataatctcctgaaacaggtattattaccttcacttatc

SEQ ID NO: 112748 - DNA, 1029 bp, Homo sapiens
caaagtgctgggattacaggcatgacccaccatgcccagcctaaaaatttttataaaagaaaatatactttatcctaaaagtggtatttatttggtagttcagaaagcatttcaaaattttttcgctattctagttttcaatttgtacgtctgttttgctcaaaacagattaaaataatacatactatataaatttattttcaatatatcccttatagcagcttattttctcatttggttgctttctgataaaaatgaaacacagaattatcaatcaggttatttgactttttggatgacttataaactgcgtagatagatattctttaatcaggaaaaatttgtcttgttctgtttttataacctgtttattattattaatagatgcatttatacatcttgtatatatttatgggtaatatttctgtttatttttcagggcttcctatgatacctctgctccaaatgcaaaacgtaagtatctggatgaaggagagacagatgaagacaaaatggaagaatataaggcaagtagagagtgaaataagtttatggtcaaagaaaacataaatccaaatgatagattcatatccaggaaaacaaatttgatggaaagcctaattttaagatgtgctaaaataattgtcagtggcatatgttatcaccagttacattaagaccattatatcagttttcttatctttttcttttcttttcctttttttttttttgtgacggagtctcgctctgtcgccaggctggagtgtaatggcacaatctcggctcactgcaacctccgcctcctggattctaagggattcttctgcctcagcctcccaagtagctgggacttggtgcaccaccatgcccagctaatttttgtatttttagtagagacagggtttcaccatgttggccaggatggtcttgatctctttacctggtgatccacctgccttggcctcccaaagtgctgggattataggtgtgagccaccgtgccctgccagttttcttatcttaatgcaag

SEQ ID NO: 112749 - DNA, 1003 bp, Homo sapiens
gaaataatacctaatctcgtgaatattgtcttatatgttgcagttctgataatatgtaacttaaatgtttgtgacttttttttttattaattaaaatgttagtgattattttaggtggaactatatgcagttgctgatattctaacctttttgacctttaagcatagcagtttcatattgcaacattggtggtcgtatctttcatgactcaaactagactctaacacttatagtattgtatatgagataaatagttttagacaaatcaatcagcaaaatagtagttacagtaattatttatgataggaaatttttttatgaaaataatcagctagctagatctaataatgggaaagcaaagacttcaatgtttgattttaatgctaatttaaaacatttattaaatcttaaggaaataaaatatgttgagttttaatcaggatgtgatagagaaataacccctatttgtaaaatatttacttaatcttatgtttttcaaggatgaactagaaatgcaacaggatgaagaaaatttgccatatgaagaagagatttacaaagattctagtacttttcttaaggtaaaataaataattttcaaattttgtaactcttcatatttaagttctatacctgaaaagattttaaatacctgtttgtcttcaagatgttttttaattattgagggatcattgttataaaataaagattatttaaaattactcatgaaatagtcttctgatatttggctatttagtgtgaggtaacagtatattaatatcagtagctactgaaaagtaataattttagttgtattttcaaatattactaatttttaaatctatcaattgattgcattttatatcaccttgtaatagaaaacagtacagagataatttatctgccattacaatgcatgttacaaatttaattttgttttttaatttagggaacacagagcttaaatccccataatgattactgccaacattttgtagacact

SEQ ID NO: 112750 - DNA, 1042 bp, Homo sapiens
ctaactgaacaattgagaataaaacaatgtgatattccttagaaaattcagatgagaagggaaaggggttcagagacacatctgagtatggatttttaatattgagagaagaatatattctgggtgtacatggggaaaataggacttttactatgtagtttaattacgttcatgtcttaagaaagatcactggtagatcgtttaagtctatactgaagaaaaaaagactcaataaaaaggcctttagtaattaggttactgattactttgtaaatagtgtttagtaataatgtttagtgatatctaagacatttctttcattaccatctgttaaggtacttgaaaatcttatttaaaaagcatttttttaaaaacctcatttttaatgctttaatcaaataggtacttacaagccgatatagaagcctttgacatcagagaactaacacccaaatttgatgtgattcttctggaaccccctttagaagaatattacagagaaactggcatcactgctaatgaaaaatgctggacttgggatgatgtatgatcaaactttctacattgtaatgaattatttattttcaaatgaatatgtttatttggtcagaaagtgagataataaatatcatccctacttttgtagggattataaatgtagatttatagtgtaaattatagctgaaggtccaaggtacattgactaatattacattatctttaatttgagccttcttttcaaggcaaaaattgagcagatagcaagtgaataggctgtagaagacttaaaattttggtcttagagtccttggctatatagttagagaagtttaaaaacagatggaatgattcataattcattctgcatttgattagtttcagtaaacatcagagcttgtttatgtatataaaaacatgatttctactctttaaacagcttacagtgtagtaaagtatggataaacaccctgtatggacacataattacaattttgttgattaaacgatggagtcctgcataagatgacatgagagcaactga

SEQ ID NO: 112751 - DNA, 1028 bp, Homo sapiens
ctcatttgaagttagcgtttagaaaattttcaatagtatgtagctttgtcagagaatagaatattgagttggcaggaatcaaattgtgttttggattgttttgtgattacagaaggtctgagtgcttacaatttaaaaccccatgtccattgatgacaatagaatgtagaattgggagatgatgtaatcctttctatgttttgatatttaactatatatatgacattgatatccaaaagatatatatgcattccgtattatggctatgtatttaaagactggcatttctttttatattctacactgaaacaaaattaccttgaaaccttggaatatagtgtctgaaacctctagaaagttttttttaatgctggttgttattgttaagtattgtttatttctttaagttaaggatttgtgtttaaaattcttttgtttctagtgtttacgaaaatggggttacagaagatgtgaagatatttgttggattaaaaccaataaaaacaatcctgggaagactaagactttagatccaaaggctgtctttcagagaacaaaggtattgcctttactgatttgttttttttaatttttgtgattttctctcaagcttttccaaataactgtatactgtttaattaacttcagtgaaaaggtccttttcttagacttgtaaagacagcattgagcattacaggaatacatccaaattagttttaaaatgttttattcattatcttagatcaaccccaccatgctagaaaggggagtatatattcctccatgtcctaaatgccatatttctaagttagataaaggcttttgatcacactcacccgcagaatttttctaggctcagaaagaagagatagcaagatcgcaagactcgagttggccagcttagagacgtatttctctcttctttccttctttttcctttacaagaacccctgagaacttctgtttgttgtgactctgccctgctagtatcaggctttaacagtttttgttcttactttttagggagc

SEQ ID NO: 112752 - DNA, 1123 bp, Homo sapiens
cctaaaatacagtgacttttggacagtttagttgttcctaactgctgttaactgaaggagaatcattgggcaacatgcaaacatttaatgttttaattcaatgtaagaaagccattgtaactaatgatggaaaatttatttgccgatctttgcaaccatagtataaatctaaccctgctctcagtttctagttctctgccaaaaaagtgacatgatcttgattatatgcttttttagtagtaacttaggcagagagtcaaatctgtttctgggaacaaaagtcttagtatcttcaaactctgttatctggaaatattccagaagtctaattgatgggaaatctcacccagccaggcaaggaaccaaataaaaattgtacattttgaagaactttttgtaagcataatcttccttttattattccaagtagagttcataataaatatgctgtaaacatcttcaaatttgattataatttaaaatgtaaataaagtataataatgagttggcttagctattcagacaatgaaaaagcttatttaatttgtacatgtattttttacaccatgcacttggaaagaggaattacaaaatcacattttcctattcatcttggctcatcttaatgttgattttagatggtaaaattaacattattgaacatttaccatgtgccaagctgtaggctaaattctttctatgtattgtatcatttagtcctcacggtgaacccatgtggtgcgtaccatcattacttgaggaaacttaggcttagagaccgcgtaagtgccagcttcaggccatacatccagaaagtaacagagccagactgaaaaccgtatctgtgtgatcacagaagccctattctctaatcagtacactgtgtatacatgagcaagtattaacacaatcatcctggagttccctcagaaaaaaaaaggcctcagctttgccatataactgagagtttatcattaataagtttatggaatatatctgcatgtaaagtgtacttgaaatgtgaagtctccatccaagtcagcttttttttttttctgaacaaaaatgtagtttcttcacttaattttaattcactttgacattaccagatgcctaacatgtc

SEQ ID NO: 112753 - DNA, 1048 bp, Homo sapiens
caatctgtgctccagtcgaaagccagcctctctccctgtgcaccactcaagtatatttccacagtaagtttcccctcttcctcttaaatcatcagtatttttctttctacagaatgattcccatctttttttaaaaaaaaccttctctcatcttaaaatataaaaatgttttcttgatccacttcccttaccagctagcactcttttctttccacccctctacagcaaaacttaaaaggactattgccaattcttctccttctgttatctcttaaactcactctgagcagatttttccctagcattccaccaaaactgcctctttaggatctccagcagcaccatctggcacagatgatcgtgcctccgcgtgatacacatcctacacttcacttcaggacgctaggctcctcgtttcatccttctcagtcctttggctgctttctcctcctcctctgacctccttatcttggaggaccccagggctcagtacttggtcatcttctcttctttggccataattattcccttggtggttttaacctggtttcatggtttcaaataccatctatatgctaagaattcccaaatgtgtatctccaccccagactttagcccagtctccagatgtacatatctaattgtctactcagcattgctgtatgactgtgtaatagatttcccaaattggacatgtccctgactagattcctgatctctacccgcacacccgttaaaacatcccttccctttctgcagcctttactttgtcagttggtggcaattttatgcttctggtttctcaggccagcaatcttaagagtcgttcttgaccatcacgctctctcacactcacatcttcacaccttatatgcccttaacaaataagtcactgtacctttgaaatatatccagaatttagccacatctcaacacttctactcctgtcaggctggtactgcagcagcctccacatggtctccctggttctactcttccccactgcaatccattctgaaaatgcaggcagaggaacctacattacagc

SEQ ID NO: 112754 - DNA, 1034 bp, Homo sapiens
agctttcatgtgatttgacatcagcagcaatttgacacatctgtttactccgttctccttgaaatgaaacttttacattttgcttctgggattccacccatttgcttatatctctgcctaccccactggaggctgtgtctcctttgttaatgtctcctcatctctctgactacctagtgttagaagtgtcctaaggcttagtctttggacctttccaaagacttagtcttagtctttggacctttcctttctccattggcatttactctctggataacacttctcaaaatgtgctcgcaggacagcaccatcagcatcatctgggagcttattaaaaattcatgttctcaggcctcagcccaaacctacagaatcagaatctctaaggctaaggccctggaatctgtgtttcaacaagctcttcagatgattcctaggcacactaaagtgtgcaaagcaccactctaggtaattccatctattttcgtggctttgaatgagaatgcagatattcctagtaaagaccttttccctgaaatccagatccaattccattcttctggctcctcaggccaaaaacctggggatcatctctgattcttcctttcttgcacatctcatatttagttctttagctaattctcttggtcctaccttgtctattcatcctgttccaagcctctactatctacctacctaggtttttataagagcctcctaattggtctccctgccctttcagtctgcacagagcagccagagtcatccattcaaattctaagtcagatcatgtcatggctacggaaaccaatactctaaaaaccaaagttcttacaatagtctgcaggaccctacattatttgccacccctggctcccctataccctctgacacacacacacacacacacacacacacacacacacacacacacacacacacacacacacacagctacctctgacctggtctcttaccactcttctccacccactttgaccagcaacaccagcctctttgttgttccttggcag

SEQ ID NO: 112755 - DNA, 1051 bp, Homo sapiens
atctgccgctgtgtgagagaccaacttgtgatcttagattttttttggtggggggtgtcttaagaacagttcattctcattgcacggtgttcctttcctattaaaattctcatattgctctataaaggacctgattctgtttgtgtttgagtacttttgaaaatgccaataacatggctgggggaagactatgactttgcagatatcagtgatactgacttccctttgccctgggggtgaagtgcaagtgacacataggactttgcagtctgaccccagccaacctggacagcttccactctggctactttccctcccagcctctccacaccaagcctttcccctgtcctggtcgtgccatcctctctcatgtctttgctcaagctttgctttctaactggaatcccttatcctgtcttctatatgaagaaaactcctgcttgtccttcaagattcagctcaagcagtcctccttctttgaactcttctcaattcccccaggaagagttaggtagtctctctgcatattgtaacagtcatcccaagacattgtaatgatttgtttacatggttgtctcttctctcaaatggctcaaaggcaccttaaatgtatgttgaataataatgagaatgatttgagaatgccacagaatgatttgaatcactgccatagagttgattcccaaacaaaagggagagcacagtaatattgatgtataaagttctgcttgcatatatcagagcttttttttttaattctctagacatgtctataggggttttcatgaaaattgctgctatcctacttatttttttaaagggggaatatttttggagagctgtgaggcaaatttaaaaaaagaaaaaaaaagaccaaaaaaaaaagaatattttcgacttctcgtagtgcatgtaattatttaagttgaaaatattttaatgctactgttgtgaattgcctacttttgtccaaaataatgtttttaaaatgaaaatataaatgtgcttgtaattatgttgcatatgctttgttagaataaaaatgcttaag

SEQ ID NO: 112756 - DNA, 1050 bp, Homo sapiens
atagtctgagaaataaggtttttgttttgtatctcaaaggcttttaaaataagctccttgatacaatttgtgcaggttcgtgtttactggtgataaaccatgaaagtgatttattaagattttttcattaatgaaactgggaggtttgtgtatttcttcctaacgtgtaaaaaagagactaagaactggcctttcctttttcctaagaattttaacaaatatttttaaaaatgtatgtagattgtgtaagttcatggaatttgatactaataatcaattcgttaatattttcactaaacaatgcataagatagttttaaaaaagatattttaatgggaaggtagacttttccaactagtgtattcttttccttaaaaaaaaaaaaaagaaaaatcacaatactcttaagacctgccatatgtgctgtgattcaagttcttttatattgtttaatgttagatgtttattttaaactgtgcagtatcaagaaatacaactttggtaccatatggtttacaagtttgttttagcaagacaaagtttaaaaatgaaaattttatctcatttaaggttatatgtagctttaaaagccaaaatcagaattattttccctcctggaattgtttggaactctcttacttactggggtaggagggggtacattgctttaccctacaactttccgaaaacacagttgatctttataaagtgatggaataaactatcctacaaagatgtttggttactaaaatacttagaagatcctttttgacagctttaactgtaaggtatttcttgtagaactcaaaaacaacctgtagaaagttgggtagtttatatattgcatctggaagcatttttaacacagtgtgctaggtgtgctagggccaaaatgattgccagtttcgcttactctgctcatgagctcttgttttaaggagggaagtatgctgatttatgttatctttgcagagctaggtagaaattaatgatgttacaaatatagtattattatattgttaattttatactgatgattttagaaaattt

SEQ ID NO: 112757 - DNA, 1646 bp, Homo sapiens
tgacttcttacactttgcttagttttttaaatgttcattcatgtcatagtatgtgtcactacttcctttttatggctgaatagtattccactgtatgaatatacataacacattttgtttatccattgattggttgatggacatttgtttgggttgtttccactttttgactgttatgaataatgctctgttagctattttcttcacagcctcccaaatatttattgagagaataaatacagactcacatttgcattctcgtaataaactgcagtattcttttcaatagtatgttattcctttgacatattggtagattctgtttgctagcattttatttataatttttgtacctataatcatgtcacatttgtatgaggtttatcatgttttgatattaagggtatgttagctttatgaaatgatttggggttactttctatttcattttccctttggcctgcagtgatctaacactagaattaactgttatttgaagtttagataaaaatttaactttgaatttgtctaatccagatgccatttaaaatgggagaacttttctctcttttccattttcttctaaactagcctttttaagcttttcattttttcttgtattaattttggtaatttgtattttgctaggaaattacctgttcctttttagttattgccataagaaataaagtaatattcttaccattgcttatgtgtttggttatttctcctttaacaatttcgttagtgtttatgtttctctctctcttttttttttttaatcttaatcaggctttttgtaaagattttgtcagtttttgtaaaattttagtttgggatttattttttctattgtttgactataaattgacttggaaatctcctttcttctttttagtataaggtttcacagttttcatcttacttctcttttttcctacatcatgtttggattctttgagttacacatcctgtttttatctgagtttctcagtctctaattctggcaaattcttaatcatttctagagatatttatttatttccctttctgagaatcttattagatattgacatttaaatattttaaccatgtctcatagcttttgagaagtgtttatattttctacttccttattccttttttaatgctttgtagaattgcttgacctgaacttgttgctcactagtatattcttgccctatattcaatttgctagttaacccatcggattttttatttcagcagtttaaaaaatctatacatatcttcaattggtgaatattatgtttgttttaaatttgtggtctctttagtcttttttcttatggtattgattgttcatttgttgcctttctttcattgtgctcatactctccaagtgtctggttatatttttcttagaagttccaagttatgagctagtaatatttgcctggggagcagggtgaaagactaggctttaacatgtgtctttgtgtaatttcatggagtagaggtgggagtgtgtgggctgattcggggtgatgcagttcgacagttggtgccaaaaaggaacttcctgttgacctgcttagaggcatgatcttctccaggacctgctatccttattgtatttatgcagtgccggtgagaacagaacacac

SEQ ID NO: 112758 - DNA, 1029 bp, Homo sapiens
gtcttgctatgttgcccaggctaggcttgaacccctggtttcaagtgatcttccgcacttgacctccagaagtgctgggattacacacgtggaccaccctgcccagccatcacccagagtttaaagccagagttcttaaaaagggcttgtgagatcccacatgatctgtctttttcccatttacttttctctttgttcacatttctcctgccacactagactttatattactatttctccgctataccagatatgctccaaccctcagtatctttgaggtttctgttcactgtgcttggaattccttctcttaggtggcttcttcatccctttccaatctttgtgcaaatgtaacctcaatgagaccatcgttcattatcctatctaaaagcacaaaccatcccacattatatatacttcctatccccttttcttagattgcttttgttactacttatcatgtaacccttctggtacactctacaatttattattccttaaggtattgtctgcctttcgtcattataatgttagtttcagtgactggttcaatacatggctcaaaaaatgttgaatgaaataattcatcaacgaaattcagttgattagacaaaactgttagtaatacaggtataccactgaggtattgcaggtttgattccagaccactgcaataaagcaagttgcaggaatttttttgtttcccagtgcatataaaagttatgtatacactataccacagtctattaagtgtgcaaaatagcattatttctaaaaagacaatgtatatatcttatttaaaaactattgttagaaaatgctaatgatcatttgagctttcagtaagttgtaatctttttggtggtagagggtctcgccttgatgttgatggctgctgactgaatcagggtgatggttgctgaaggttgaggtggctgtggctattaaaataaggcaacaatgaagtttgccacattgactcttcctttcaccaaagattcctctgtagcatgtgacactgtttgatag

SEQ ID NO: 112759 - DNA, 1063 bp, Homo sapiens
ggttgacacacaccttcagtttgttaaaaaggcagtatatctgcaaagagcgataaagtaaaatgctataaaacaaagtattcttgcatttgtttgtttttaattcataggtttaacatttaaagtccttttaatcaggagtgtgcgtttgttgataccatggaaatttaattcaccaagatttatttatgacttaaaggtttcttttgaataattatacatatccatttacataaaatctgtctttttttggaaaaatatgattctatgtaagaaggataacaatatattctagagcaatttagtgttgacagatacagcataccagctgaaatataatttattctagatttttggataatattttccttaggaaaccatcttttgaacattgagcttaaggtaggtagggattgatgtcacattgatattttaaaaatgtaaatgatgaaatttttaaaaatttatattagaatgctatcagttctaatcctttttatgacgagttttaattctatattcaatatttgtgttcaaatggtaaagttaagaattttcttatttgcatttgcttttatttaaacttttttttcttttttgtagatttgctttgaggtcacattgatatgaaatatggagtcaccttttataacttcacctgggaaagagagagaaaactttcttgttaaaaaaacataaggaaaacaaacaaccaaaggaatcatgccaaatgccaactctacatctttttgtattattaacatattttatgcatcaagacaaatggcttatgcattaaaggggatgattcgttcatcagtatttttagccattaaaaaaaatcgttttcatattaaccttatacagctcccataaaatttaacacatataaacatctttaacgccttgtttaaaatagctttcttttttagtgcttagaacttcaatgtttatgcaccctattgttacttgtcagagtctttaagagtttataacatcaggaaagatatggacttggaaacttacattattaaaatagactgcagtggatttaattggacaa

SEQ ID NO: 112760 - DNA, 1060 bp, Homo sapiens
gaaatgtggaatttatctcatattttgaatttctttatgaaaagtgtcagtcatgtgtcattagagatactctattattgctaaactaatttgtagtgaattcgttttattggacttaaagttttatgaatgaattaaaagtggtaattctgttaacaatgtgatgtcagtggtgccttcaagtaataatataatattagattggggcagtatgcatgagaaatatttcattatgtgtcaaagacatgattcatctaattattcctcattttacaaaagatgtagtgttaagtgtacattaccaatttttttaaacagcttttttatagagttactgatgaaaatgccaaaaatagtgaacttaaccttgttggtatgatctgctacaccagccaacattattgtgcctttgcatttcacaccaaaagttccaaatgggtattttttgatgatgcaaatgtgaaagaggtaagtgacactttctttaattgaaataattactgtgatttttactttttgttaataaatgatatattgatattaatattcaaaaggatgatataattaatatgtaaaatagtaataaatgaacatgatgatagcatcagtaagttcaaactttcttttgttattcttgaaattggcttattttgaagccagcttttaaaccagtccatttccagaataataataagtaaactaatgaatattagtatacaaatatgtaactatcagtgatctgtgtgtcagtgatgatcctttttgcctgacgcatacttgctatatttacttttttgtggatgattcacagtagttttgtataactagtgatgaaaatatgcttgcctttatttttattatgacaatttttttcaaattttgtgtgtagaatacagaaatagatatatcagttatatcttttggtaattacagttgacccttgaacaacataggagtgccaagccctctgtgcagttgaaaacccacataccactttcgactccctcaaaacttaactgccaacagcctactattgacaggcagccttaccaaaaacata

SEQ ID NO: 112761 - DNA, 2368 bp, Homo sapiens
aaactactatttatatatagggatttcttagataacatttaataagcatgaaccataaaaatagctggtaaattagacttcattgaaagttaaaatttttgttcttcagtaagatactattaggagaataaaatgacaaaccgtatactgagagaaaatatttgtgaagcatttatctaataaagactgtatccagaatattgaaagaactcttaaaatccaattaaaaaatcagcaaaaaatgttgacagttcaccaatgaatatacatgaatggcccttgaaatgatattcagtacatcattagccacaatggaaatacaaatttaattcataatgagattctagtactcatctgttgtaatggccaaaattaaaaagaccagtagttggtgaggataggaacagctggatctctcacacaaggttgatggaaccacaaaattgaacattcactttcaaaactgtcagtttcttataaatttaaacatatattttccatataacccagcaaatccactcctgtgaaaatgtaagtccatgtaaaacgtgtacttgaatgttcatggtagttttcataatgcccaaactagaaatgactcaaatgtcagcaattggtgaatggatgaacaaattgtggtatagctatacagtggaatataatactcagcaagaaggactgaactattgaactgacacatgcaataatgtgaaaaaatctcagaagcattatgctaagaagtgagatataaatgactacatgctatgattccatttatatgaaattctagaaggaaaaacaaaggtgtggagggtagatcactcatttccagggactgcaaaatggggtacaaggtaagattttggggtgaggattacacaattgtattgtcaaaactcaatgacttgtacactgtaactagataattttacttcatatagtacaactcaataaagctattaaaattttttggtatttatatttaaaatcagcactttgcttgaattacttagtactttgatgtaggagtttattaagtttcatcttgagttgatgtgtaacaacatttgcagcttctactttgcttttacatagtttaaattgttcaaaatttggaggaagaactggctgtattaatcaccctgtgaagttttttattttatattcacattgactcctcaaagcctggccaacatggtgaaactctgtctctactaaaaataccaaaattagccaggtgtggtggcacatgcctgtaatcccagctactcaggagatggagtcatgagaatcccctgaacctgggaggtggaggttgcagtgagccgagaccgtgccactgaactccagcctgggcgactgtgagaccttttctcaaaacaacaacaacaacaacaacaacaacaaaacaaatggactcctcaagtctcttggaatccccagtgaggagggtaaacagctgaatatgtgtagttcaaaaaagctcatcagaattgttcttaaaagtccccttgcctgcaaaaatattctagaatgctttgtggtgtttttgtttggttggttttgttttgcttttaaatcaattttatagaggtatagtgcacaaacattaaaatacacccattttaagtgtacagttggagttttgataaatgtatttacctatgtaactaccataatcagtacacagaacatgttcatctgctagaaaaattctgtcaggcttctttgttgtcatactccccacaccaccccaggatgaggaaatcactggtctcattatagattagtttcactcattctacaattttatataaatggtctcttacagtatgtactactgtgtatctgcctcccttcctttagcataatgtctttaagattcattcatgttgtttggattcacactttatttttattgtgtgttttatggctgtacaacaatttatccgtttacctgttgaagtatgagtaatctgtgaacatatttttttccgttgctgttagataataccttgaagtgggatttctgggttgtgtggtaagtgtctgtttaactttacaagaaactgtcaaattgatttccaaagtggttataccaatttgcattttatgagagcaatgtatgagagttcctgttgttccacattctcagcagcacttcgtgttggtattctttttaatgttagcccttctcgtgtatgtataatattatctcactgtggttttcatttgcatttcccttgtcattggtaatattttgagcatcttttcatgtgcttgtttgaccattcttacatctttcttttggtgaaatgtccaattttttgccagtatttcgcattggattatcttcttattaatgtgt

SEQ ID NO: 112762 - DNA, 1057 bp, Homo sapiens
ttctttattctgcataccagtcctttattagctgtatgttgcttattttttttcaatttcttaatggtgtctttccaagagcaaaagttattaattaatttagattaagtccattttaaaaatatttttcttctatggtttggtatgctaagaaatctgcccttccccaaggttgcaaagattttctcttttgttttcttctgtaagttttagtttttgtgtgagccattctgagttcatttttttgttgttgttttatatgaagtcaggttaaagttatttttctcatggtaaaagttctttttctccagttgtagcaccatttgttgagctgactcttatatttctccattgaattgtcttgaagtctttgtcaaatgtcagtcaaccacatatttggaaagctttttaaaatttaatcaccttgaagtttataatctttgcccgtcaaatttttaaaagataatgtttaaaatatttttatttagactagttactaaatacagttaattatatgatacatacttgaactactagcagctgcatatctaaattttttaaaaatataaagtaactcagagtctgtcttttcatgtaacacattgattacaaggttttgttttgtctttattcattgtgtttttttaaaagattggaactagatggaaagatgttgtctccaaatgcattcgatgccactttcagccactacttttgttttatgcaaacccagatggcacagcagtttctactgaggatgcactcaggcaggtcatcagctggtcacattacaaatctgttgcagaaaatatgggtaattctttcttttaaaaattctcaatgtttttctattatcacagtcaactaggaatactagtactctgaatataaaatgaatatagaggataatttcaaatttgactttcagtagagctgaggaaattttagtaatttttgttagtattttggaatgaaccttttctcatcggtggcctcagaagcaccttcaggagttacccactattatggtcacacaatcacagaagaggcttcatta

SEQ ID NO: 112763 - DNA, 1038 bp, Homo sapiens
ctaaatacatttattatattactgtttaatccttctaacaatgtgtttgtttgatattagctgatatttgaccacatttgttattaaaaggtagatttgcaaaaatcaactgctcatgttttatgaaaatgcttgtttcaataaagacttaaggaaagggccaggtgtagtgtttacacacctgtaatcacagcaccttgggaggctgaggcaggaggattgcttgagcccaggagttcaatactagcctgagcaacatggaaagatctcatcatctctaggaaacagttttaaaatattagccaggtattgtggcatatgcctgtggtcccagctacttgggaggctgaggtgggaggatttttgagcccaggaggtcgaggctgcagtgaaccatgtttgtaccactgcactccatcctgggcaaaagagcaaaaggtcctggctcaaaaaaaaaaaaaaagacttgacaaggtaattttataattcttcttggaatggagtagcctagggtagtagaaagatcaggactttataaccagatagacttagattttaattattgggcaaattaatttgacttttacagtctttatcttctgtaaaatgaagataacaactacttttaagtattaaataatgtacattaagccctagaacagcacatggcatataataaatgtttaacaaatgttgtttttttttagactaaacaaaggcagtccataatacctgatgtgtttagtgtgtattttattttctagtgaccagattacgacaagcaacctaaataaagaacgtggggactgtacctcccttcagagccaacatcacttagaaggtaaaaaacttatttgaatataatagttgctgtaaaaaatgaattatagtaatttattgtttgctattatgtatctgagagaaaatcctatatgactataaaaattatttttaaataaccctaaaatatcaataaacaagttttattaagttaatatatgttttaatgaagtacatgtggaaagaaggaaatcagca

SEQ ID NO: 112764 - DNA, 1001 bp, Homo sapiens
tttaaattcctaatattcccatgaggtaggtaaaatggattatcattatcccattatataagtgagggaactgagattttaagaggttaaaaggcttgtttacctacccataattagtgagtccaaacttcaactcaagccagcgatcttcaaatgcagggtttttttcactgttaacacttggtcagtaaagatcttgtcttaagtaacagggaaaacacatacacagatctgcatgacccagcaggaacagcactattccatcatggatgacaccctcaagtgataataaactgaagaaattttgcataaagcattccaaaaagaactgttattttgagttgggtcttaaagaattcatttttttaaattggaagagattaccttttatagaaagctttatgtaaatatagaaaagtataaatgaaataaattctgtaacataatttaaataattttgttttcctcatctcttctccccaccccacccaaccctaggctttagaaaagaactcaggaatttggaagcaggctataaatctcatgaattccacccagaatcacatttacaaataaaaaatcatttgataaaaaggtaaccatattttttttccctaaatacatgtattataggcacgttgtttatcagaagggcataaatacatattattactttgaaagcaatgggtctatagtattgagatgcctttcttattgggaatcattaatacaatgtggatctaaggatagagagcttacaaagtaccaggtacagtatctgattgtctgtttcaatcctcacagcattcttatgaggtaggtgatattttacaagagaaaatttgaagcttaggttaagtaatgtgaccaaaactatcgagctgagatttgattatagctccatctacctagcaaatcctcaactctctttaaccattgcattctaattcaattccacataattcatataagaaaaataatttgcaatatggcatcattta

SEQ ID NO: 112765 - DNA, 1037 bp, Homo sapiens
gagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgccattgatgcattttgccaaccagaactagactctatttctacctgtccaaatgagacagtttcattaactacctatttttcagttgatagctgcatgacggatacatatagattgaaataccatcagaggcccaagctctcttttccagagagcagtggcttttgtaataattcactatcttagagtgaaaaaggactagacctgtgttacataataatcttggttcaagctgcccttctgaacaaagatataaacctagcatacattgtaatagataactggtaaaactgaccaacttttacttctcagaggccatttaaatataataggaacctactgaccaaacctagtgatacataaaattaaagcctgtggcatttttaaagttgttaatcactatacatatgtatgtgtatatgtgtatacacatatataattttatgatcaatatcttagatattttagaaattccctttgaatagtcttggcgtgccgtgaaaaatagaaaatcagggagatataataattcatttgtcatatgctacagttgaataa

SEQ ID NO: 112766 - DNA, 1081 bp, Homo sapiens
aataataaaaattcctttaattttcaaagcactcttcatgaaaagtagttggggtaaaattactatttgttcaaagtagaataaaagggaaggatgctctaattaaacattttattaaaattaaactctctatatgaaaggtagaaatttaatctggaaacctagatagattttcaaattcagataaaatgggttgacaacctataagcaggtaatattacagcaaagaaaatgtaggcaattacagtgacattcccaataagagggtgccctacattaattcctaacactggtggttagcagcccaaagtaaaccaaaccaaaataaagacctttcacatttcatataaaattagaaaaaaagtaacgagataaataaatacactaaagtttaagtattttaactttttaacttacatggctaaagtagcatttatgaatacctataatagtcaaaggcctaatttatcttaactagatattctgaagacaaaaattctaggagcaaaattaaattccatccgatcttgaaaacttacaaattgttaatcatataaggctttttttccccaaatgctatcaaattcataagtcattttttttaaagacacttaaagggatcatatgcagtgactatcatagaagtcaaaaacaaatgggtgaagcccttttctggttacccattagaaagtgcttcttcataaagcaattctttgacaaaaaagtaccaggctatgtatcacctggtacttttcaattagcatagtttataatctccatacatgagtactggttagtttaatacttcccagtctactggccacaaaatagggggacaaatttaatttttattcaactgtagcatatgacaaatgaattattatatctccctgattttctatttttcacggcacgccaagactattcaaagggaatttctaaaatatctaagatattgatcataaaattatatatgtgtatacacatatacacatacatatgtatagtgattaacaactttaaaaatgccacaggctttaattttatgtatcactaggtttggtcagtaggttcctattat

SEQ ID NO: 112767 - DNA, 1096 bp, Homo sapiens
gccaggcacagtggctcacgcctgtagtcccagctacttgggaagctgaaataggaggattgcttgagctggggaggtcgaggcttcagtgagctgtgaacgtgccactatactccagtctgggagacaaagcaaaccctgtctcaaaaaaaggggtggcaggggagcgagagggattaatgggaggatggcaaaagggatagggatttctataaaattctctgtcaagccatttgtaaagggagagttttactctccctccctgttttggtagagactgataatctcaaatacagtgggttttgtgtgtgtgtgtgtttttatgacctgaactttcagctctggatagaaaatagaggccttacaagaaatgttctaggcttttctttttatcaatatgtaaataggcataaagtgttaaaaactgggaagataaagcacatattgctgacaaatacttgctttttacagacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctg

SEQ ID NO: 112768 - DNA, 1354 bp, Homo sapiens
tggtggtgtttaaatattaagtgtcaaatgctagagacagtacaaaacccaccagagggggccttcctaacacgttggcataaggatccaaacggaatacggggataggagaggtgacctcgtgcagtttcagggaggagtccatcacctgactggactgggcctttcagggggacgagaacgtatttcttccaacgaaacctgaataaccagctatctgcctgggacgccgcgaggcagaagtaggcgggcccattgacttagtgtcaaggcggaggccgcgcttcatgccagcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatggtgagtatctcgaatgcaaaattggggtggtaaggagcttagagatcatttgctcgcttttgggcggggaggggactgaattccagagagtttatatatgtccaagatcacacagctggtgagtggcgcagtcgggtgggtgggggagaaggactaggagtaaaatgtccttctttagcacgtccgtgggagtctccaaagaagtgtggagaaaacttggcgtcatattttctcatgatttggaatgaaaccagctaggcttgagttcctgcagcaccatgaagcgaccggagaagttatttcgccttttggagctttattttttcatctgccatttgggaccattagtaacccaggtcataggggtgtagtgaagattgagatcgtagtgatttgcatgttgcctggcagtagtaagtgctcaacgaaagctatttttactatacagctgtttaaccatgagcagaccacgcagctgtctcaaactaaacatgtccaaaactgaactcttaacagcttcttacccaaatttacttgccttgcagcgttaccatttcagtaaacgccaactttatccaccgttacctcccagaaacctgagacactttgcccttttcttacacacatccacatatcctaaaacaccaagttacaaaattctg

SEQ ID NO: 112769 - DNA, 1096 bp, Homo sapiens
tgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaatactgtgtgattattaggggactctgaattttaagggaggggaattaataggggagtttggattttaggcagagagaatgggcccaatactttgagagactttaatcaagctaacctgtgatcctattagccgaagaaaagtaa

SEQ ID NO: 112770 - DNA, 1112 bp, Homo sapiens
aaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggta

SEQ ID NO: 112771 - DNA, 1050 bp, Homo sapiens
catgccgagaaaacaagatcaaaaactcattctccatgtgccaaagccaacacgccataagcacttaggtgatctttacctaccttcctgcccataataaacaggactatatgcctatttatttctaaccaggtaagagaatagaagagggaagaatgtgtcttcatatatcctttctctcccctgaatcaaacccttgtacatactgttttatggggagaaaataaatgaagaaaacatttttaaataaaattaaaagggaaaaatgttggaagctaccaaagacagagagatgtacctaagtgaaaaagagtataatgtaatagttaagagagcacgctttggacatggactacttgtcttcgggtatcaagctgctgcttatttgctataaaatggagatatacagctcctaacagggccttcattcacggtctctgttttaaagaatgatatgcttttcattgtcaaaactgagtctgttatttatttcagatagcagaacttgtagcaactgaattttttgatcaaggagacagagagagaaaagaactcaacatagaacccactgtaagtatgaaaccttgttggtaggaattattcaaattgttttttttttaattgtagactcctttttatggctctatgggatctttccttaggaccacaatttctcattttattttttaaaacttttttctcattggaagaattatacatgttcattacagaaagcaaaaccaataaaaggcataataaagactcttgggttcatcatattgtatcagtgttctttgtaatttgtttttttccgcttaagtattagaaaccacttttcattttaacaaatattcttatgtattatcatgattacatgaaatcgatgtaaccataatttacctacgtcccttggtgtaatatttgcagtgttcactattacaaacagcactgtgataaacatccatcatagatgtttcactcctactccttggttctcgccatcaaaagaatttaatagagaagctgtggctgacagagaaaggaaggaga

SEQ ID NO: 112772 - DNA, 1072 bp, Homo sapiens
ggaaaaacatgcatatgtaggcagatgaagcattatgaagcggtttacatgtatgacagaggggttgggtgggaacatagaggggaaactttatttcatggtatttaagtgtgtcctccacattcattagaatactgggcatgtgtttaagatatgtgaatatatttctagattttgttcttgtcagcagcttctccaggatgttaatactggttttctttttttataaagggcaatcagattctcagtggcctctccattgaagaatataagaccacgttgaaaataatcaagcaagctattttagctacagacctagcactgtacattaagtaagttttaagaaataacctgagaaataggtatttgaagtcttttcattgtttcaaacttttgacatccatattgagaaatttcaaagcagaaatgtcctggcaaaactgcttatcagaatacggagcagtttctgaaagggtagccagaaaagtctactcctttggcttatactgctgaaaattaagaatacctattatttctgatgtttatctaccactgtgtctctgaaactatatacaaatctaatagccatctcaaggtcagtcattccaagccatgttgtccaaagattatatagatcatttgcttttcctcctttcccttgctccccacaacttctgaccatttcatgactcctttataccgtcattcaagcttagttgggcaggaaaaggagttactgccaagcaagtaactcttgtttctttttatttgattttggcaggagaagaatatttatgtagaactttgaagttgttgattctaaaataagagtatacattagagttgtctctgtgattatgcattttcatgattaaactgcctttctaaaagctagaaaatactttcctgcatttgagcaatcataagtttccaactcctagctgagatctttgacgcatgtgtgggaatgaggggagtcagggaatcactctcaggatttccttgtaacatgagtctctctccctctgtaaggaattcacattcatggttgtagttactcttaggagaagta

SEQ ID NO: 112773 - DNA, 1050 bp, Homo sapiens
tgcactaaataccttcacggatatacaacatgagagcatgggaagaacttgggagtggccgcttttatggctctcaaatggtgaattcatacctatgtgaacctttggactctcctagttggtgacacatggaaatggcacatggacacatggaccttttattaaaaaaaaaaaaaacctacccagtgccctaccctgccaaaaatacccttcttagggatgtcttgtgttttatatcaatttaattagcatggtacttaacatggtaggctgtggagtcaaattgctcaagttagaattttggccccatccctaactaacaatatgaccttcagcaagttacctctctgagtgtcagttttcttgtctgtaagatgatccaaatcggagtatcaggctaaatgtgaatgctttgtagtgtctggaacatagtaaatgtgtgaagatgttggcaattattgttactacttatgttttattccctaaaggttctttgcagatggattttaagtgttaagaagaattatcggaagaatgttgcctatcataattggagacatgcctttaatacagctcagtgcatgtttgctgctctaaaagcaggcaaaattcaggtactttttagagccattcatatatctaatacattttgttgcttagtagtaaaatttatagcatattctttcaatttcactttaaggtgcacaatgatttaaaataatatttgctgccacttacataataagttatatttcgttaattaaagaggactaatctggcaaaactacttcgttgctaattttcttccatatatgatatatatggcatattagaaaaccttcaaaataacttcatgttgcacgtaaatagtctttgggcaaataaatatttccttctgaggaaaacactgccttattaagaaaaagtaagaaaaagtatcacatttctcttgttcacattcaacctgctccatagtagaattcctcaaaaaccacctagttcctgaacttgcttcattgataagttaggggtctgtatcgcattttctct

SEQ ID NO: 112774 - DNA, 1053 bp, Homo sapiens
aaccaatccactaatgacctcataaattaatatactgaagatggttttgaaatgttaaatgtaaaacaacatattcagggtgaacattacacataattattagaagcatatcataaaagggataaagcatagtaagctcttgggagttgagttgcccaggaatttccaaagggaggctcatttccacatggtgggaagttttagagtttttgtgcttcaattcaagagccacccaattagaaggaaaaaaatgagtataatgttgtgccgtttatgttagctctttaagaagtagatattttagtgctataattccatactaattaactttatgttcattcacaaatgcacatttgtgtcataaaatgataaatacatagaattaatccttttaggtcactttcttggaatatacatattagtttatacttgttattgattatcatattagaaaatataagtgtaattaaataagtaaagactactactttaaaaaattgtggatacagtgtagaagaatgtagaagtcagattgattgtatttaaatgtaagtatttaagttgcaccacatactgggcttactagctgtgagacttcatgtaaattatttaatctctcaaagcctcagtttcttcatctgtagtggtagtaggattgtactaagaatcaaataagataatgtatataaaatgcttcagaaaatttctggcattcagtaagtgttagctattatttccatgtctctttgattttttttttatttgtctttggtttacattacctgcagtgactcccatttaattctaaagcacagaaatttatcttttcaagctccacgtacctaattctctcatcccaacaatgcactcatatacagttcattgatacacattgtacaaaaagccttagatgtgtgagttagtccaggtcttccaagaaacagatgccaagattagattaaatgtgcagaaatttattagagaaaacaccctgtgagaaccagagggaaggagccaggaaagccatcagaccaacacgaaagtctgacccag

SEQ ID NO: 112775 - DNA, 1526 bp, Homo sapiens
actccagcctgggtgacagagtgagtgagactccgtctcaaaaaaaaaaaaaaaaaagaaaaaattggagaggtagctcttgtacaccaaaaattaaatatctatataaggtgacaagataaatgttaaatgagtccaatattcaacacacaagttcgaaggaaagactgaactagggaagctagagaaatccctggggagagatgaaagtgccctgctgtgtttatctcacagcctcaagagaggaaccacataaatgctcctgatgacaaatacttgatctccatggagtgtggaggccaaggagtccttgtctatgatctctcacactcacagtactgactgccgctttcttaaatttggcaagtaaacttggaggaaataaatgttacagttttattcataatccttcaattttcagtcaaaatagatgaaaatataactgcaaaaataagcagagtttaatagcagactaccagttgatctagatctattttagtgttaaagaattggctagttacatgtttttgaaaacttagaaattggccaggcatggtggctcacacctgtaatcccagcacttggggaagtcgaggcaggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaatacaaaaaaattagccgggtgtggtggcatgcacctgtaatcccagctactcaggaggctgaggcaggggaattgcgtgaaccagggaggtggaggttgcagtgagccgagatcttgccactgcatgccagcctgaaaaaaaaaaaaaaaaaggaaaagttacaaatcgttcactgcatttattccccacagtattctttcttgtagttttgttttagaaacaaaagtgctgcgcagagtttctgtttgttctggacttgaggttgtgatagtgacaatcctttctttttccttctgcacactgccctttaaataacaaagtatatattatgaagatgttaactgctttcctaaaagaagaatgtttcttaagagcagcagatgaaaaacactgtgctaatatgtgaaatccccaagtctacattactgatcaagaagaaaaagaaagtgaataaaaacttgaaactgaagattaaattaatgtggtaggctttgtgtacccaaatggtatcctatttttaatgataagaaaatttggttcatactgagtgctatattttattcaataggaagcttatcttcattggtaatttcaagataaccattccagcactttttggaatgcattacatttttaatttaatagatgatttataaatttaattttgagaagtttta

SEQ ID NO: 112776 - DNA, 1050 bp, Homo sapiens
ctagtgagtaataccgagggccgggatttggggtgtgatacttcatctaggttaagtcctgaaatgttttttcagaatccattctatataagcaatgtgttcaattttgattctcttggaaaaatttactggtcttcatagagtatctctatgacctctttgagctctgtaataacttcacactgtagcagattccaagaggggtattaaggacacagctgaaggattgctgccaagtttgcagaatccccttcctgtcttaagtgacagctgggtatccacttttcaatggcactatggtcccaagagtacagtaggatcataaatattctctagctttgttgagaaagtctttatttgtcttcatggtcctaagtgtctccagccctgagaattcttcacttatatgtgttttatttaatctgcctaccatcttcaaagttttgacaatgtattttctgttttgcatttgataatgatttaattcttgtactattgtttaaaacagctagtgtccttgatttgcactgctcccagggtgatgcctcttagcctgtggatttgtcatgttgctacttcacatttggtacccttgatctgtatttatagtagccttgcaggagttatttcatgtcccaagaatttcattagaacttgtgggggttgatctgtgatctaatttacattgtgatctaatttatattgatattagcagtggaagtcagttggctaatggataattcattactaagcaccatccataatttgaataattaaaatactatgttttttgaaagtagtcaggatatgaaaatatattctaatgttttctgagtcctagctctttaaacatgcatctgtaaaaatgacactgtatggcagtgtttcttaagcttatttgatcgtagaccactttaaaggatgtaatgtcactgtgggaaaccaagagaggtgtctgtgaaacagaataatactcagattgatgctgagaattttttttaaagtctcataaagttaattataacaaatgacctatatttagttcacttt

SEQ ID NO: 112777 - DNA, 1028 bp, Homo sapiens
gctggggagtcatgctttctgctatacagactttttggagaatgttgaactttgccttcacatctccctgcccagacaagcctgttgcacagacagcgatacatccacatggaaggcatcagaagctcattaaacctgagcacaaagagacaaatgcccaagaggtcttgaagagatgtgagagtgaagtcaggcctctggctttcattcagataagccctactgtggggagagaagggacaaacactgacctggggaccaggccagatgcaaagaacaattatccacagcagaagtattgcccagcaatactggcaatcttgccacagacatatctaaattatgtagaatgctgaattattgtaaatagtctttcaagaaaggctaaagcgaaagcatgtttcaaatggagttattcttgataagcgctatgattgcccttcattccttaataaaaatcatggccttgtccttatggagtgtcctaggtagggaggctctctgcctttctgtctctctctctctcatgcacacacatgtacacgcacacacacagacagagagagagagagagagcatattttctcaaaattgtattgcaaatagggagtaagatctaataaaaatcttttaatgtaaagtttggaagcgttctgttgaaatcccttaagtcaggtatacatatctagccaaataacctttttttttttttttttttttaaacagagtctcgctctgtcacccaggctggagtgcagtggtgtgatatcggctcactgcagcctccgcctcctgggttcacgccattctcctgcctcagcctcctgagtagctgggactacaggcgcccgccaccacgcccggctaattttttgtatttttagtagagacagggtttcactgtgttagccaggatggtctcgatctcctgacctcatgatctgcccgcctcggcctcccaaagtgctgggattacaggcgtgagccaacgcgcccggccataacctcaattcttgattgcaatagga

SEQ ID NO: 112778 - DNA, 1759 bp, Homo sapiens
tgtaatataaattgaaggaaaaacattatcatgcaaaagtaatgtatcgtagtctccctttccacagggagacccacagtgaatacctgaaaccatggatagtatgaaccctatataatgtttttttcttatgcatacatacctatgataaaatttaatatgtaaattaagcatagtaagagttaataataaactggaacaattataacaatatgctggcatcactattcttgtgctttgggaccattattaaataagataagggttacttgaacacaatcactaaattgcacggaagttagatacaatattttctttactgaaataaatgttcattgagcaaaataaattaactagtgattggagaccaagccaaatgaccttttccagcagtgagtggttcaaaatagaagagaggcagcaagattagttttacttttagaaaataatatacttcaatgatcttatccccaatttaggttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaagtcatctatagttgatatgttttatttcattggttaatttttacatggagaaaaccaaaatgatacttactgaactgtgtgtaattgttccttttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaatttgtcttaaaacattttgatactggtttggtgttgatatagttaaatggtaattagaattgattcagcatagctaatgaattcttgttcctacgaagttatagaacttaagggtccaaagttgagtgagtcttgaggtgtcttcaatctaatggataaactttgatcacatcctgttcatctcatagcaatagacttaaggctattacttcatcattgtgaaaagataaatgtcctttggaattagtccaacaattccagttgaacaagtgttgattttagtactttactatactcttagccttattgtcagcctacttttccttatatacttaaatactatgcttattcctgtgctttcattaataccctcatctggtacatgctttctatccagttctcacctgtttttccaaggtcagt

SEQ ID NO: 112779 - DNA, 1280 bp, Homo sapiens
cggcgtagcctcttccggagcgtttcttcctttaagtgcagatccgtcccacctcccaccccttactttccgatacaggacacggtgtgactggggtgggccccagtgtatgcgtatgtgtgtgtttttcttttttttttttaactgcgagagcaccctcaccctcccactcaaagtgattattgggcatgaggctggcagtagacaagactttgggaacccttgttttcgaacaggccagctgcacgttctaaaggaacctggcaggatttgggagggaaaggggaagataaaggcttgtctggagcacagtgactattcagtcagttgctaactcgaatgcaacagcctattttgacatcctctagcctcataatctgaatttggacttggattacaatgaggtgaaatttggcaataataagttgatacactttggctttttttttttgccacgtgaaagcaattatctgttttacttagaagcaagacttttaaggatttttaatgccactttgtacctactctgctttcagcaagatacacgtgtgttcagtcatttatagctgtatagcctaatgaaaatatagcaacatctaaatatattttattttccagagttatgcagggataatgaattttctgtaacatttcttttgcttgcagcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaaggtattttaatcattggaaacaatttgagtcttgcagattttctagcatcttaagcagtcatttttccgctctgcacatagaagtgtactgacatctcaaatatattttcaattgagaggaagaaaataatatataaaatggaagaaatacactcttcccccacccactacattgtgagtgggctgaatattttgatgttagaaatctgatatggctaaaaaaatagtcttcatcaactcccttagaagtggcttttgcagtaaatgtggccaaatggaacaggttggaattttacataattataatggtgttcactatctgagacaatatacactacatattctcaatataatgtattaattttctgtaactaattaattttctgtagtctaatgttatcattacattaagatcaaggaaattggattcaaccagagaactaaacttcaaaaagagaaaagattagc

SEQ ID NO: 112780 - DNA, 1045 bp, Homo sapiens
tcatgtcttttgcagtaacatggatgggactgggaaccttttttttttaggttaaatcactcagaaagtcaagtactgcacattctcacctagtaggagcgcaacaatgtggacacatggacatacagagtagagtagtagacactggagactcgaaaaggtgggagggtgggaggtgggtgtggaatgagtaattacctgttgggtacaatgtaccctatttaggtgatggttccactaaaagccccgacctcactgttacacaatatatccatgtaacaaaaatgcacttgtactacctgactctataaaaattaaaaaaaatacaatgaattaggaaacacagtaatttgtttttctcatttcagactgggatgcccagaggttttacatgcttaaggtgaggaactgaggccagagtcaccttgtcatagtcattgcgtggtgctttttggctaaagtacaaatgagtactatgtatgtgaaggagaagtattaggctatgatgtctctaatttttaaaatactattttgacaacctaattaataatattgggcttaattttaagggtaagtaatgtaattatattttcacatacctcagttttgctatagtagattaccaaatttgtatgcttcattttctacatccataaaatgggattcacaatatgcaataaatgaaaggttgtgataattcaatgtattaaatcatgtaaatgcataggactcttcatagcatatggaaaggacacaataaacataattattatttttgatcttagataaataaaatatgtgtgaacttaaatgcacaaaccacacatgcatgcacaaacacacaggcctgaacacaggcaagtagttactgaatgccaaataatcattaatgtaacaagtgcttggggttcaaaggaggcgtaatcctcaaaagcatgctgaaagaggtggtctctgcactgcattgaaggatatggagtatttcagtttcagtaatagagaaaagagaacagaggagagccatggataaatgtgtagaggtaaa

SEQ ID NO: 112781 - DNA, 1046 bp, Homo sapiens
aatcacaaggctttgcctttatggctgttagaattatggttcatagagtttgaacacattgatgacattcttctaatgttctcattctccatatgatatataaccacataagttatgtaaggaagagggaaatgttatttcatttaacttgtagtctatgcttgttttggatataataaattaagtcattatatttgtaggtagtcatttaagatatttgaaggcttataatttctaccattaagcaattagcctgtcattttttaactatggcactgggtaggaagttaatatgcataattttgtatattcagtagtaagtatacatttaacttttatctagccctaaaaagtagtctcaatgaatatatatctcttcctgagttcactttcaaacttttagaaagtgaaatcagaactgaactgacgataggtggaaaaggccttatttttagagtccgatggaagaaatatcacatactttaacttctcttttttcccatggccttcacacttggtttaattgaaacagtggcgacttttcataaaagactaatttgatgagtgaatctgatgaagtcaggtgtggtagggataacaggctttagagagttgtatttatatatgttgaatggaggctcttagaggagcaggtaagctgtagttaggagtttctaagatgatccaaacagtaatatttctcagaaaattccatttgaatctaatgcctactgatattttgtacacagccaatgcatcccctaactactattcagataaagtactcaaaatgaataatatcattcatctattatattgattgcctgaagacggacagctatgtttggtttaggaacacaaactatacaaataaaaaagtattaattagtaactaagcaccataaaattaatgcccattcaaatatcccttcttttgtagtaccaatagtggtgtcagacaacatctttgtcaatcggtgctttgaagattatcagctgcttatgctgtctaattatataattcagtttgctgatgactaaaagtg

SEQ ID NO: 112782 - DNA, 1049 bp, Homo sapiens
ctctatgtaatataaaattcttcatctccactgtttatgaactcacttaaaatgatcttttgttgggggcaaactaattatccttaaattcacttttgcacttttcctattttagcttatttcctaaagcatcattgagataaatattgagttagagaaataatatctcttcttgattaaaagatggcatattacatattctttataactcttcattttttcaatagaattatattttaatattaatattttattttaacacatagttttttgtcagttatttacttaattattttctaaatacttactgagcaccagctattgttggggtgctggccttacaacagtcaactagcacaatcctacttggctttttctcttcatgtccttgggaaaaattgcctggctgccctaacactatcagagaaatgatgggacactttaagttcctatccaactgtaacttcttttatcctgtgattgtcaaatatcacacatttaactctaataggaatccttttctaaaataggaagctgatgaaagttcaatatggcttcccattcacttagtgctcatttcctggataataggtagtaggttttttcctcttagatactgcgttttaatacatgaacctcaactgttcatgtgctatgttaaattttattgctcctagcagaccattatccaggagtattgctcttaagtaacttctcacctagttataagcattgtggcctcattacatggggaataaacatacttattccctaatggtcaagtcaagagaatggctgtttcaacaagtcaagcaaaggaattattgcattgtgttttgtgaaatctgctgtacagatttagaagactgaaatattttaatatcttggaaaaagaaattattttctttatattttaagttaggcatgtttattaagaaacattctgtgaacttgataaatatctcctccagcccattacatttagaaattaaaacaacgtgttatctggtgggatagattgggtttccttgatcttaactgatccagag

SEQ ID NO: 112783 - DNA, 1018 bp, Homo sapiens
acacacacagagtcataatcacaaacttcctatgttgcaaatgattagagactatagtgagagcaatgtggaatttttaactttcttcaaattcgtgtaacaggaatggtatgtgtaatttcttcagtcaatcaacagaagtggaagcctgagtataaactgatgaaggtatatttttgctaaatacttgcataccacttgttaaactaaatttggtctgaggctgcccccatacttttagttcctacatagccaactgcgacctagcttaagagtttagtcttgtaacaaatagcttgagtttcagccactcacagcagcagagcttcagccaatcacaggctggcaacccccaatcagaccatgtccatataaggcaaatatctcatcacgccatgcacaaataaggtaaacaccacgcggtggtgtttctgaatgtcattggctgtttctgaatgtcatttcctttttctgtttataaatactacctgcctgcagtgcttagtggagctcaataaactcccagttttgagagttgcccaatttataaatcattctttgctcaagctctgctcattttgttttgtgtaaagcttttaacaatcttttttactagtttttttctttaacctaaggaattaattacagataaagtggttttctttcagcttgaaataatatagcagaaagtcaaataacccattaatttctccaactttgggcaccagatggtataatccgtaatatttaactttatttaaaagatgaagaatcttttgaaataatctattgtagtttaaataataaaggactaaataaaattttttaaaaatataattactttgggggatattattttgtagaagatagcatgatgtcatttttaatcacaggacaaatttttctcttgctgtttatttaagtgaagagaaaattaatttataatccctttcatggcttttgttttcagtaatttgatttccattacatattgagatcagagatgctaaaagagctg

SEQ ID NO: 112784 - DNA, 1018 bp, Homo sapiens
ctaaaatatgccataggaagtgcaaattacctatttataaaaactaaattttgcctggtttatttaatttttttaatttttaatatatctatatctattataaaattattaaatcatgtattttctctttattacttatttttttaggatttatcagaaagcaatttttggttaaaatgctaagagaaaagataaaacaaaatttccacatgaaaaaagctaaagagtcaaacaaaaatttcctatttcacatctgtatagtatttatcttaacgctatttattttgtaaaatatgatattgtataataattatttttgaaagagccatgccttatgttgaattacatgaaaaattacatgacttttgtttaagtcaaaacaaccaagttccaacaatttcaaaatattcaacctttgtatgtatcagagcttcattttttctttttgtatttccgttgtgtagtagtatgggagtattgggaaatctttgacttctttggctcataatatttttcatgcacagcattttgtaaatttaagttaactaatggctaagaccatttatccactttatggcaatagttgtaccttatagggatttgcattaaacaatctattattattatggttttatgatgatttgtcctgaattttctcaaaggaaatatctattgaaagggagaaaaggaaaagacaatctgaaatttaggaaaatctcagaaaacaagagaaaaaaagatttatttgataatgcagtaaggtatgcatttataaatcttactagttcccaaaacaaaaatctatttctattgcatctttaaatagcaattttactgttttaaacaacacttagagtcaatcatagacattatgaaatggaaggcagatgtagaggtcactatttaagcaagttttacttgaccttttccaatctaatctgtctctattctatttctaataatctccagggatggatatttcagaacattttttagtaaaatgtttcaatgcttaaga

SEQ ID NO: 112785 - DNA, 1120 bp, Homo sapiens
ctgatgaaataattataattatttttgcaaaataataataaaaattctcatgcatttttcatggccacagagtcaagatcaaatgctatgagctttaaaagtttaaaagttctgtaaattatgttgaacacatacccttgtttaaaaataagggcaaagaaagttttcaaaatgacagttgtagggtaagaggtgcaatgaggtttaattttccttgagacatgcaagaggaaagttaataatttaggggaaaatattaaatgcactaagggagaaaaggtagaatttaaagaaaagtctcccacatttaaaggatttcaggagaagaaaactaatggaatgtttataagaatggctaaaaacattaattctaaactaccaaagaatgtttttcaaagttcataacataagctaaacttcgctgttcagagtctatattctggctaatgggataattaaaatgtcaacccaaaatgaatatatttcaattatagccgtgccctgtgcaattaaaaatgcctcacaggaaaataaacttattattattatgggggaatttttattagttaaggaatgcattatcagagttgattgaggtgatgtggtaatgtcaccttaattctcataaatcaaacaaggaatccggaaagtgaacttttaaaaacattttaaaatgttcagcctgaaggaaaatagataaaggcatattctattgctttagcaatcttagaatagtaattaccctcccaataggtgagtgagcaggaacatttagcagaccacaggagtttaatgcctataaaatggcctttcttaagtttaatagcagatgtgtagtgttggttacctcattttcactctcattaagtagaaagtatggcaacattaaatgattggaaactagtctccagatttttctttccttttcctcagtagatttatagataatatccattaaatttttaattagtacttacatataatataggaagaacagaaatattaaataaaaacatgcatatattgattcaagctggatttttatttctgatatgatgggcaaaatgtaactgtcatttcaatcatatttttaaggcagctgttaagcttgcatctgaaa

SEQ ID NO: 112786 - DNA, 1040 bp, Homo sapiens
atgctgctacttctgtgtcaaaattcattattattggattacccccttcttacccaattagggccctgagcctttctgagtttcttattgctgtgaatgtaaatcttctttcctccgtaaagaaagagggcaaggattttttgttttgttttgtttcagtgtaaggttttcccaagcctaacctcaattaaaactccagctttctttacagtatttttacaagccatttcctctctcattatatttttcatggtgttttcacattatttaacatgtcttatttcacaacggatatgattttgaagagtttcatgtcagtggaatttttctgaataacatcaaactttaaactccattttttttggtaacttggacagttgtgccttgcattttctgtgttaatatttttagttatggggctgtttaatgcatgttgagccaggtgggaatgtggcagagctcatatgaaataaacttgttaccttccttagttaaacaaagtgtatataataagaaatagaaaaaagaaatagtgtgtaataaatttctgcttatgatacttaaaacagcattagctttttatttcacaagtggtactaaactgaagggatcactgctgagaaatgtcttatgccatttatgttatagagagagatgccatctagaccgtaaagcattttgcttaaatagtttaatatgaaatggcaaatacattccattaggataagaaaggtattgttgccagggagttgtttcactggaaatgtttaaatccagcagctgggaaaagggaagggtgactcgggtacaaaggacaccgattaaatgcagtaacttattaattttctttgccaatagtgtgagtgttaaattttgtttataaattttgtttatttcagtataatatggttggtctttgggtcttttctaggtttgtgatttggcttttagcctgaagaaaatgctgattcgacacaagatgactcataatcccaatcgtcccctggcagaatgccagttttgccataagaagtttacaa

SEQ ID NO: 112787 - DNA, 1026 bp, Homo sapiens
tactctggctctcattcagcaagctgttggagtgttcccatctcatccctagtgtggagcttctaggacttccttaattcagacccattatcaatgatttcagcatcttgctcaacttcctttccgttttttccagcttgccattgctctcattttcccatggtaactgtgtaaatggacttgcactttgtatccctcccaccacagtggcaagctgaactgtctgagaacctttcttacattttcacagtggtttttatatatatttttaatggtgtcagccaggcaaatggaaaaagtagggtgagctcacatatctctgtttgaaatgagatattttagtaatagttggcccttgggagggaggatagactctgaacccagactgtctgggtttaaattctggaaacaccacctagttctttgaacctgggaaacctaggtaaccttttgtgtgttcattttcttctgtaaaatgggtttaatagtaatactaatatctacttaaaagcatgactgtgaggattgagcaagttaatatttagaaattgctaagagtggctcctggaacatggtgaaagttgtaagatagttaagcctaggccctgtgctggacactgggatgaaatagtagaagatgccatgtcctgccctcatagaactcacattcttgtagagtatagcattaaacaaatacatgagaccaggcatggtgactcatgcctatcatcccagcactttgggaggccgaggcaggaggatcgtttaagcccaggagttcaagaccaatctgggcaacatagcaagactccatgtttacaaaaaacaaaaataaaaaattagctggcatggcggcacacacttgtagtctcagctattcagaaggctgaggtgggaggattgcttgagcctaggaattcaaggctgcagtgagctatgatcagaccactgcactccagcctgggtgacagagagacaccgtgtctccagagaaaaacaaaaacaaaacaaaaaacaaaatacatg

SEQ ID NO: 112788 - DNA, 1459 bp, Homo sapiens
gagagagaagcatggagcaaagtgggaaaagccccttataaaaccatcagatcttgtgagaattcactcactatcatgagaacagcatgggggtaaccagccccatgattcaattacctcccatcaggtccttcccatgacatatggggattatgggaactacaattcaagatgaaatttgggtggggcacagccaaaccatatcagcatacctgtaaatttgctgcagtattctgtggatcccataacacacacctgaatatggaggactctgcattcattcattcactggcaattttggtggtctctttttgttgactgcaggagaagccgtacaagtgctcagagtgcagcaaggccttcagccagaagcgaggcctggatgagcacaagaggacgcacactggagaaaagccttttcagtgtgatgtgagtttggatttttttcccccatagtgtcttccaataacagaaagtaggggtgtgtgtgtgtgtgtatgtgtgtgtgtgtgtgtgtctgtgtgtgtgtgttgcattgctggaatgtgcctatgcctgttaatgtcttatgctatttatagcttgttcttgcataatacatgtaactgcattgtaatcattttattcatctggtttactggcagcaaataaattctgattttcttttagacatgcttgtaccctgttttaataccgttgagttgttcttccaaggtgtaaaagcatgatgatttgaggcagctttcatgtgtctggccaaatctttactgattaatgacagttaaaccagagatttgactggtcatacatattatttacttggttaaagccaagcatgtacaaaattccaaaatgcatataaactcctttgtgttaaataatgctgttactaagtgtctaggttttctgcttatgacatttggattgaaatggaattatttgacatagcatacattatttctgaaaggaaaaaaatactactgttgacagtaaaattaatctgaatattgatcaatttaggggaaaaaaaaccactgttcttttgtgcgggattggcagttgacagagaattgacacagatgttagggaatcaatgtaagaaaaaacattaaagctgtgctgtgtgatatggcacagtgcagaattctgcttaaatattgagggaaattccagaacttagatccatcatcatgtcccaatggatacagcatagggtaagcagtccatatgaaaggaaactcacaaacacaagatgttttccttgtccttccatgaaacttcagtggtaaggttaagacaacaatgtactcccagtgggcatactcataaaaatacctttattaacagtacacttcttttaaggaaagaaacagttgtagaggaagaaatgcacacatataaagctctatactgaacagagctacagccctagttcagtgatttcaattagtttaagtca

SEQ ID NO: 112789 - DNA, 1712 bp, Homo sapiens
ccctacccaaactagttaaatcagggtgagggtgggccctaggcatcaatgtttttaaaaagatccctaggtggtttaaatgtgcaggcagggttgaagtccactggactagaaattaggagaatattagggaaaagtttagtttcatcagttttgtctcacgattccaaatggactagtttgagtcaccctgcagccccaggaaaacaaggcttttgagctggtttggatgattctttgcatgctttatgccagataagctcttttaacacctctatgcaagtgacaggactttctggctgcccagccatttcatttatacacactattctgtgggcctcagagtggattaattaaaagggaccaggtgcctccttgtttctatttaaagactgtatgcaacactttaatataaaaattgtatcctattcactgtgcttgtttttagtgttctatgtgttgcttgtgcaattcattttcctaatttatagaagtgtgtttttcattagctacaatgcaaaaccaattatggatgtgttatatagaaacctgctttaaatattctcctagcttcctaagagttataatttttagatgcattgtttactaggccatgggtatgttttgtcatatgttgaaagatcacactggctataaaaataagacggtgaataaaaagccacaaaagctataaacatctgtaaaagaagttttctaagcaaggctgcttgttagagggaaactcaatgcattttgattgtatgcagctggtggcacatgcactttcagaaaggggcccattaagaggaactgttagatatatggcatgccgtactgtgggctgtagctctgttccctcagctgtgtgtaatagaaacccatggggccacacttgcaaaccctcctctaaatttcacccacgattctgttgcgaatttggtttatagaagcaagtagtcatcttttggtctcaaagcccatcatgctaaacgaagattactaatcttacctgactcctagaaaagtggaggactccgaaaatcacagcatgggtttcacagcctctgccatggtgaggagcacacatcagtctgacctctgatcagtggtcaggaccaccacaggcccctgtctgtagctctcttttattcttggaggatctgttgtgggattgccatatgaagtacagatgttggcccagttatacacataccctatcatataagagtacaagaagccctttactccagacacatgtgaacagcttggctatgctggggttggggagagaagggccaggttttgggaatctactgctcaccagtctgcgtttttgtggctcacagtgaggccagtccctggagcgctgggttgtctcaaagcaggcatacaagacagtttctgacttctgagatggttcaatgtttacatgatccatcttcctgatatcaaaaatagttcccctagatagagaaagacaaaacccctgatgcagaaggataatggcgatatttttaagttttagaatagcatgaaagcagcttttagaaaaacaaatttaactttttaggagaaaaatgtgaaatctacagaagcagagaataggataatgaatccccaagtagccccagcccagttcaacaagtattaatttttttttccatttataacttcctcactaccctagccataaaacttgaatttttatatgt

SEQ ID NO: 112790 - DNA, 2051 bp, Homo sapiens
ttgctctttcagctactccttctattcggtgaatgaatgtactccagtcaaatgttcactgtgccagtgtaagttaaaatgaacattttactggaatgtggtgtgcctgactgctttggatctattacatatatttggctttgtagaggcaacagagtgaagggactaaaattaacatgtgttttcagacatgtaagcagtctcccatgtcattgccaaaaaaatgacattccacctagaatatagtctttaacatgcgggacagtttatcaccaagaaatatatgactcaatggctgaattttaaatttttttaaatactgaattatgtttctactccccactggcagagcatgagttgagttttccacatctgtcccattaggagccattgccaatgctgtggctgctgcatgctaagtgtctgttccttttcttgcaatactaggctcaaagccccagaggcttctatcactctccatcccacccccatttgtgtcttcaagtgcccagtgtatcttctttcatccctgcctggagagaggccctttggagattgtttgtggacattctttgaggggagagaaatgtgtactcactgaattctctctgagcattcaggcttagtttctttatgtacaaaataagaattatgttaatcgaatcttcttctgggtgtgttatttatgttgacttgacatagaggatacctggctattagtagaaaaacaactgcaactgcaattgtaaaaggagagagaacaaagtactgggagattgtgctggcagttcttttcttacaggttaacattctctgaaggcaccagtgtgtctaaaccaaataaccaatgtaaagaattacagcaaaacaaaatcatctaagcatgcaaaggaatgattcagcactgagatccgtgagtccatgaggctctctatgtctttggatataattaaaacaaggaaattacctcaattcagccttgttttacctaatatattctgagaatgggttggatgatttcttagtaacctagacagcttataagtagctctctctgtaaaaatattttttcttaaaataacaaaatatcatcctcttgagggagaaagcattttgtttggcctgaggcaaaacttggcacttcagtccaaagcactgcccttctccctccctagcccaaccctccatccctgcccctgtagcactctaccttgtgcccactcgggtgagcagccactcttcgcagtggggcagtgtgtgatgggaaagggctagctagaggtcttgacagtacttttccttggtaactaagcttgttctgccagtgggatgctagactgtgactatttagatacgagatgagagatcagggcataggaagaaggggagattgtgttagcagaattcttcttatctagtacgttgccctgtgacagctgggtggatttacaggctgacacatacagtgtgtctcctagatagtatctaaatggaccattacaatgagctgtgattcctgaattcagatgatgctgtttaatatagaaacggagttggcattttcttgttcttaacatgagctttctggtttgcaccaaatggaggggttacccagggtgtaggattttcagggctaaaaccaggctagtcctgggcaaaaagggatggttcatcactctttccatggtttttgaaataagttaatgggtgttctttctcaaggaacacactgaactgaaaacagccaaaagctagtaggtaaaaagtcaccaaggcctattaggaaaaaaagtgaaatgtgatctgtttctggttactactgatgacagtagggtcattttattttggaggtaggagtggtgttttgcagaggtgtgaagtatatatctgcctgatgaagtctgtgtagcatcatcagatattacaaaagttttcacaaacacccatttgtgaaagaagattgaactcaaatttgcttacagaaaaaaaaaaaacaactgtatatcagatgaaaagtgtaaatagtaaagatgctaattttctaagtaaaa

SEQ ID NO: 112791 - DNA, 1004 bp, Homo sapiens
tgaaataataattgtctggaatcaaatcagaaaaaaatatatatatgtatatatacacacacacatacatacatcatttagtttcctatgtcattatgtgttcaagattataaatggaaataataggaaacagaagtgggaacaatttcccaaatacattttcatcaccaaatgctatttatttatactgtaatgacatatcagacagatggattattaaggtttttcctgtcttttataaatctctgatttacagtgattatgatggtgctgattgcttgtggccttgatactagattctaacagatgaatagggtagacaactgatctgagatttgttgtctagaaaacctgaagcaggaggaaagggcaagagggtctggggactggcaatgagaccggaagcctttcaccccggggtcagcagttgggccaggctaagctgtgagtgatataaaccactcatctaaggaccagctgtgatcatgacagaaaactgacagtgatctgatgttcttcactggtactttctctctctctcttttttttttttttcttactgagatggagtctcactctgtcacccaggttggagtgcagtggcgtgatcttggctcactgcaacctccacctcccgggttcaagcgattcccctgcctcagcctcctaagtagctgggattacagacgtgagccactgtccagctaatttttttgtatttttagtacagtcggggtttcaccgtgttggccaggctagtctcgaactcctgaactcaagtgatccacccgcctcagccgcccaaagtgttgggattacatgcgtgagccaccgtgcctggcccttcactggtactttcaaaatgcaaaatacttttctgcttcagcaaaaagtggtagacatttggagatgcttgttaagctttagtaccactcttgaggcccactgagtgcctggtgatccagtcttgcagcactggacttgacccaagtctcaaatattct

SEQ ID NO: 112792 - DNA, 1020 bp, Homo sapiens
ggaagtctgaattggatcagaaagtatgagtctgagttttctaggaaaaggaacaagattgggggtagggcattgcaaaccaactgagtgtcgtgtgcaaggatgtgaagctgtgatttgtgggtgggtgagaagcccactgtaggagagagcccaaggtgtgcgttgttgagaactggagcatgaggtgggggtcaggcaggcatggcaagactgtgaggagtcccaggtgctgggacaggaagataggattgattgtgttgataacagtaagtcagaacaggctttcatttgtttcccagtgagagaatggagtaataaaatgaacaataagactaggtgttccctctttactgaaacacaaacctatgaaataaagaaaatattcagtccaagcagctctgtctatcccttgaacttacctatttttctttcatatcttttttcttttatatcacacaaatggtcttgtaggttgagactagtaaaactataacaattgctaaggctgtaggtatttgctattactagctagaacaaaatacaatgcacaacatttctaaaatgtcttcattatttgtgacctattttgagtgcagtctagagtcacagaatatcccagctgcaaagcatataagaggtcagttgatccaacccctttatttaaaaatgagggaatttaagtcaaaatatcgtaaagactgggtatagctagttatagcaggaatatttctctctctgcaagcacttcgatgacattatctttcctcaaattcatttggtcatgaaattaaagggaaactgaataacaggttaggttagagagcaggagtattataccattttttagtttttatagttttttatttttagtaatatgttatataaaattattacctgtttaaaaaattttattgtgaagtaacctgttgtattgtcctgaggtaacaacctcagagatcagttattttcaagcaatacatctgatttcaagagataagttacaatgaatataaaatt

SEQ ID NO: 112793 - DNA, 1034 bp, Homo sapiens
agccctttccagtgggcttttcctagtctccatttggtctccctctttctcccactgctttagagcaaggaataaaacatctgtggttaaaatcaaaagactgtatctcccatccagcctccagacctggcaggagaaatctcagcattttaagtgaacagcttttttttttatgccccagtagggtacagtagcacaaaggccagtgtcctgtaagtgcctccttttctgtctatcacataactctcagggactgttaccacagctggaatcagtgttttaactgaggtattggagacacttatgagctcattatcatttgaacatatgaataatgtaaaatttagacagagtttcatttgaaaggattatttaaggaacttttagtttacagattgatttatattgctgttattctgaacagtaggaataaaatcagttccctgtagtgtaagttggatgacaccatggtgacacagggcctttcttgattatctcacataatgtcaaaaattaaaagcaaaagaattgatcttagggaattccatgacagtttctatttaacttcacttaacaatgacttcaaacagttgttacatgtatagagaactcctgattaaagggactttctttgaccaatgtgttatgtttctaattgtaactctttaagaacatgcatttggtctcagatggccaactaactgttacagagtcagcttctgtgctatgtgccgtgtactgaaggaacagttaagaaaaggctgcagcccttgcagagtctgggggagaagacaacgagataaagcatggcaaagaccacgctgaaagtatcccagggtgctgtatgtgcacataggaagatcacttacctcagcataggaggagggctaggcaaggaaaggtgtcggaagaaacagaggagcgtttagtctgcagaagtagaaaatacactggagacatctatgtggaatggaaaaaaaagtggctaagccccagaatattgtccaaaaggaaaccaggaaggagcagccaaa

SEQ ID NO: 112794 - DNA, 1817 bp, Homo sapiens
tgatgaaccatgtgagtgagtgtaagcatgatgttgaaggaaaaagaaaaaggttcattctatttgaattaagatgttaaggcaggaggagtgagggctgctgtatgctaaagggagcaaaaggcaagaataattttcctagctccagaagcatcgtatagaggatatgcagcgttggttgagaacagaaaggagtcttttaagggtgagaatcatcttgaaatcctcatggacacattaggaggcatgcataaaaagcttaggaaacagatgcaaaagcaagttggttgaatcggattgggagggctggtggattccaggactagagatagaggatgatatttgagttgtgtttgaaggagtatggtagagggcaggccagaaaaaaatgtgactgcataagcaaagtgcacacctacagatacagtaagggtggcctgtccactgtaactgagtttgaggatacatgttgaaggatgacttatgttgagacaggctgagattgagcagttggtatgaattgtgaaaacattttattgtgtgtgtttggtttggttttgagtagaggagtgacattatcagttctatctcttagaaaggttgctctgaatcattctccagcaagaattgaaggaagtagcacttgagtcagggaggcccattcaggagacacgatggagccaggtgagcaggaatagggacccacatgagatggccatgggatctgagagtcaggcacatatatgagggacacctttgagataagtattgacaaagtttggacaaggtttagacatactcagtataggtggtgaagaatagggaggagtcacagatgaatctaggacgcctaccaggggcattttgggatattgtgattttccacatagagacaggaagagcagcttgtgggtttagagaggaaggaggggaggagcggatactggattcacaattatctgggttaagtgcctgaggagtgctaatagctatttctgtttttatgtctggataagaagaagagatgtacaaatttaataacttttaagaatagtttattatgaatatggagaaaatttaacatttttagaatttctaaacttcatcagcttttgtcctataggaacaagagaatatgcctcattgtcactgtttgaaaatatcgttaattcgattttggaattagtgaatcttttattgtttctagaacccatatatttcttggggaattttatatgccttgccaaggaatcatttaagataaatgacttcaaaataccgttgtattttatttggctccaaatatatacctgcatgaaattgagcattcttattctatcacaataaggcattttcttttgtaaaagggaaaatcagaccacttgaaaaatcactttcctttcagagaccgacagcatcattaccccctttctttttcttcatttctcctttgtgaaaattctttctgatggtcatcaacccacttggcagagtgccctctattcttaatctctgtgtaacttctgcccatgagccagtcagctatcttaaatatcaccagaaaagaaagttttaaatttcccagttaggaatacttttttggcataccaaatgatgctcctgaaataaggactttgggtccaggcatgctagatcatggttctctggattttgataggctttgagagtaaaaggtgaaattttaaagtaagcttgatttcattctcttgacaaattttttgggttggttaattatcccataggaaaatagacaaaagtctttgtggaacaaaattctgttttactatagttaaggt

SEQ ID NO: 112795 - DNA, 1024 bp, Homo sapiens
cagccttaactgagtcaaattcatttatatgaaacaaaaaaattaaacagaacaaggtgtcaatgaatcagttaaataattcccctttaaagagtagtacagtgatagagcaaattgattaacataaaatatttttaacaaattcttaaaatgaggagatttaatttggtctcaagtattaaaaggaatatgcagcaaatatgctactggcaaatgtttatttttgagtatcggaagtgctctgggctcagtgccctctccacaggaggggaggccacagtccactgctgtcctgcacgacccatgcttggatctgccctgctgtgcctggagccacttcttgaagtagcacagggcatatgcggtggccaggatctgagtgtgtgagaagtgatagcacaggactggttctgctacttcatgtttttctgacatggaggcttcctttatttgtaggtgagcgtccctatcaatgtccttactgtgaaaaaggattcagtaaaaatgatggactgaagatgcacattcgtactcacaccagggtaagattatattctgtttcattaatattgatcatgaaaaccatacttattttaaaagaaatatatttaactttatattacaaaataaaggcaatacactggaagttgtatatctatatttatgacagatatttcaggataattttttttaaagataaaacaatgaaagaaaagaagaaaaaaaacacaaattgaaacctcaaaaaggtttttattctttgaatcaggactcaattttcaggagttataaatgatgaacttcaagataaatagattttaaaattttaatactacaatatttaaaggtttttcttgcagaatattcaccagtaataggaacattttttaatagagtctgcaagtttgtcagcatttggccattaagtaatactgatgagcaagtatatttgcaagaaagacattgcagataaattaccaggacaggtggaaaataaggaagtgtagctcagtgcttcacaggg

SEQ ID NO: 112796 - DNA, 1030 bp, Homo sapiens
tgaaaggaaatagtaacctggtatattatattaggattaacatataattatttacctgataactgcaaatcttttgtttttgtttgctggactctgttggtatttggagaacaaaaccagacgtaaagctatgtgatacaaagagaatagctatgaatattgaattatcttaggcttgctagaaaaataattttacgtaagtgtaaaataacatgttactattcttatcatgctttatccctaatatagatttgatatgttgatggatttcattgttaataaataagaaggaaacattttagccttgtttattatctatcactaaagtaaaataaactttgaaaatctaaaaaatgactttttatactttatgaagaagaaaatgaaaaaattatctggaattgtgtgatgcaggagctaccaccatttagcagtcacattctgctatgttttcttcctgtccttttcctttgtggttcaaggttaaatgattaagatctcagtaaatgatagctcctgctgtactcctactattgctgctgatgctgttactgctattactataatgttcttttttatcatcatcctgaaatagaaaaattctagatatatcagagaagcaaaatcattatgacttagagtctggatggagggagaagtgagtaaaaaagtgtggggttatcttggatggctcccaagtttttaatttgctaactaggtgaatgtggtacaactaatcaggacaggatttatagcatgcataagaccaaaggataaataccgcaaattcaaaacaatgcacactgatttaagctgtttgtgagatacccaaaggagggtacctgttagacatatgtgtacatggagattggggctcaatagagatctggaattctgataagcatgtgttatcaactcagggttaaaataagatgatcttttcctagatgttgccaagcctttgtcctactgacttggaaaagccacaccttcccagagtcacgatgatcctaaggtcaataattctagg

SEQ ID NO: 112797 - DNA, 1004 bp, Homo sapiens
ggtggggtttcatggctctttttgctgcggggaaaaaaagtatttcaattacagaaagatgccaagaatgaacttgagctactcctatttgtcagtgtagcatttcacttctctctatggtgtacttctaatttattagaaactccataaattgaagggattggaagggtgagattggaaaagtaattgggtggtgctttcacaattacatttttggtttaattttcacctagaatgattcagtttgctgttttgtaaccatttcctagtctacaaaagcaaaataagccagtcccctgatattcatggaaaaaaatgtaaagttcttctaaagaattcccatataatacatatattttaaagttcaaccatgtggaacgatatcaggtatttttcatgaaacatacacttttgaggtttgctttttcacttgaaagtgttgccatctctaaaactgatttttgttagaaaactcaaagtaagaagtaaagctatgcttccaaaatctttaaacattatttaatttggattcattgaaaataaatgagtttgactttattccattttaaattacattttctgtgtgtacatcttttcatattttcaaggaattatgagttctttgaaatctacgttggtttttgaaatatattaaatgacaagttaacgttattaaaatgcttattgaaaatggtctttttatattaatccagataattaaatatatgtatattacatattaagctttgctgcttgtttataaaatgttcaaagcatagggcacattggctgtacacttttttaaaaaattgtggtaatatatacatgacacataatttatcatcttcaaaattttgcattttttaatcttcaagtttgatcatggtcattattaacatattaattcagtgtatttagtagcatgaacaaaaatttgatttctgtgcctctgctagagtggtcaggttcacttcttaaattagatccatgttctaatttaagat

SEQ ID NO: 112798 - DNA, 1099 bp, Homo sapiens
attattagataatagcatacctctattaaacttgcatcaccaacatttttcctttggaaaataaaaggagatttgatttcccctaatttgtgctttcttctgctgttgctaccatttttccaccaagaataactctctgtgttgtttttctgcaaatcggcactatgcttctaggctggggaaggttttatatcttctctagctgttttttttttttaatcttctctagttttatgggagagacaataattttatgggtttcttgctactcaacgttatatactcttgatacttccttgctggcactatttataggaaactcctctttgtgcaggcacctaaggtttaactgcttagttactccatgaccacggttcaccaactatactcataaatattgggttaaataaaactttggtagaaattcctaaaaatagaaaactactgggtgaaatgattaataattttctcaccaaattctgactccctaacaacaaaaccacatcaatgataaagaacatttcttccttgacttaaattgttccctaccatagcagtgtggaacactcatggaagagtttttgtttgtggatgggaaccttgaaaacttggccagtgtctggattgttcagatctttctgctgtttgtggaacagtccccttgcttttgccagcactcacatcaagaccctttattgtctgtcgtcttgctcccttagacaagtcacatgtaatgagggtaatttatgctcctggttggctgaagcaagagcatcctgagtagggaatcttttacttttgcttcattaactcacctcttttcattctgcatctcgtattcttttttaaaaaaatttgcatcagtaaaattcactttttgtttcaccctcagtaaatccacccaatctggctttttatgatttccgactgaaaagttcgtgagcacgtggctgtcctgtttttttccttcttcccaatgaacctcatgtcctttgagttggcatctcttcagaaatgagggagggatactgtaactgtaagattcttaaggaaaataaagcatcgtttaaagaaatagattttgaaaaccagactccat

SEQ ID NO: 112799 - DNA, 1208 bp, Homo sapiens
acaggtattcatactcccttgatacactgtttgaccctctattcccagtgtcattatgcttatcttttcataaactttagctacagaatatagatcatctatagaatgtagatgaggatttgctgtcaaacagggctggtttagggtgagtgaatgtgcatgtacagtgtgttgctgtcatcttcattgaaggggaatgttcaggattgtgcctggcgggcagctctgtaatttatcatccggcttcctatgctgaaacaacagagatggcactctgtgggtcagctgaaatagtagagcacagtctcctgttggtttatagcttcttagggtcagtgagagctgaggttaattcagcaagggaatccacggactgtgacatgaattccatcagttgttcataaattatggaagaaattctaggaactgcttttgggtttttaaagctctgggccagaaggttaattacttgcctacagttccaaccagctttctgtgttaatagataccgactgtgtaggcccttctgttctaggcttgcttacacattgttatttgaatatagtaataaatcactgtcttaggaaacatgtaattttttggataaatacctgtgatcagcttagatataaaaaatcagtatattattatttgatcgtatttggattttagccactgtttttctttttccttgaatgcttttttaaaggaaataatttattctttttagaatatttgtccaacattataaaaacaatagctttaaataattataagtaattatagagcaataataaaattattaaaaaattagatgattactgaattataaacacaaacgaaaatgtaaacattttaaaacaacattttagcacatttttaataagaattagatgacctccatatgttgagagagaacttattttgctatatttattttctgtctcattactaacattaaaccaaatcaaatattctcttacctgcagataatctaagagttaacagaaacgttgagtagaattgacatagaaataaatgatttccttagcatcacacttcaaaagcttcaggttttccccaagaaatgtttgaatggaattttcttataagcaaagtcttgaactgcatgtttttagatgtctcagtgttatgttgacactttaaataatttcagatccacaaccacatcaatggaatgtaccctt

SEQ ID NO: 112800 - DNA, 1051 bp, Homo sapiens
ttctccagtctccaattacgtgttactttctccttgacgtgttccctgacctgtcccctacccctgccttgttaggtcagcatatccatgctcctttaccctcctcagcactgcccacttctgattgcctgcacctgtggccatcttcagtagtctgtgggtcctcagttttcttagggccatgcccataactgataccttactttttaccattcagcacactgcctggcttagaaagagaacttgtgaatgcttattcaatagataaaataacttacaagtgggttgcattacctgtatgatagtaaaaaggatgcatgggttcagagtgagaagttccagatttgaatacaaatttagttgaccataaaattattttttcacatactacatacaaaaatccgtaacattcactttgagaagtgctggcattaaagaagaaaatgctacacttcccaatctatgagctggacccacccatatttgcttccctttccattttttatcctgttgctttgtcatgtaattggtgggaaaacaaactgtataacaaatgatcattaataacatggttcaagatctaactcactagtgcctataaacttacagtgcttaaatgagggaataaagaacaacatgtggtcaaccagcaccaaacttactgtttgatttcagcttggagtttcctagtttttaaagtttctcattagaaagaacgtagaggaaattggtcctgacaaatgctctatctgttttgtttgacaagggtgagtctgtgctattggagctggaataattacaaacaattatgtagtacattatagtcttttgcagttgtgtagcaaatctcatctagtagagatctgggggctctcattgtttattatatataaatacctattttcagctatattacactgtactttgcttatcagtttcccatgactagattctaagctgaaggacagggcagatcagactcacctctttaatctttaaatttgttgaaagaggaacgttctctcaaatatagtatctaaattaatccttt

SEQ ID NO: 112801 - DNA, 1062 bp, Homo sapiens
tagttcatagtagatggccagttcattgtcataagtataatttctaaaattcttctataatatcactccttgttaagagtacttttccaaagttaaatgaattgtgtttattaatataccgtggcaagcctttactgaatgacataacctcctatattattttctacttttcttcttacgtttatttacaggacatcatattgagaattttcatgttcaatacctttcccttttatttcttccagctttatcaagatcttaaattgttgaacgtgttgaaattttcataacttagtttcgtagatataatcttggttgactattgataaggaattaatatcatggtgtttggcatacttaaaatcatggaattttcttaatatattaatttggggaaaatgcattttagatggctatgtttctgattaactaagactttttttaaaagaaggctaagcattctttttaatacatgtttaaatgataactcagttgaaaaaatatttttggtggtatttaaaattctgaactgtgtatgtcccaccaattttttccttgaaattaaatcatagtaacctccaaaatacgcttaataaattgttctccttgccatataaaacttatcctaggcttttaatatttacactgccttatttattaggcataaatccaaagtatgcttgattcctaagtctgaagagaggttgcgggcaataatgtttgttttataaaaagaacattgttatgtcccttgaaaaactgtttataatggcaaaaaattggaaaagatcctacatatttaacattaaaagaactcataattcatggtatatccataaattggaatattatataggtaacaaaagtgatatggatatatactaaataacatgaaaagaaatgagaaagatgttacaaaaacagaaggatatatttttgtaagaataaagcatttgtatttaaataattgaaaagttatctactaaattattaactgcttttatttctatatgttataaatatgtttggttttaattttctttatgattttctgttttctaa

SEQ ID NO: 112802 - DNA, 1816 bp, Homo sapiens
ttcctaaagatccccttcttttcttagcacttcctgtgtaatttctccaatgaaagaaagctgtgccctagtgaagggtgaatgaacaactaaatatacttcaaaaaccttgtctggattctacctatcacatagataagcccttgaaaaagacttgaaagaatactattaatattgatagccagatgattttacattagtctgaaaacttttttcagtacctagactctaattacatggataactatgtgactggattatacagctgaagcttcctcttcaagggccgtagtatatgactttctttacctttgtatccccagtacctagctcaatgtctagcacaataactgtattgtcaatggagaaatgttaaagtaggccaaagaatcaatacagtgaatattagatataggtggaggaagggacacccttggagcataatttttaattttctgactaaaacttaaagacatatggtcagcttagtatttgttatcttagaataggtacttaaatacttttaaatgaaacacataaccaagaacagatagctgtggaataatgggtgctctaaagaagaaaaggaagatttttcttaattagaagtcatctagagaaagtgaggcttttaggatcaagtgttgcagaagcagagagccccaaaatgaaaagcagagggcagcacatgggaatgagaagcagagaaccatgttgagggcaggtgtacttaaaattgtgccaacggccggtggcaccaggtactgatggtacataagtaaggaactaatgaagagggaacagaaagttttgaagttcctggctagcactgcagtctagtggtgtaatctttgatgtcactgggcagccctcttttatgtgtatttgtggctgtatggagttaggatggagtaagggcaagggtgaaatcaacagcccttcactctgatatcagtaattcttagaagatatctttgtgccatacttagacttagtttgcttagcagatatcatgctgtattagtgtgcatgtacatataatttgtgtatgagaggagggcaagtagagaataggaaacatgtattatatgtacatatcagaatagtcagtttatggtaatgccccaagacatgatgtaattgtgttatgtttggtatagtgtgtttttaaaaggtagggacttacattgttcagaatgcattaagacatagctaccagcacagaaaagatgaacccaatccagtagaacccttgattattcaaaataattccatccttgaggatattgtatgcctacattttattttactcatagtatggctaggcagtggagaagaataaagcacttacactagtaattgcttctaaaattttaattagtattatcctccataaaattacaataataagaggatttttagagttccaagaattctctctgataaaattattaaatatatgtcatggtttttgttgtcttatgttctatattatgtataatttaaagtgtattctacactccaaatcactttatgtatcatttggttatttattgtatacacgagtctgggccaaattgttgtacagattctggcctattaaatttggcttctgatcaagagaactggttatctaaattcagacagcagtggtaaggcacaatgaactaacacatacaatttgattgatagataaagaaattatatatatatgtgtttgtgtatatatatatacacatatacatatacacacacatatatacatatacatatacacacacatatatacatatacatatatatacatatacatata

SEQ ID NO: 112803 - DNA, 1026 bp, Homo sapiens
atgttgggagcaaaactggtctcctaatgagactgtagggccagtttaaaatgctctgtctccctcctcttttggggaggggtcactcctttctctttgaactctccagcatttatcgaaacttgcttttaactatacttattcacctttcctcatgtgattgtttatgcctagattaaaggcatgttgagggcagaaatatgctttcaaattgactgctcagttaccacctggtgattttaaaggtcaaatcagatttatattcctttttgctttgcagtaaaaccagtctagtcaaacatcataacacaagtaatagatgactttattaagattaattctgtcctcaagagttaaatatacacaaagaatgtgaaaaatgcttcaaatgaagtgtttcttggcagctgggaagggtagctatagccctattttgattatgtgcttttgctagaatatactggtttgtataatttaatcatttttagttggggctccatgagggcttaaaaaagtaaactgcagaatgattttgaaattaacactaatgcatgattctaaggcacatttttttgagccagtgggaatatccatcataaattgtttaaaatctcattgtgaaattaaatcattttaatgaaatgtaatcctacaaaataaggatttactattgtcagaggcatttaatcatctttacctaattctttgtatttatccttagcctttttatccctttccttttagacacatacaggagaaaaggagaaaatctgtccatattgtggccagaaatttgccagcagtggtacactcagagttcatatccggagccacacaggtatggagattgtaattagactagtgaaaaaaccacttagagaaatcacatgcttccaagacaggaaatattgtaataatacaaatatcttccagattaagaattaatcttggctgttttctctctcttaaagcattgtacaacccagttttttcatctagaagaatttggaatgagtatattttctt

SEQ ID NO: 112804 - DNA, 1032 bp, Homo sapiens
tagaagtacatacttttaaaaaatgttcatggtaactttgagaattctgctaattcagtccccacgttttccagttgagaagactgaagatgtaagatgaaaggacttctgcctagtcacacagtgaattagcaaataatggaactggaatttgttgtaaaaaataaaaagttaacattcttagagctacaaagccaacattttggagaaagcaactaagtctggcatacatgggaggaaattaataggaccctgctattgcttcttaaatgtttctctttgtttctaaggtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaagtaagtggaagtcttctgttagtttgaacagattacgtgtttaagcagtatgggtatatatgttaactaacatgtgataattatatattaatctatcaaaatatttactcaaaatgacaaatgcatgatttatatcagctcttcagacaatgttcactttcttcatctttcaggatagacctatttttttccatgaatgagaacctgagttagatgtagactcttcataacccatagctttgctgatagatggcttctaaaaagtactcaatgagcaggagcttatcaatttttatatatttttgaattaatgtaggctgtttctttctaagaaatatgagtagtactttaataattttatatttcaaagtgaattcttatgtttattggcaagttaatagactgaacccttttgttattgggataggctttgatctttacctctctagagcatagggaagtttctggtacagaatggggactcgataaatacttgcttaactcaaagaaaatgttcatatagtgatttggagatttttttgtgtgtgtcttatgctacttgggtcattacctcaagggaa

SEQ ID NO: 112805 - DNA, 1051 bp, Homo sapiens
cttggagaattttcctctggtcaagtgtttaaaatgccaaataataaagatactaagatttcttaaaataagtattgagtggtaatgattctgatgaaatgcaatctgcttcctgtaaaaaaaggcagtgttatgctctcaggtcattctgcattcagcttacaggtctaaagaagttattagcacaacttaccagttttcttattaaaaagaattatgtgtttaaaaataaaatttgttgtgcaattgcaggaatttctattatagttcattaccagtttgatttagaaaaataactgttatgagatgaatgaatgttagaatagagatttggacaagtaaacctcattcatactattgaaatatggctaaatttgacttgatgcttgggaaattttgcttgggaatgatgaaattttatttctaataacagcaaggaattcttaacagaagtaatctaccacctttgctttcagtttttttgttctcattcacttgagaaataggattaaagtgactatgtgtagactgtgctgtggagtatgtatttaatatgatgttgatcagcacattaatcacaggctttatgaagatgcatcgtgacatttggccaggaaaatcaactttgataactgagtgagtaaatgagttattttagggaaataaagttagatatcagttagtgaaaagaatgggaaaaccagaaatggctaaaatagggaggacaaaatactacgtcttatgcaatatgaaaattaaaacccatttatttaactttaaaatatgaaagctgttgttagaaacttacatcagctttctggctcaaaatgtgaagaataacttgtaatgattttggaaattgttgctatttcccaatatgttgaaaaccaaaaggcaagttgctggctagcttgtaggtactaagatagggaaaaaatctgataaatttaacacaaagaaatctgcaattaaagtatgaaagaaggaaggtaagaacttccttgctatagcttgatgagattttgtacagggaccaacatttttattcact

SEQ ID NO: 112806 - DNA, 1059 bp, Homo sapiens
atgggtttatactggtgtgtaatgtaaaagaggtggagtgagcagtgtttgctgttttgttttggttttgtttttgaattttagatctagttagtggcttttcattgtttcttgtttgtcagtatatttttgtttcttatgtacctgggtgcttaatattgtttgggaaatctatgctgtttgaccttcccaagttaccgcaactttttgagccttagttttatcatttgtaaactggagtcagtaatagtgttttattaatccagttactgttgtaattaagtgaaatgatttatgtaaagtgtttagaatagcatttgacacaaattaaatatttaatgaatgttaattagggttaattataacatgaataagtgctctagtgtaatttaggggaaaagcagcacctaggactagaattatttgaactgattcagtgaagttgagagaaaagggtgaaaacaatttctcttttaataatttcttttatctgtgttgcaaatgttgtaccagcagagtaaaagcctggccagtgataggggaggcttagttttcagagaaagtacgcacagtttcactacaaagtaggccctgagaaatctcagtgtgtattcagattagcagtttgagataataggaatattttttttttactatttatcaagttaataattactgtgagcattcaaaagttatttttcctcttgcaaacacagcacatttgtctttacaattttacggtggaagaatggcactagaagaaacagatactgtccaccttcccttctttcctctttcgcatcatgaatccaagctccactcgttcattgtaatgactggttgattctagatcctcctgactcagtgtttttcctctgcagacccactctgaggagagaccgttccaatgtgaagaatgtaaagctttgttccggaccccattttctttacagagacacctgctaatacataacagtaagtcacgattcaggcagttgagaatataaggaattatctcatactttgtttttataacctttgagaatgtagacatcccag

SEQ ID NO: 112807 - DNA, 2420 bp, Homo sapiens
acattggcatccttcttgacaaaagtatttattcacctggctatgcacagacatcttactacttaaaatatgtcattggctttaggccaatatctagatgttgtggctttggttgaacatagttaaaaggcattatgctgtcccaggttctttcataattaagcaacttaagtcatgttccttaagtcatgttatgtcccaaatttggaaagagaaaaaatgaattagggaggaatatagtatttttagaagatgggagcaatcctgtgttccaacctggatgctctaaaaacaaaatagtttctacctttttatgataatgctgtctacttattgttttgtagaaaatctaagtagcaaagaaaggtataaagaagaaagcaaacattctgtcaaatatcactgtctttcctttaaaaaccctcctcaatgttttgtagaatgtcttcctggactccattctgtgtgcatatatgtatgcggcttaaatggtattctttatattatgttttgcattctgcttttgtcacctaaagtatgatatgcatgacttttcatatctaagaaaataaatatagaattataatatctactacagtttagttaaccaggtttatatctttttatgggcatttaggaattttccttttatttaaaaaaaagtagtttttgcaaaaatttgtcagttgtatttctgtaaagggaattggttagtcaagggatgtgcacatttgtcattttggtacatagaaccacattgttatgcagaaaatttttattcccaattacagtatgtgggattgcctgtttttactctttagtcaacactgaatggtatccatcatcttcatctttggcagtctgattaatcacagatagtatctttatttttaatttttcattcctttatcatattcatggctttaaatattgataccatatgtaatctgacatctccatcttataccttattatccagacttgaaatattcaagtacctgtagtgctagacatctcgtaatatttatttgaacttgccccaaattgaacccctgatgttttactcagacttgtttcttgctgctcttctgcatatctgttagtggctaatccatcattgcattgctcagatcacaaatcttggagtcatgcttgcctccttctttttgtgtctcatgcttcatatccaggtactttctcaaaacctgttcactttcagaagatatttagaactctactacttctcttcacatctgtggctaccaacctggataagctctaattatctctctcctgctgcattgctgttgcttctccactttgtgttttcccctacattttgttgtcaacacagccatcaaggcatcctgttaaatgtcaggtgaattgtgtccctcatctgctcaaaatcctgcagaaagttacatctctcttagaataaaagacaaaattcctgcactggccagtcaggccgtacacgatttgcttctcctcctcacttctcccattcttctgactgcatctctccacttctctgcccatttcacatggctccaaccacactggcttccgtgatgtttcttgactaggtcacccgaatacccacccttgctccttcatatccatcagatcttatctcataggtcaccttctcagctagaattttcttgaccacctatttaaaattgctaccccattctctgaaatgtttgttatcttctttcttgctttatttttctccatcacatttatcccttcctaatatagtacatactttttcatttgtttattgtccttctcctctgctagtgtaaaagcttcgtgatagcagggacattgtcttttggttcatggctataggctcagcatctaaaataggacttgctagtagaggcatgaaacgcatagcgtagacctggcataaaataaaacgatgaatgaaattttaggagtgctatttggaagggagtccttttgtccattttcatcttttcttattaagatgccataacttcttatattagcaacattacacttctgttttatgttgcagatatttattttgtcatcaaagatttttgctttggagctttaagtttatttctgtcatttcaatgtctggtttaccttgcttggaaagcctttccagactcaaaagttatttaaaaatttactcggattttcttctagtacatttaaagtgttattcttcattttaagaaaaatacctaaattgatttgcaatttatcttattgtaggaggtgagtggtagatccaacattacttttgcccgaatatctggacgtttgcctcaaagccatttactaaactttctactcttttcccaccaattttaaatgccatatttctcctgtactaaatgttcatgtattttatgtaatgcaagagacctacttgt

SEQ ID NO: 112808 - DNA, 1034 bp, Homo sapiens
tttgggatgattcaagtgcatcatatttattatgcactttatttctattattattacattgtaaaatataatgaaataattatacaactcaccataatgtagaatcagtgggagccctcagcttgttttcctacaactagatggtcccatctaggggtgatgagagacagtgacagatcatcaggcattagattctcataaggagcatgcaacctagatcccttgtgtgtgcagttcacaataggattcaccctcctgtgagaatctaatgccgccactgatctcacaggaggtggggctcaggcggtaatgtgagtgatggggagtggctgtaaatacagatgaagcttcactcacttgcccgccactcacctcctgctgtgtggcctggtttctaacaggctacgggctgatattgtggggttggataatcctgctgtagcagggttggggaccccctgctgtagtatacatctctagaacttacttatcctgtgtaactgaaactttgtatcccttgaccaacatcttcccattcctcccttcccctgcccctttacctctacccctagttcctggcaaccaccgttctaccctctgcttctgtgtgttcagcctttttagattccacatgtaagtgagatcatgcagtatttgtctttctgtgcctggtttatttcacttatcataatgtcctccatgttcattaatgttgccaaaaatgacaggatttctttcttttttaaggctgaatagtattacattgtgtctatataccacattttctttatccattcatctgtcaatggcttcttaggttgtttttatatcctggcttttacgcaatgaacctgagagtgtaggtgtctctttgacaaactgatttcactttctttgaagatgtacccggaagtgggactgctggatcatatggtagtcctatttttaactttttcagaaacttccatactgttttctacaatggatatgctaatttacatttcaaccaacagtatacaggggttccaatagtt

SEQ ID NO: 112809 - DNA, 3101 bp, Homo sapiens
aagatagcttctcttttggagtttcctctttgtcttaatgacaaaagcatgtaattatcctagtctctttattcagtattggtccctttataaaattagaagccaaatataaagactctaccctttacattatctcatcactttcacagtcatcccttcctttaccattccaacatcctgattatttctcccctggattcctttaatactcatctaattaggcttatcacttcctgctgcaatccatcctacaaggcaaatcatcccaaagcatcactctggtatatcactctcatactctaatattaaaagtagattgccagtgtctacatatgtaatagtatatacaccttcacctgtcattcagagttctctacatcatgacctcagcctacttctccagctttttatccttttatctgcattaaccatacctaaaacaactaaatatttgcctgccttctgtgtgacctctctaccttcttctttctcttcaagttattaatatagtgtcctagtttcttctgttgattttggtttgcatttcttatactttacctttgctcaagttcttgtttcagaatgtatcatgtagataatacatcatgcttgaattgaattcaggaaattggtccaaagatattcaacatcttagaaatgcatgtaaaaacattttcatgagatacaaaatacttgcttattgattttagttgatgtattatagcatgctgttaaataacatgtatatgatcttttaaaaataatttttcagttattatactccatggggattataattattataatatttatgggatacttccaaagacttcattttatctcttttgaaatcatttaaaaattatgataccaatttcaactttagtccaaaaagagaaagaaaaaggcagatttaccaaagaataaacagtgttgattatagtgtcttaaatcgtctctgcctaatttcttccttaccatctttatgtttacctcaagcattgtacattcggggcaggactgcgttcattactgctgctttggaattacgtgactgtaaaaaattatctggctagttcctgtttagtctctggaaccctcttattcctttctctgatgaaactgatctatccacatttatgagtttttcacagtttggctcatgttatatgccatatgggaatttggcacaggatctttgcaccatctctcatactttaagccataaatcatataaaagtaataatgatgtcttgggaagcatagaaacaatgatgcttgtaatttccaaactggaaagcaacactcaatccttctgcactagacaaatgtatttcttactgtgttatgatcctagcatatatttggcattgttacatgaaaatacctgaaatattctccaagaatcatgtaaaaacagaagatcaaccttttcttccatcacaatcattaatggctagttgagaaacatagaagtaaggatatgccacagaaattagaaaaaaacgttaagagtcagtgtgatctttatcttttagtatgctcaagggttattacttttaattaattattcttttgttttttgagaatataatatatacatttttattatacttatttgagttattttgggttggttcttaacatttagacttgcttgaaaaatagaatattatttttcattgtgattatgatagcatatacagaaattatttttattttttgaaatagagtctcactctgtcactcaggctagagtgcagtggcgcaatcttggctcactgtaatctctgcctcccaggttcaagtgattcttgtgtctcagccttccaagtagctgggactacaggcatgtgccaccatgcctggctaatttttgtatttttaatagagacagggtttcaccctattggccaggctggtctagaactcctgacctcaagcaatctgcctacctcggcctcccaaagtgctgggattacaggtgagagacacggtgcctggccagcatatagagaaattttaaaggggtgtttttttttttttttgaaaatttagttactcatttatttcatcatcttgccagttatatgggttcaataggttactttttcttcttcattttttctgacaatcatttgatctgaattacagttgtattttaggatctagctaaaaaatctcatttatctcaattcaaatatacttcgattctttaaatcacaattgaaccagtgtttcagagccagaggagacagaaaccgttcaattactcttcaccctccattgtgttccctgtcatatataatgcaaagcaaaatttgggtaagttgtacagtgcttccctcctcctgctgtaggatacatgtttagatgtagtgaaccatcttggatcctagagctggcaccacttacttgctgatggaagtgagtatggaggggttttgccctcatgaatttacaaacaaactcctaggggacaggtgtgtgcctattcaaaaaaagaatcttttttcctgaccctttacttagccttccagggatgaaactttagaggcttatgaggaaatctagtcacaacttctcctggaataattccattgggccttaatgtctcatcaagtctttttcaaattctgggccatgactgctgtgtaggtcttgaaatcaatttactgagtgatgactggccattaaaaaatagaatagaaggctgggtgtggtggctcatgcctgtaatcccagcactttgggaggatgaggtgggtggatccgctgaggtccggagttcaagaccagcctggccaacatggcaaaatgccatctctactaaaaatacaaaaaaattagccgggtgttgtggcgcacgcctgtagtcccagctactcaggaggctgaggcaggagaatcacttgaacccgggaggtggaggttgcagtgagccaagattgtgctactgcactccagcctgagcaacagagcgaaactccgtcttaaaaaaaaaaaaaaagtagaatataaaatatagagtaaagggtcattcaataagataatacatgtatttgtgtgtatttgtatgtgtgtgtgtgtgtgtgtgtgtg

SEQ ID NO: 112810 - DNA, 1275 bp, Homo sapiens
agaatcaccatgtaatttgtcacttactcctccttgagcctcagtttctttattcttcatttgtgaaatgggatactggtgcctacctttcaaattagctgcaaagattaaatgagatcatttaggtactgtgctagcatagtgtctgacatttagtagatattcaaaaattataattcttgcatttttagatacttttatattctagctaagttactaatacatgttagtaagaaatctataaatacattttgagtatgtaagtttttaaagcggtagtttcatttaagcaagtcttatgaatagctctgttttactaatgcagattaaaaaaataagctctgaaaatagtttttactttatggagtctctagagtttaagatatctgtaatttgaggcgattgaagtcagaatgtttttgaatatgcaagttgttgatacatatgaatattttagtaaattaaaatcagatcaaaacctgttatcttttaggtatgctttatttgatacatattatatattttttatttaggtgtcaatgttatatggatattgcataaatacgaattttacataccagtgtaaatatctggttcctgccgagcattggaagctctgcctccatgaggcctttgtggccctgggggaaggcagctctgttctttgtctccatctctgtcaggtcactttctgtatttggggccctgaccctgatttaaactgtcacatatcagcatggttttcatctggaaataggagtccttccttgaatgtaaaccttttctttatatctaagctactttaaaaattcaaaatacgtctgtaagagaacaagctcatatttcatttaggagtagacacatttatgtgtctattatgtggatggtagatgttttttagttgtttgaccatcctttagttttcttaccgtaagaagtaatataaggtaagggtgttttctcttttatcctttacctttatatagatatgagattgtctccactcatttttttaatagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaaggtaaaacttattaatattattattattttttatgaatttgctgctgtgattttcaatttttatttttgataaagcttttgtacatctggggcctactg

SEQ ID NO: 112811 - DNA, 2655 bp, Homo sapiens
gttggaaatgcagaaatcacccatcttctgcgtcgctcacactgggagctgtggactggagctgttcctattcagcgatcttggaactgccctctttattaagcattttaaggaattttgaacatggctttagcttgaatttttcactataaatgagatagtcaatgcacaaatgcttaaatatatagtcgatgttccctttatagttttgggaatatcagttcaattcaaccttgaaaaatgtttcatgttgaagccatgagaattaacaagtgaacaatatttcacttaaaaatgaaacaaatgaacaatgtttcatttaacgatttccattttatatgtggatgaataatttttataattttatatatcaatagaaattaaacattaaaaatgataacaaaagttttcatttatgtataactcagaaggtatgacatctctttagagtatcttgtttgtcattataaaattatatatattacagaaacatagagtttaagaatataaatctgctcttactatctttatataaacattacaaatcatatcattggtcctcaaacataggtgtttaactgaagccgctgtggaagtctttgatgattgaagaggctgcctttaacatgcctcaggctggaagtttttcttgtctgctctggagcactagcattccaaacacttgtgcaggcagtcatacagatcccacatgctttctaaaggaactctttggattctagatatcccctcatagatgccattgcatctaagcggggagataagtcagactcttgtggaatgacatattttggcttctgccttgtttctctactttttccctgctttacataactgaatttaatgactcaccaagagtcagacctgacagaagcagaggctggttggcaaccttcaaactgccacgtgcttgggcattgaattaagccgtgggctgcaggcctgggatctgtcagccttgcccctgcatctgtttccctgccttgaagccttctatggccatttagatcaagagaaccatttatcaggggccagccgagtcctccactcattactcatgtgctgtaccagttcagggacttttgcctagatctttcactctgcactgttattcctagttattctgcagggacactgtcttggcttcttgcacaagggcgtttacttctctggggtttagtattgtgagctggacctttagtgaggttgaaacaaaaacatgacttcaccacaaccatttttgaatattcaacaacattgtgtgatgctgttgttcattgggatgatcaacatttctaatataatatgatatgtaatacatttcttttagaattgaatacattgtttctgaaaacctagacttttacttttcataccacctatccagtttctctgtgttagtgtctgggagggaaataactaatttaatattcagttttaatatttatattagccaattgtttactgaagttatatccccccttattgtattttttaaatacattttattctgtatatttaagttatacaacataatgtgatgagatacacatatagttaaatgattattttagtgaaataaattaatgcatccattatctcacatagttacccatttttcctcctgtggcaagagcaactataatctactcacttagcaaaaatccagaatataatacgctattatcaattgtaatcttcgtgttatacattagatctttagagttattcatcctgcatacctgctactttggatcctttgactagatttcctcattttaaaagttgtgatcctcctgtcatgtgagacttttttttttttttttgagaccgagtctcactctgtcacccatgctgaaatgcaatagtatgaacacagctcactgaagcctcgacttcccaggttcaaacaatcatcctgcttcagcctcctttgtagctgggaccacagacgtatgtcatcacacctggctaatttttaaaattttttgtagggacgaggtctcactttgttgtccaggctgatctcgaactcctgggctcaagcaatcctcttgccttggcctcccaaagtgctgggattacaaatgtgagccactgcatctggctcatgtgaaacttctattgtgaactaaatgcttttcagaatcctgtaacttctgatcttttactgtaattaatgttgcactctctactatgtacatttaagtttaaaatattgttggctactgtaaagggaatattattaactgcatgctacatatttccaagtctaaatttgtgcataacagaagagttactatatattaggtgtaattttttacagagtataaatttaatatgtactaaataggacagctgtattacatttttaaggactgtgagtattatgtctcaaaagatattttttactacataacttatgtccactgcattttcagtgtatataggttagtgtgaacaaattagggctgaattgtaatatatagtttgggtattgcagtggcagctgttcacatgtttacacttttgcttgagagctgtgtaatttactaggctttgacagttgatttaactgtctatttaaccttttgcagattcatgagatatttgattgtcaagaatgtatgaagaaat

SEQ ID NO: 112812 - DNA, 1790 bp, Homo sapiens
ttttttgattttcaatgctgttctagttaaaatgctattcttaattttcttcatctatgtctgcaatatattgtaatagaactttcatgtcagttttaaagcttaagtttgctgaactaagtaaaaaaccagatgcatacgaaactctggagacttgcattcttattactgggcatgttgtcttcaggctgtgctataagcacaatgtctttgaggcttcttgtagttggccttgcatattgtaatattattaattctggaaatttatggtgattttgtaggaaataattcataaaaggaaatcttgttttatatatattttttaatttgtggaccatataaagtgtaaaatcttgctgtattttagctaacggttactatgccatatgttttgctggggttggtacatgatgtcattctctcattcacagtatgtctcttgcttctcccctttcctccatgggctgcacaggcattggaggaaagaatattccctattggagatagcaagcaaagcagctctcatatacatggttgtagaatcctttattatagaaaggcaaaggcactcaaagaaagagatctttgatggcaaatgtttttttgttaaggtgatatgaattgaggatgatgattagagagaagctgaatttttcaatatggatcacatttttccatagcaaccataacatgggtaggtaggttctcagaccagctcctagaagcatacttagctcacagcgtgttgaaagttgagtacttaagtgattgtgtattcagtacagttgtattaatttcctcacatggcctactggtataagtaatgtgttcctaaatgtttttgaaagtttaaatctgaaagtcaaatatcagatttacctaaataggaaagttaagacagtataacatctagttatggctttgcaggtgctgttatccatgagcctaggggagctggtagagtggtgaggctcctcacagttacttaagagggaacagagtgaaggggctaagctcctccgtcacttcccatctttcccttttgcttagattccatggttgctgacaaagagactttgcattaatgggagataacatttatctacattctcagatgaatagtcatacatttttcctgtgtgtcttctcagaggagctaggattcttctagggtgaaaaagaggagaagccatgaaaaggagagagaagactgaagattggggatgagggtttgatgtataccctttgatacctgcaggcagagttgtggcaggagtgcaggggtaaagtgagagtggtgggtggagaaatctgtttctttctctcctctctcctcctcggacccatccagtgggaaggagtagggcctagtatcaaggagtagttgctatgagggctaggacagggcaataaaggattattggtggaagatggaccatcccaactagtaggacctggaaaagagggaatattctttctgaatggtgcctcaggtatgatatgtttaggaaattgatgaccaaatatatgctatcagatattcattttgcctgggagaattttctcctttagtagccatgttacttttcaatcactgagaagcattttcttggctatcatatttagcctgctaaaaacagtgcattaaatggaataggcatcttgaataataagacaaaaattcatatttgccatttgaaagtatatttctttcataaatgcagtcctataataaaacgaaatcattttgtaatattgattttacttgttttagatttgcttcaaaatat

SEQ ID NO: 112813 - DNA, 4078 bp, Homo sapiens
atatgccaacatttgacttgagaagatgttaaatgggaaaacatataaaattgtatataaagtatgatcccaaatttacctcttcttagactgcgcataaaatatgtatgcactaaaggcaagtcaggcttgccagtaatattatgacagttgtctcttcctgatgggattattggtgttttttattttctgcattttctaagtctaattttattttataatcagaaacaaatgtgtaatttaaatagcacgctgagaaatttggtcagacctgcaccagtctatatgggaccgtgtagcataattcactctactagcttaatcagcactgtttttatgaccttggtcttttttcacatgtatgtgagattctccttggtaattcaatatagtttgcatcagttggatttttctccttgtgaaggtaaaaatgagctaaaaatgaccaatttcaggaatagcttttgttttctaatttaacattttgatctgaaaagttaacattataggatgaattaaataaggaatttgactttgtattaatttggtgaaatacaagtgattttgaaaataatgtatttctctctagtaacacttgctattatttttttgtggccaaatactattaatatttatagtgataataagaatttattcatatggtatcattaagcacaattaattaattaatttaaaatgagagcaaaactgagcatttcttggctctgaatttttgtctcatgaatatgtttccttgtgaatgtgcagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacagtgcgtatattaaagaaatatctttaaaattataagctaacacagtttattccattcagcttaactcatagtttttaacctgtgtgtgtgtgtgtgcacgcgcgcacgcgcatgttttgtgtgtgaatgagagattaagcattttacattggtattgtcattaactcatcttttcttagtatagtatgttgattattaaaatattcaaattatggattttaacacataaacactgtttatggtaattagtttttgtccatttattaatttgccattatgtatcaagcttactggtttaatctgaaattcagatatgcctactttagttactcctttgaggtaacagacttttagttgtctacgttttatattccttctggaatctgtttaaaaaaaagtttaagaaatggggagttcaaagtataaagaattcctggacattttgggaagcactgtttatttgagagcaactttggaggaataatttaaagatgcataggtcccagttataacaatatgattaattagatgatcccacacatagctctgtacccttttttattttaacaatttatattaacaacataaaattatctttatttaaatattttacaggatcagaaattgttaaaagtgagaaagtaggtatatgcatttgtaaagttttatttttttactcattaaagtttgtaattttaatcagataattgaatttaagtaatttaaaagcatatttacatattggatgcaactgtagactctcattgtgttgaagccaattacttccaatatgaaagtaatgtaaattgtcccatctcatcaacatatctcttctcttatgtgctcccatcctgccatttactttctttctccaaccttagcttctcattttaacagaatgttaccttacttatgagcaagaaatctttaacataggctttaatgttacatttttacatttttgtgtttcattgaactaaaattctgaaatatgctacatttcatactaagactgtatgaatattattatatgcatcaacttttgcttataaaaattgagatgaaaattgtgcttaaaacttaataaatgttcagaatatcaaaacttttataatagcaggatactacatatttagaaattctattgtacttccttaaaaaacaagcaaggactatatgcttttaaataaatagatgttaagttgcattctggttagcttttattgcatttagtattatatatttatacaaaagacactgctgagcaagagcttatagttaaggtactgctaaaaatttaaaaaggcaaaagacaatgaaaaaagggatcacgaacatgactttattcagagttagtgtagtttcatttttgtcttagagttccagtttttgttttcttttctttctctttttcctatttccctttagtgttcttcagtgcacagcgaaaagcagtctaaaggagtcttcgcgaagttttcagtgctctgtttgcaattcttccttcagttcagcatcgaggttttgtgtctgagttatgaaatggctgttatataattgtgggtcattttttgcatgcatactttcatgcttcttagtaattcagtttcacatacctacagaatttaaatgcttttcttcttacctgcataggtaatgcatggaatgaccccgaaactctactagggagcatgtattacaaaatcttgctgatgtttgagttttgtaggtatgtcttcaccatttcttcctgttccgctttgctggttgtcttgtagttttgagcagcaccaggagacttgccggggggatgccaggtttgtgtgcaaggctgacagctgtggaaagaggctgaagagcaaggatgccctgaaaagacaccaggaaaatgtccacactggtgaggagtcgttggagggtcgtttccgaaggggcttcctttccccaggctgcagcgatctgtttttaattctcgctcttgaggagagagctggcttttccattgtgtttcacacagatgtggagcgctggcagtggatttttttctttcactgaacactatttctttctcaggttgaatttagcagcatttgttctttttcccattcctgaattaattataactgtaagccttagttaaagtctagttatgtttgggtggtcagatgcattaagaattaatatttttaagtaacaattttaaatgttttggcatgtgacatttcttttataaattgttaaaatttatcattattaagtgatgtccttctgccttattatttttacagtaaaaatccaacttgtgaaaatacagttctcctaagttagagaaaattgctaacacattttgacattggaattgaatatgtatggattaacaaaacaaatattatttgaattccatctgatagctagctaaacaataaaacaaatataaaatttgactgtcttttgggtttatctgcttagcacatggtatactgtcagtaaatatattttggcttagggattaaatctattgcagtgagttgaacagatggctgtattgtctcagttaactttttacttcttgtctttttacctccaaagacttcctccttaaaggaggttgagatttatgaaaccctgtgtgttcttctcttcatattctttgttcatgtgtttatttttgcccttgacttctgggaaatgggtggctatgtgtctctggatgtgggggaaagtggatttcttttctcccttcagttgtttattcttatattcaggagaagatgataatctgcacccagcatctgtatcctgtatttgttcattgtccaaaaagtattcactttaataataatacagttatagaggctagcgtgaacaactgctagctgcgactttgcatcattggtttgggctgcatattaagtgcaacctatggtgaaagctctgtgtggtggaagtagggccttgtgaaatgcacctccagcttggtgcccttcactaggcttttacagtgttctggtttctttctttccttttgaagaatacacagctgacttagggaagatggatttttttctgaattcagtatactggggtcttccctatgattgcaaaaggcaagcataactttttgatagacttgcc

SEQ ID NO: 112814 - DNA, 2011 bp, Homo sapiens
tatttcgggaccaggtttcagtaaattctttcaggggacgaacttatttgcacttcctctggtttgtgttagaacttgaaaggctttttttttttttaagttttgtgttagtgttaataataacgaaatcattgatatctcattgctctctgtctgcatgtgtgaatgacactgttgcatgacaactacatttataggccaccacaaagtgttgcttgcataaggccagttagtgatgcaaaattcactttaaaaattgaacataatttcatttgacatgtgtaaatgtcactttttgtcatatgtatttgtattttatttgccaggtaactgaatattgtcacctgcctttttcagcacccagatcaactagaaataaaaaaaagtaataacttttcatgcacacatagtactccattaatgtatcttaaaattatttcttaattactatcagaaacaaatgaatggttcagcatttaaaaaaatttgtttcaggaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaaggtattgcatctttaattggtgatctgggagaagaaaagttgtagaaaaaagtgtagtttaaactgtggttgaattatagttgccttgtaatatggcattctcaaataaagttagtttttgtcaaaattattctcgagggtatcctgtggtggactcatctttgttacagcaggaaaagtattttgggagtgggtgatggatgtaccctataggactgcctaggccgcaggcagggctgcattgctagggcagctcccggctctcactgctctcactggcgcattggggtaatgagtagtgaggatttttatagtcttgccatagctctgccactaatcagtcttgtaacgttgggcaagttgctgactttctgagactttactttctcatctgcatataggaaaaggtgagagtggaggtgaggtacacaagagagcctgctggatccgaaggggattgattcctcttgtttgggatcttttgggaacctgcagcttcttggcatctctttctgttctgatcacagaagcctggaggattgctaggttgccctagtgtggttaccaaaaactttcagtgaccgtaggtcagaccttcctcagtcaatactgcagccacttgcttgttaactgccagggaataatcaattattattggccttgtttctattatgttgtgttttactcctaagggaaatttaagggatatatgaatgatgctataggtattcacattttgtaataggcctcgtctttatcctttcaggctgttataacaaaatactttagactagatacttggtaagcagcagaaatttattgcttacgtttctggagcctaggaagtctatcaaggtgccagcagatttggtgtctggtgagggcccgtttctaattagatagcaccttctagctgtgtcctcatgtgacagaagggacaagcaagctctcttgggcttcttttacaagggcattaagcccatacatgaggacacagtgctcataacctaatcatctcctaaagggcccacctcttaatacaattccattgcggtttcagtttcaacgtatgaattttggggattcacgaacattcagaccatagcaggctgatacttactatacagtacttttccattttgtgtagcaaagccacttcagaagtgatactggtttcattagtcaaagtggtagtatgcttttcctgtactttttctgttctaactgcatgttattggctgagaaagtgtgaacattctgtcaccattgccagcttatgcttctgtttctttattttagttgaattatttaaggggaagataaggacaggcttatatgcatt

SEQ ID NO: 112815 - DNA, 1896 bp, Homo sapiens
agagcattggggcaacacccttgtcttagtccatttgtgttgctataaaggaatacctgacactgggtaatgtattaaaaaatgtgtatttggctcacagttttgtaggcttgtactgaagtgtggtgccagcatctgcttctggtgatggcttcaggctccttctactcatggtggaaggtaaagtgaaacaaacatgtgtagtggtcaaagaggggataaggagggtgccagtctctttctaataatcagctctctggggaagtaatagaggaagaactcattcattatactgagaacggcactaagccatgtatgagaggtctgtccccatgacccaaacacttcccatcaggccccacctctaacattggggatcacatttcaacatgaggtttgtgggcacaaacacccaaactatagcaactgtaaatccttcctgccaaagggcatgagattaggcctgggatgagcctccaggtggacaaaatggctccagaaattagggatctggcaggccttgtcaatctgaggtttgtagggaggagaacaacaccatgaagagttgcaggatttgtaggatgatcaaaaattagtgcagtgtatgcaaggaagtgacttaagaggatacttcttaatagtattggggtagcaaatgaaaggaaagagactgttggtctgcacagtggttggaattatatgtacagagatatccagacattcccattaaataaatagattgaagtaatacctgtaactatattcctctttatatcacattttttggcaaacagagaaaaaccatgcagctggtcctgtggagcctggaatgctgccattactttcattaaattaaagttttagctggtatatgaaaattttcttttattacagagcctctaaacagacatgccatatcctgtgattacagtttaagttaatggtatcatgttttaaaattaaaaattattatctttccttggtgctatcaaaaccatcacaaaattaatcactaatatactaggatgacggttcaattaactttcatggatattgatcagataaacactaatatttattattgcattctgaagtctttattaggttagtgggttacccaaacagttaaaaactcatctaataaagacctggaaaatgctgcttttgagttaaagagacctcttgcttagtgtctatatattttttgcttgtttgcttttgttgcactaagaataccaatagtatataagttaattcagtgatcttaattagaaataacctttttaatgtttttggatatataaaatttaaaaacttccaagagtgttcaaaatgttataggaatgtctatacattaagtgtagcacatgattagatttgcttcagtgctttgaacttttgaatcaagccttccttccataggattggatgcatatgatcataatttctgtctcttccatgaaattttctaatatatattgttttaaaattacaaagtagtcatgcttattattcaaaaaagccctcccaaactaagacaatgttgaatatagcccctctcccatcctcaaaataactgtatgtacaatttgatgcatgtctttgcaatttttcatgaaggttctaattgtgtttacatatatacataaatctatgcatgcatacactctccttcctcccctctctcctattccttcccctctcacatcttctcctttgtcttcctcctcctgcttttaaacataagtgctatgatattgccaaagaagagaaggctttgttctgtgctctgtgctttattgaatttcattcattggtggaccttactttctttgtcctttcctgcctttgccactatgaaggttcaataaattcagtctctgttttgcttttctt

SEQ ID NO: 112816 - DNA, 1600 bp, Homo sapiens
tagtggtttatagcaacagaggtttatttcttgctgacaaagtataggctgccagaggctatgactctgtccacagcttggctccacatggcatctgaagatacaacccttatcagggacatgtgttttcctggcagaggggaaagagagcggcggccaaaatgtgatgatttttaaagctttcacttggacgtggttcactttgcttctgttcacatttcatcggttagtgcaagtcacccggccaaactcataaggtatacccactccccaaaggtaactttctgagtcacatagcaagttgggaaagtcctcttactgggaagagagtgaataaacaggaatcctgtctattacagttatgtcttaaagacttttggttttattgttggattatagatacattttgtgaattttaatgtggaaatgatttttttcttgatgtttgtcagctttgtatgttgagtgctatagacatatcgatacacaggttaagactgattcaggagtttagtaaagaagctttatatgagaggatattaaatatgaaatctttactgtttcattctgttttcttttttgcaccttcatcgcttgtcttttatttctattgattattggatagcagtccagagactttttttttcctctacactggtataagttgttcatttataagcccttgcattgttttgaagataattcccttttccatggattacccattagtcatgttagctggatagtgtggattttcacaatttactaccttttcaatataatgaattgtacctttgccaatttcacaatcatggtttttcttacagtgtccacatgtggatagcagcctgccaacaagtaaacaaaaactgagttaagcgacatacagatacagctgaaataccaaattacccgtggcctctcctggagttatatttatttgcacacagtggggactagtatttccttgtgaaacaagagacttttactgttttgaaatagcagaactgaacctcagatgcatgagttcattaggatagatttatcctagtgaggcatggcacttgagaagagacaaagagcaaattatcagagaaggttgaggtgtacacataatgccggatgtggaagggtcatagagaatttgaaaattagatttattgcctagatatctaggagtaaatgtttctgtgtagtgatagaagcagaaataattagactggaaggcatcttgagttcatttggtcctaaccattaccacagtacagaagtagtcacattgataaaatcttatcaaagcatggcttatgttacgctatgtaattttggagaatgggcctctcaaccttacaaggttgtatattccagcttttcataggaatcctagttaagtatttctcttaattccataccatgctttgctttagtagggtgaggtctgagagggaaagcagtaatcagatcagcctctatatgtacttttccttttaaattcattaactagactcccctaaagatgagtttatttcacttgtgattgagtctagctctagaagggatgagattataaagtccaactctatcattttacagataaaat

SEQ ID NO: 112817 - DNA, 1050 bp, Homo sapiens
atctaactgtaagtcttacaggagaaatcatgggttaaaagtcatttggaattgagggcactctcagtgcttaagaggatgtttctatagaagaatacaagtatcctgttttatacttgatcttagtaaaaagaccaagaagagatgtaatagcctttgttaatgtttggaaatatattaaaattaaaaagatattataaaagatatatttttctattttttggaatattaggaaagatgataataaacaatacgtatatattcctgaacttctgacatcaacattcacactgccttacaaatgcacactttctcattcttttttcctaaaatagagaaatatccccttctctttcttaagaacaaatctcctacctgtttctctttctgatgaacacttaccttgtaggttatcccttctctccatttgatctttatcctctccttccttcaattgtctgtatgctgtgtcttcattttcttacctccaacgttctctgccacccacactaacctggtttctgcttccctctggccttctgtttgttctctctcaggtcactagttctgccctcattatgaagccacttgatgcttttcagatttccttttactctcagactccaaggcaacattaggtgttgtggacagctacctccatctttcaactcacccttctttggcttcctgaaaccacctatcctctgagtcactttttttttctttcgcctttatagcttatattcttttactcagctattaaatgtgcgagttcctttccttttgtattagtctgtttttatgctgctgataaagatgtaccagagactgggaaaaaaaagaggtttagttgacttacagttcctcatggctggggaggcctcacaatcatgatggaaggcaaggaggagcaagtcacgtcctacatggatggtggcaggcaaagagagagaggttgtgcagggaaacccccatttttcaaaccatcaaatcttgtaagacttagtcactatcacaggaacagcacagaaaagacctgcccctatgagt

SEQ ID NO: 112818 - DNA, 1265 bp, Homo sapiens
ggccacagaggtttccagccagaaaagcaacaccccaaagatcccataataataggagtgcaaaacctgttgtaaactgtgcatgccagggatctaggttgtgtgttccttatgagaatctagctaatgcctggtgatctgaggtggaacagttttatcccaaaaccatccccagccccatccctgtccatggaaaaactgtcttccacaaaacctgttcctgatgccaaaaaggttgggcactgctattctataccgctgtaggatgactatagttaacaataatatatagtttcaaaaagctagaaggaagacattgaatgttcccaacacaaagaaatgatacatgtttgagatgatggatatgctgattatcttgatctgatcactatacatgatatgtattgtaacatcactaggtaccccatgaatatgtacaattatgtgtcaagataaataagtaataaaataaaaagctttatcttattccccaaaaaaagacagcttgaggaaaggaaaaaggaagattactagcagagttgtaggctattgtctatggtactttactgcatgaagaaggtacagaggctgaatggaagaggggttgtaaaactggagtatgggctttcctttcacatggagctttgtttaacagaagtctagaaagtagatataagaatcattatcatggttagtttatgtcaaaactatacatactgtcttattatacttaattaaatgggtaatcatttgactagtgtgtctatgagttcgtaagttggtacttaatggttatattatttaattcacctcagtggacagagattaaaacagagtcattttctggttccttttcctgtggttaattaagtcctttgagatatggctgtatacactttatggtggtttacacatgtctgttttattagttttgcagacagtagacaggaacaaaaaggggcatagtcattcttgctgtgagttaaccctacacttctccaagcagtagaatgtaaactcaactaggcttttgagaactttccctcagtgacttaattaattccatgcccatttctggactttggaatatagcatgcatctatgtagcttgttttttactttatcaaatttaaaatgctcattatcgaacatttatatttttatattaaacttttgtaagtataacctgcttggtttcaaatatttcacatgcaacatgacattggttggaataatgttatgttgtatgtaaaagtgtaagttgt

SEQ ID NO: 112819 - DNA, 1495 bp, Homo sapiens
atacttaatatcatgatgacacttagataaactatttatttatgttgtcatctctatcactaggctgaatttctcaagagtggcatttgtgtcagttatgtttgtttcccagtgttcatttcgtctagtgggggctcagtaagtgcttgttgaactggcctcctttggcagctcttctgcctctttcctgatgtggtacacctagttgaatgtaccttgtcacttgggaaaaggcttacatctgtttcctttaaaataacagaaagcaaatgcttccacttgaactctggcctgaaatatatgtgcatgcgagtatttggtctggcaaagtgtcacatttttactctgtgagtgctgagtatgtacttgtatgtgtgtacacatttcagtctactgctaagtagttttatcttagccagactgccgtgcagccaacagcacctcatcgttaatgtcaaaagtctttttacagatataaccacagacaagcagaacctttaattcagatactctgttgattaacaaccagagagttcagtctggactcactcagaaaactaggatatagaataatgaaatagctaaggctactgagaaaagaagtatttactatgaagtggtagtgtgctttcaaatcatacgtaacaaatgtagtaatgaaagattagtatttgagaattaatcaatattgcactaaatatactggaactgggctatatcattacaagatttaggaggtatgttagaaattaaaaagaagaatcttaggaatgttttagtcactagaaaatataatgaaacatttgttatatatggagccaagcaaacaacatgaaagctcacttaccagaggaggaaattaaactaacaaccatgtacgtgtgagtgcgtgggtgtgtggtgtgtatttttgaagtgttaaaactaaaatttagacacccagaataagcacatatactacttgttgccaggcaagatttttggtgtatgaacataaagaaggaaatgactttgtttttgtgtttcaaaattggaaatatgttttatggtaagttttaaactattttttaatggttggcattaaagaagtcaataaacaaattacaaagtgaagtaaatgtaatggatacaacacaaaacagtagaattagccacatgtaggtctttatcaatggaagttgagtagtctagggaaatttctattcaaagaagactgtactacatccagtgcctgaatagactgtcataaaaggttcagccactgttgagcaatacgaagtaaaatgtgaagttctgcattctatcactgaattcactactcaaaagaaggtataaaaattaccttgtactttatatactgtactcaatgtaatttgtataacaaagttatactgtattaagccaagtatatttcactctgataattttgagaagtctactatgtcacaaaatctaggaaaatgttaccttagaccctaatctaatcatccttgat

SEQ ID NO: 112820 - DNA, 6550 bp, Homo sapiens
atgtatgattaagaagggccataaactaatttctctaagtagtgctgtcctctcaaactgagatatgcctgggcaaacccatttgtgtttcactacacaaagttagttagcttgtgtggatttcagtaacagttatagattttcagtttcaattctactgagaaaatttttctttcaagtattaggtggcattgccacctgctgtgcttaatttggctttttgtcaatataaacagttttggtgctattgctgtgagggtacctgaaaggaaggactttatatccaaatatttaaaattatttgtttactctgccaaaaaaatgtgaactgacatgcccattgaggcagaggtgtagagtgtacattctctttaccatatcagtgttgctggacatttttggaatttcccagtgggcagtgagtgttctgagtcgaagtgtaagtagggaggcagaacaattttcaggcacctcccaaagcagatcttttcagtgagagtttgttatttagtgagaagtgttacaaattcccataccttcacatataagcatcttaagtatgtaaatatgaggtatttatagtcctaaattgctcttttagaaattacaatatgaaaaattaaattcgtgcttcccagtgatggtctggcattcattattgaggatccttgggcacttaagaaaacaggaattgtttgagaaacatggcagtatgtcacatataaggaacaggcagactgtattctttcctgggtattatatatgagaatctttaaatatcagtttttgcagtgcctgtaacagatgtgtctttaaaatgttttttgggtaaaaataactgtacctgcccaaagtaactgtctagatggattcctggtctgttggtccccgcatgatctggtgtctgccaatctgttagatctcaatgcccaccactttctcggttgctccttctgttccagcctcataaccttcttattgttctttgaatgcacctaattcatttccaaaccgaaggcctttctccttgcctttcacttgctgtaccctctgcttggaaacagtcttcccctagctctctactggcctgttccctccctttagaactcttaaggtcctctcatcaaagggcttttcctgatggcctcatggaatagagcccttctcttagtactctattttctcctgctctgttttagttgtcatcatagtactcatctttacacgaaattatattctacatttgtttacttttaagttccatgtgctctggggctttgtcttgttcactgaaagattcttgatgccttcagccattaaggacccaataattgtttgttgaatgaacaaatgattgttcagatgtagcatgaaaatacataccttattggactgattgtcttttattttataaaataaaattttggaaatctagaattcttatcaagtctgccaaggtgaatttgtaacctgtatgttcgtgttacttggtgttggagatatggagtgctaatcactcactcctttccttttttttctggattctaatggaatagaaacatgaaatcagagttgaatggtgattggtatataagttttataaactgggcaagtccctagcaactgataatgcaggggttttggagaagctagatttcaagtaacttgggttcaagaatgtccaatgggttacctgcttttggagttactcccctcctctctccagttgaatgtagagtaggcctgagcaatgagagcgtatggtctgagacaaaaatcagagagcccaccatcctcagcaatccatgagtgggccatgaaaggataaaatgggattgtttcattcattcacaagtaaagagcataacattttgtttcattggatgtcagattcccgctggctagatgagcaggttctccttttatggagatgattctgtaagcaggtccagagaggaattgaaatgattgctccagttctacccctctcaactgggaaataagcagtatgacccttctctttggagaaaaggggaaggttgcaataatgattattctctgaacaattgtgattgcaatacatatactggaatatacttacaaaccgaaataattttgaccagaaaacaactatcaacgtaggatgtttctgagagttcattgcaattgtgagtcatctagacatctgccaaatgaaatagtaggctgtatttctacatgtgtttaagagaagaatgcatgttagtccaacttctatttatcacccatcaataaaaaaggtatatacttatgaaaaaacgtcatgtcctaaccttgatgtgtttaaaggctaatattctgacttccattgtaaactcaggagcctttaatgtttcaggttcgtgggagtaagggagaagttttgtacattttggatgctaccaacccacggcactccaactggcttcgcttcgttcatgaggcaccatctcaggagcagaagaacttggctgccattcaagtgagcttatttgcttctcatttgtactatgcactgtgaggggggatgaattaatatatgactgtactccctgttttaaatttgtttcccaatgacctccttcaaataacagtaactcataaaagcagagaaatctcatctagtcagcatatgtaggaaagggcaagcctagctgtaaactaacaccagggtacttactttatgagaattcctgagggaatgaattacacagtctgatattgtccttggcagatctcgctttcaggtacttttatttcattcagtgaatattcattgatattttaatttgtttgatagtttattttgttcatagtactataccctctgttagtgtttgggaaaggctttatggagaaggtttacttggggatattccctgtgaccaggctttgagcttgtcggaggtggtgtgttagtcagggtttcccagagaaacaggtgcagtggctcacgtctgtgatctcagtattttgagaggctaaggtggtaggatcacttgagcccgagaggtcaaggctgcagtgagccatgaagatgctgttccacttcaacctgggcaacagagcaagactatggctccaaaaaaaaaaaaagaaaggatatatccttatatatcctttttttaatataaaaaatatataaaaatatatatatggttgtgtgtatatatgtatttgtatatgtgtgtatatatgtgtgtatacatgtatatgtttatgtatgtgtgtatatatacgtatatataaaataggggattacctcacaatgattataggagctggtaagtttaaaatctacattgctgatgtaccagtttaagtctaatggccagaagctgctatagaaccaggaagagctgatatcccacttggaaacccatcaggcaagaagagctagcgttccaggttgcaggctgttaggagaattctctcttactctggggtaggtcagccttttgtttgattcaggactcagcatgattggatgaggcccacccacattatggagggcaatatactttattcaagtctcctgatttaaatgttaatcttttccaaaaacacccttacagaaacacccagaataatgtttgaccaactatctgggaccctgtagcctagtcaagttaacatgtaaagttaaccatcactggtgggaaccgtgttttattgaattccatttccctgtatcctagcatactgctggacaaaacattaggttttgatacaaactatgagttgaacttaggtgatccctcagtggaaaataaggcaagaagagaaaacgatatagtttttagaggagccctatagttagggcttctctaaaacacattgatcagatgaccaaaagaataaggaaacattaaattctggcagataattgactgattacatgtgaaagctcatcttcctggattctaaacttcagaagaggaagtaaagctatggttggcaaaagtaagaggggaagggaaaagaataagacatgaacagtatttgagaatctaccatgtacactgttcaagaagcttcatatacatgtggtcatttattcgtagaaattctgatagtttgacaatttgttgacattacactgatttcattcaattctcaatataaaatcaacagtagcaagaaggaaaaggcacagaattaagttttaaagtaactagcaaacagtcatctagactacttaatttcctaatgtcatctaaacaatttttttcagtacaaatgagtattagataatcaatgtgactactgtccctttttgcatggatacatgagagatgactcttactaaacagctgaggtgacatggaaaataggatctctggcagccggggatattcaagccacttttccaattattcatgatggccattgatccaaccacaagtttaaactgatgttttttttttttttctttttcaacatgtagacattatttttttccaagtgtttatatattttttcatggctttctgaggcaaactcatccatgagaacatcatttatgtcaatattttaatttacggactcagtttgtttctttgtaaatgttactattattaaaattgcctatagagccatgaatttaccttaagccaacccattgttttggtaggttctccatcattgtgattgtggagaatattatttatgctagatggtttttcttttcaggtgtaaataatgattttaagccttctccaaattccttcagtttcagaaatgtcttcctattgcctattatttctgtagaatcagtaggtctctttctttgcctaaacttacaaagtgttatgtgagtttcatcttatatttacttaggtaatacttgtttaggagttccccttaactgaacatcttacttgtaatgatccctttagttaatggaaaacagtgtcaataagtatttataccttgatctttcaccatttactctgctactctactatgccctgtatgttatcatattgtaggcacttcgctcattttcagtaatcacattgtctaagacttacagttttcatgttcatttagtacattccacgcagtacttttcttcctctatatcaactgtgttttttccttgaaagaaaatataaatcacaaaagatgacaggtactccaagaaattattaatgacttaacaagaggagtgaggggggattagaacaggacttatgtaactggtgggctctctgaaatttcactcttgaattataatctaagtatgttcagaagccactctgagaggcttttggtgcagagcaatgacagtggctttcatttcttttaacactgttttgcactttcttaatagggatgcagtgcactgctaccatattttttgtcatagattacaatagggatctttgttagctcccttgaggtaacatctttcttattttgaacagtagctggagtagaggattgctgagggttcaaaatcacatctgagctaaaggcagagagcataatagttgggtcacgtggctgaaagagatttcagccttctaattggttggaatgatctcctaaagattgcattccagaaacattgagttggtaaggtcatgatgtttcctgcataacattatgaatcacttgcattccaaattgcatctgaagtttggggtattcaggaaattttttatttgagctgtatatcccaggagtggagtaaatgagaaacatttgtgactatgtggcttgctcggtggaaaacgtcaatacttggtccaacttttttggacaagggattatgaagttgaggtctgttttggcagataattggaactccttcttggagacttgattatatttctagttttgcaatttatttgattttgaaaaatttgctttgcaaatgatgacttaagtatctgaattatcaaagacggatctagtaagcaaacagttcttcccacatgcacacttttcagaataatcatttaactgtatgttcagacttctgaaaagtttccaactatggctagaaaattctaaatgtgaaagttgtggcttaaaatgaactaaaatatccttaagctccataggaagtgggtgattcttattaaatgctaattttgttgcactaaaggaaaaaaatgtatatgtagcttaaaaatatttttgacctagtttgtgttttgcaggctcttaaaaatttctgttcttttgatagaagatgaatattttatgccacttacagttgaaactattaattatttgaacatttcagagatggagtgctacatctcatattcttaagcccatattttcaggcatgtcttttctgtgactagttgccatacttatcgatttacataaaaaggtaaaaacatttgggtaaaaacatttgggtcctggtgcacttcatgaggggtgtcaggatgtgaggatggtctaaatgaggtgagaaggcactgggtattgagccaagatattctcacagctctgccccaattctgctgtcagtttagaatgctcattaccagcagttattttgtcacagatt

SEQ ID NO: 112821 - DNA, 1367 bp, Homo sapiens
cagcaaagtcatacagacatgaacaattatattgaagcataaaagttttcattttcacaagaaggtatctttccctttcctactttattttattttactttgagagatagagtcttgctctgtttcccaggctggagtgcagtggcgtgatctcggttcacagcaacttctgcctcccgggttcaagtgattctcctgcctcagcttcccaaatagctgggactataggcatgtgccaccacaccagctaattttcgtattttttaatagagatggggttttactatatattggccaggctggtctcaaactcctaccctcaggtgatctgcccaccttgtcctcctgaagtgctgggattacaggtgtgagccaccttcctggcatgtttcctactttagctaacctttttgtgtaactactgtaggaagcctgtgcaaatcaaacaggttttcgaactgaggtggtttttactacacgatgagactgttgacttcatcattggccccaggtatgcagaagatgatcctaagtcagatagtaaccaaatacacttcatttccaagaaaattcaaataaaagaagatggtatttggaagactaagtcttgacagtaacataatacactttggcagcaaaaattagggagatgctgaaacatggtactaggaggaattttcagtcttttttattccttagatttaaaaaatgttcaatttattacctcagggttcagtatcaaattaaaatagataaatggagactttaataatagccagctgtctggagttgttttgatttggtgtctctgggaagaggaatgatggattagattacttttggatgtctctttcagatgatatgtcagcaaggcgaactctgtgtttagggtagtgagataaaagtcgtgtgcacaggtaatctaccagctttggtggagtgttgaagactagactggtgcaatgaggaaatggccagccacttgaaagctggagaaaacaggcaggccccagagagcaaagactctctaagaacttaaaagttgtttgggtaagcatatttggaataaaatgggcagtgattctgttaatgaacaaagaaagttatttcaaatatgaatatgtaggtaatgtagtatattgctggttgtgatagtgttgttctgagaataaagataaatcagcacataaatttgtgtgtattaaaagtgatacatttcagaatagttttagtataaaatcaaattatgtatttcccttaagacggaatattgtgtgagaaagtgatagacaggaagtgcatatgtctaatggactgaaaaggaaaataagttgctaatactgaataattgaacatagttggggcta

SEQ ID NO: 112822 - DNA, 1040 bp, Homo sapiens
aggtgggaggcagagggacggaaggtagaagggagttataagtagataagctacaatggtgtgtgtgtgtgtgcgtgcgtgcgcgcgcacgcacgcgttcataagcacacacaagcaaatagtaattttagagagaatcctttgaacaatcagtgggggaataaaacccatgcccttttcttggaaactataaatcactacagtttcctagctatgatcattgctgatttctgaaagtgtgtctccctttggtttaaatctgacaaacaatgtgccgtcagaattgactacttgagcacacttgcttttttgtgctcctaaagatatcctgaagtctggataattaaacactgaaggcaaggcatatggccttactttagttaaaaacaattgcagaaagaatgcctgtaatttaaatacaaaaacatggtggcattttatactctaaagacatccatactctaaattttagtgcttaaaactgctttctttgaagagccttgttgaaagacaaaaagggaaatatgttttatttaataaataatactgtaacataacgtattgtaatttttcattaaggatattattgctgtcttttttggaactgactgtatttgctgccattacattttaccatacattaaatcaaattttatctatcagttacattttgccacttctggggggcaaatctggctgactggctttgctcttggagccttgatggaatgtatatagttagtgaaaaattccttaggcatttgaaatgattgaaggaaaataatagagtaagcaacattgtagactcgtctttgaaaattaaccatccaaataataattgagcttctctgtctatagttgacccaatttaacaaataaaatatttaagtttagggaaagaagatttgtatctctctcccctgctccctatttccactttcttctttcatttacacgttagggttttctgtaattgagctgagattttttgtggtttcctctgtctttttctgggtggaaacacaaaatcaactatgaca

SEQ ID NO: 112823 - DNA, 2655 bp, Homo sapiens
ttgtttaggtaaaaaagcccaagaactatagatatttccataggagagacccattaaaggaaagtataatagggttacaatatgtgaataaagcagtagatgttagagtcagtaagaaactgttaatgaaagtaaaatattatgcatattcatgatacagaacagcataatacccatatttaaaatctgtcttgaaggagttcattggcagcgcccaatgttgttcccatttcactcagtgaacacatttggaaggtgaagttgggtccagtttgcttgtcattagagtttaatattagggtttttgtatgtgctcaggccaagtttttctcacttttgtgctaacagctgccaatgaagtgagatatctctggacaaagaaggtgtttttgtcactttgtaattttagatgacttattttaaagggtagtttgttgcaaaattaaaaacactcccttggggaaagccccagatttgtaagcatactttaaaaaactcaaactaaagttacataataccttttgagcatcagttttcccaactgcttccctttattgtgttctacatctgtatttttaatggtttattatgtctttatgaggtgaaaagagcaatagaaaaaatatttatggtcaatagtttccttatgtgttaaattcttgatacaagtttgatgtctctatatacactggtgaaagtgtactcagaccattcagtaataaatgaaaaaaatatataatttaagccttaagatttggagaaaactgatgaaatgggaaatgtagaaacatatgttttggttttttaaaattttattttataagaggaactgattttctctatttgtaatatgagttagtattaaaatttatgaagatcatttaatattccctatacaacatttttttttcttatctcacagttgtgtgggtgagaagtccaggtaggttttctgcttaagggtcttaaaaggccagatcaaggtagtggcagggctgggttcttattaggaggctttgaggatcaatttgcttccaagctcattcaggttgctggctgaatttggttccttgagattgtaggacttaggtccttattttattgctggcttttggctagagactgttttcagtccctaggtctgcgaatggcccctctcaggccaccctgtgagcccctcaatctcagcaatatgtcaaatcctttacacattttaatatctttaacttctatacttaccagccagagaaaattctctgcttttaaatagctcatgtgattaggttaggctccccaaagattatccctatataacatgatcataggagtgatatcatattcacaggtttctttcatactcaaatgggaaggcattatacaaaggtgtgagttatgggaagtcagtcttagaattctgcttaccagttggcaaactagtgaccaaggtagtgagtgtattaaggtagtataacatggtgggctctggaatcacatcatcttggttcaatccctagctccagtaacagctgtgaaacctttggaaagttattcatttctgtttctgcttcagttcgctcatctgttaaacgtgcttaatatgtagcacttacctcatagagttgttttgaggagtaaattatataatatatataaaggtgtttaacaaagtgcctggcacataataaacactcaataactattagcagttatactgttagtatttgttttttaaagcagatttcttttctttcatgtttcacttttcatagaataaatgagtataaaatgcaaagcacatgtttgtaaaagtaacatgatgttgacccaaataggaatctttcatccttatggaatctgactcatgtgagaatctctcagatgaaagtgtgaagcactgttcccctgctccaggcagtggatgtgcattcttagatggctagggccaggtgtgtgtgcaatgaagtgtgcagtgaagtgggaggaggtacagtgatctgagctgagacagacaagtcagcatgtgaagggcctcttttgtcatgcaaaggagtttggaattctggcaaacagcattggtatgaggaggtggaagaattgcaaagagtactctggcaatagtgtgaaagatgaattcgaagatagattttgagttgatatagaaaaagagtcaattacaaaaatgctattgttattcaaatggtggatcattgattgtcataacatgccccaaatctaagagtttttcttgacatcttaacaagaaaagttgaggaagctctgatgggggtgggggctgggtcaggctggagaagtcctggtggatactcttggtcaggaagaggcagagaattagaagcaagaccaggtttgagtgagattcaatttctagagtagatgagaaccccggagatcagtgtatgaggacagtgtaagtgatgcccaggaactataattcaccattcaggttacccatctcagaggagtggaactgtggacatgttgaggaccagggagtgccagttggcagagatctgggctagcagtcatctgacctcgagcaaatccaaccatgcatcgctataaccctgtcaccaaaatgtcgggattgaagaaagagtttgatgagtagagtgactccgtggggtgtagagcagc

SEQ ID NO: 112824 - DNA, 1551 bp, Homo sapiens
atcatatggctctcagaaaccttaatgtggttgggatgtgcctggtgaatcagagtttgagaccagcaggcctccactttcctcctctttcctgcctctccctcccttcctctgtctcctccgtcttcccttccttcctcgtcctttatctcgctgtttctccccttctcctccgagtccttctctctgcttcttcctcctatgtcctcctctcctattcttcctccttcctctctcctctacttcctcctctttttttttctttgttcttttttgaactgtgcagtctccttacacagtgctctcatgtagactttggcagactttaaaaattctgtagttcatgcatgggttaattgaggctgagtatttcacaagatctcagatgcatgagtgctaacagagattccagacctctgtgtgttgacatgaggttttttttcaacatggcaaaggaggatcaaagacaccttgttcaatttctacacatttgcctttttatttacttgtctttctagtttttctgtatctgtgccagtctcctgatgccaaccatctgttgattctttaatattatagcaacacaggctctgtttgtattcatggtagtttacagttttatgtttgccaagaccttttgttgtttttatgtactaaattaaatgtgaggacaacaggcaggctatgagtgtctttatgagcagcttgatttatttgtatcagattatataagctgtcaggaggttaccttttggtctgtttagcaaccaattgtaggtctaatttatgtttaatgtaaaaaagtgaattcaatgaactttttaaaagttaggtattgtattttctacaagtgaaaaccacttgcatgaatgtaactacattgcacaatggaggctctgcaaacactgctgaaaaagtatgcataatattctacctgagaagttttgttttctttttatataaagaagattaatgttcatggacttgaataaattccatttaatgatttggtctataatttccttgccctatgataaatgactactcagaagtactttgaagaatttttagtgcagcttagataattaatgttttgatgtgtatatttgttacattttaacttttgatttaacaatcatgttttttaaaaaaaatctgtcaggccatagagatcgatggaaacatatatatgtatattcttttgtctgcatttaaggtagtagttttatattttataaatctcagacatttcaaatcccaaaggagggctatgttgatatattgcccaggacttgcaagttgtttccaatttgcatattaatgagtagattgtaggtgacatggaaaagaatataatattcataagtatggaagagactgtaaatgccttatttttatctataggcttcatttttaggtcaaagagagtgtagaattagttctccataaacaaaatctgttttcttaggagttgtcctgaacagtagtgtcaggacatttaatcatctaatactcctttgtgttacctactatccatgccaccttttacag

SEQ ID NO: 112825 - DNA, 1203 bp, Homo sapiens
atttttgaatttttagtagagatggggtttcaccatgtcggtcaggctggtctcgaactcctgacctcatgatctgcccacctcggcctcccaaagtgttgggataacaggcgtgagccacgcacctggctctgtactgtttcaatagcagttgcactattttacaatcctatcaacatggcacagaagttccaattcctctatattctcaccaattctttcttttttttttttttgaaacagtagccaccctaatgtatttgaaggatcgataatattttaagatacttagcattcaaaaagcttttagtaactagagtgatggattaaatgcatatatgatgaaattcagagtaattttttaagtttacgatggaggatactagacttaatattgacctatatgcaaatatcttacttgattttatacggacattttggttagcaatattatttggtggcaataacaaaaactcagaatgcaataaaagaagtagagtggtcagattacagggagagaatagtgctttggtactgtgtactggtcagaccatatcaggagggtcgtgtcaacatctgcctgttagacacagacctggaagttgataaacatctgacgtgccacagggagccatacccagaaagggtctggaagctgtgacctgtcagtcagtgagggaactagggctcaacctgaggaagaacagaagcagatagttgtcttcatatgatttaaagtggtgtcatgtggaagacggtgaaggcttagctttcctgttcgatgacagaacaacaacaacaacaacaaaacattatgtggaactagagagaagtgtgtttctaatcaacctgaggaaaaactttctggcaggcagaagggtacaactgtgaaacctgctgattcacagcctagagagttccctcttcccatgtggagagggaggtgttcaaggataggctggatgatggcgggagcatggctgtaaagtatagtcttctactggaggggaaatctggcaagatgaatctatattctgtgcacaagagagtaggagaaggtagacaaaacatagttccagaggcaaaacctctaacatatagtaggtggtcattcttgcctgcccaggctcaaccctacctagactctgaataaatctccttcttaggaggaatctgaaactctgtcctgactgctgagaatcc

SEQ ID NO: 112826 - DNA, 1040 bp, Homo sapiens
agaagggcgcattttgaatattctaaacacaaatatcagataaatgtttgaggtgatgtatatgttaattaccctgatttaatcattacacattaatatatgtgtatgaaaatagcacaccataccccataaatatgtacaattattatgtgtcaattaaataaaaaaactggataaacatttaataaagtgtacataatagcccaaaatgcatgaggagctaataaaaaaacagctatttaatagtttctatctactatcccagaaaaattatatacatgggtgctgaaaaaataagtaccttttcttgcagaaactttctattattttttgagaaatcatggcaaataaaggcaaatgaagcccctagtggggaaaaagtagattttggaaattatgaagttcttcagttacaaaattttggaatgaaataaccgacatattgttggagagtattcagaacactggtaaacatgagaaatctgtaggatgtttttaatggtcatgtaaacccaggagagtccaatagatataatgacttttgatttgagtgaaatgtttgacaatgactattgtaaatttttgtgggaggtgaagaaatgtggattgtgtgatagtaaactttgaagtactgatggatagttggccacttatagccggagtgttgaattttaattgaaaagcaggctctgtcttggctcttcctgttcaattatttctatcaaagactcatgaaaattgagcacatatcttgagcccactgtctgtacaactagagtgaagggaggggatagatactgtttttttctcttcttaaaaattgtggtcagggcgtggtggctcacgcctgtaatgctagcactttgggaggccgagatgggtagatcacttcaggttaggagttcgagaccagcctggccaacatggtgaaatcctgcctctaccaaaaaaatacaaaaattagccagatatggtgtcacatgtctgtagtcccagctacttgggaggctaagtcatgagaattgcttgaacccatgatg

SEQ ID NO: 112827 - DNA, 1028 bp, Homo sapiens
tcattagttttcagtatatttatagagtgtgcagttaccctcactgtctaattttagaatattttcatcactccaaaaagaagccctgtaccctttagcaattatttttgaatattttatatatttcattaatatcttgtgcaaagtttcatttgaagagctatgattctctaagtaatcttctaaacacattaagtccttatattaaaatttcagttaacttcttttttttattatactttaagttctagggtacatgtgcacaatgtgcagacttattacacatgtatacacgtgccatcttggtgtgctgcacccatcaactcattatttacattaggtatatctcctaatgctatccctcccccctccccccaccccacaacaggcaccggtgtgtgatgttgcccttcctgtgtccttgttaacttcttagaaccagtttcagataagtattttggattcttagaaggatctccaagagatgaatgtgtgtacttttagaagtaaaaccattagcagtgcagaaaatttttgtgtggattgatatcagtttttagtatttattgcataaataaaaataagagttgcattaaactagtggtagtcaggtttcctatgtttttagatttctaattgtatactagaaaaagaaaacatttagcaaaataaacgaaaatcaactttaagaaagtgcaatgtggagatgattaattgatctttattgtaccttctaacactataatacttaataattctgtttgctttacattgagagaaaaaaatgaaggcagaaggggaaaatgtaagtaatgtgcttgcatttaaacttttcatgtttcctacaataacactttaaaagaaactaatttaaccttaagcatacaaatggccactgtccactatggtagcaactggttacatatggctattgagcacttgagatccagcgagtactacaggggactgaatttttaactttattttagctttatttaattttaaaaactgaggcaatgtaaaatatg

SEQ ID NO: 112828 - DNA, 1040 bp, Homo sapiens
ttctgatcacaacttatagaactggaggaattttttttttttttctttcggtgatagggtcttgctctgtctcccgactggagtgcagtggtgtgatctcagctcactgcagcctctgcctcctggattcaagcaattctcctgcctcagcctcgtgagtagctgggatcacaggcatgtgccaccatgcctggctaagttttgtatttttagtagagatggggtttcaccatgttggacagactggtcttgaactcctggcctcaaatgatctgcccacctcggcctctcaaaatgctggcattacaggcatgaaccaccatgcctggctgggtagaactagaggaattttatcagatagatgtagttgattgcaactccaactccaacttgttaaataatgaggaaggacattatgtcaaataagaggaagttcagtagtcaagcaggcttcagggctggtggattaataacttaatgttacccaagttttttccacctcttcacctttctaccttggtggaggcttaatcctcaagctagtggcaggtatcaggtaggttgcagacaagatagtgtctgtaaggaataggggtaccttttgaagaatcttcttctcctagtagatctcctctaatatgccagaggtgggtaatgtgtcgtatgtcttttcttttcttttttacttttttttttttttttttttttgatacggagtcttgctctgtcgcccaggctggagtacagtggcgcgatctcggctcactgcaagctcgccctcccgggttcaggccattctcctgcctcagcctctcgagtagcccaccatcgtgcctgggtaattttttgtatttttagtagagagggggtttcaccatgttagccaggatggtctcgatctcctgacctcgtgatccacccgactcgctgggattacaggcatgagccaccgcgcccggccagtgtttctttttttgaactgggaaagggaaagagatgaaagagattgcttttattccagtcaggcataacctagagct

SEQ ID NO: 112829 - DNA, 1037 bp, Homo sapiens
cactccagcttggtcaacaaagtgagacttcatctcataaaaaaaaaaaaaagaaagagaagagtcaagaatgacttttaagtatttggcttaagctatatgagtggaaggtgatgacatgtctgagatagggcagttatataagactgagactgagagggatgacaaggtggggtagactatgttgtagacttttgaaggaagggcattgtctttttattaccttattattatctttactccccaggtctttgcagagtatctagaacataaatataattgaataaaagttcatttcatattcattattcaacaaatcattcatattgaataaatacattgcataaatgtatagctatttttaccattggcgttcttaaaaaataagttacttaaaggttaaaaaaaggaaacaactgattaacttccttagtattttaattctctgagccttgcctactttatagagatttttcttttctttttcatgatgatgttgatttgactgaaatatagtctttaaaggagcagattggttggatattaaactggacattttgtttacatgtttttctcattctttgcagttattatgtgattacagctgtcctgctgttgggaacttggttcagtaccaggtttccaatgtgttttagttttgggaaaaaatgttttcaattgtttaaaatcttttgttttctttattgtttatggaagtccttttaggtgtttggaacaaataattctttttaccaaatgtttttcttttgcagatgataacattttgttatggggtccaaatggaaccacttagtgtagaccttggtggaaaaataccacctatgaagccttatagaatgctggaactcctaaaacaaatgtcatagtgcattcttcctgacattagtcctctagttagggaaaatgcaaagcaatcgaatgtttcatgtcttctggaagttctgtgttttgtggttgtcctttatctgccattcataagatgggtcctacctaaatatgccagccaatttctggtc

SEQ ID NO: 112830 - DNA, 3509 bp, Homo sapiens
atgatttaattatctccagctggccctgccatttacacatggggattattgcagttcatggtgaggtttgggtggggacacagaggcaaaccatatcagccattccctgctctgcccagttgtgcagctggacaggggaagggacagattctgtggtaggtcttctagagggaacatttcaagaacaacacttttagaattgcagagttattgcttgctatctttaatcttgtcccttattatgttgagtgagcaagctgcttccaaaccctgagttataccattgaaagtcctttatttttttattattttagctttggaggtgctaggattcagaaagagcacagatacaggagaataactggtcctgttactggtcctgcttctgccccttgtggaactgtttgagtctttccaaagggagataatgagccttccctcctctggtgggtaaatttagattggttatgggagtcatttctgctatgccccatatctatggtgctaaccacaatgaagctctcaaatgagtagtccttctcaaaaaaatagttacatatgttgtggttatggaacatgaaccagaacctggtggtagtgtctggaaaatgatgtcatgtgagagagcatgtggcataactccttctcagtttatacctgtattctgcttatgatgccagtggttgtggtggacaaggccaagagcccctggggagccatttcataccaaagaacttggagttaccagtcaggattgagcctcctggtaggtgtgagcctttgtgagcttgggacagggtatgaagggatcttagggtcatggggagcactaataatatctactgccacctctctctctttgtccaaaggtgcagcttagaacttactgatgcccactgcttcagagtgctcactagtacctcagttactttctgtattggccatcaggttttgagcttggtctctgaatagactgagtgttgtgggtctttaatccttcttgatcacctcagatttttacttttcttttaaaattaagtgcttaagcagaagaactctggatttcttgggcctcaggcatattacaaagcttgaggttaggaaccagtgtttgactgtaaatgcttcccttggacaatttggtggaatatacccagttttctgcattgtattccattcttctcttaattagaagtctttctgtctactttttgccaggtggtttggagcttgagatacatttccttcaattctctactaattcagactcattctatgacctatgacctatgttctatttgctaaactctcaataattctttgtttttacgtctccaagacatcctctttctataatattttcttagatatttcaaaccacaattcaagtacgttttctccaggcactggctctgtgcttccagcatataactttacattttggcacctgtggaatgcagcacagtttgtgcatttccttgctacctgttctgaccatgatttagttgttctaaagtggctactggtgaatccagtagcagctggaatcctccaaacagctcttttctattggctctgggcctttctttccatttcaaaagtgattctctgggatgcttgcaacaggttttgtgtagaaactgccctgataagttctcagaaacttggtgttgtcctatatttccagtggagtcattcattcttgaactttacaactgctccaagatcacaaggtctctgcctcactctcctctttttctctcactcatgctgagtctgcatttgcctcttagtctttgaacgtttctgtggatgcagtgggtgttcagtggtgtgatctgatgcaagtggagtcatatgctatgccacagttcagtacactgggtggtccctctggaaagacagcttttactgtgtgcagaatcctaaagaaccagatacaaactaaaatttcaagtaaaatatcttaattctgggtggcattttcataggaaaaatttaagcctcttttacttaaatacattatatcatccataacttatgctaaaaaggtatttatctcaacacaaggaacattaggacaaaaccaaaacaaatagaggttgaactttgcttttttaaaaagtctgtggcctcgtaagggttccagatgtaacacaatgtgggatacccagagcactgtgagagccgtgtgcgtcacctgcagcagcctgacttaatggcatttaaaaagttttacatgcatttattttcctacgtctgtctcctggatcattcatgagaaaactctatgttttacatctgaggttagtgtattaccagggtaattagtcattacaacctactagaaaattgcatattacaaaatccagaggatcaaattatcatgattttatttatttttgtgggcagtttctgattttgtggactggataaataacatgttttcaaaatatagccatcatggtgggaacagggtgagggataaaagactgtatattgggtacagtctatacttcttggttgacaggtacactaacatctcagaagtcaccactgtagaattcatccatgtaaccaaaaaccacttgtacccccaaagctactgaaataaaaacaaaaaatttaaaaatttaaaaaaggatggaagcttgtacataatctatcactcgtttatttaaatacatgaggacatatataaaagtgcttaatgtacctaaaatagaagtgaatgggtaacaatagctgtctctaaggaaaaggaatgggtgacaagaaatagaggagagagggagacttttttattactatataatctttttacctttaaatttttattgtgtatgggcattacctgttgtgtgaaacaaacttttttttaagcaataaataccccccaaaactccacaaaatatagcaattaaaagacatcattataagatttgcagctgtttttgtatgattgtgaatctcttacagttatagcaaattattatttcaaaataagtgtacatagcagatgagttggggctccttctgttattgatggggtttaagacatccatttatcagttaaaatatatatggattgtttttggaaacttcttttccaacccttgactcccctcttcacttacacactggtgatggttcttagttaataacctctgtttgtccttggttattaatttgaaccaatgaagaacagataggaaccagatgaagataaaatatctactttattaatgagcatgtatgatattatgaaatctatatttggtcctcatctacttccttgacatttaactcctaaaatccttggaatccctagagtataagagtgttttttgtttgctaatgagatgactggaggctggagtcccctagatagcctccaggatgggactgtttgccaggggaagcaaccacgtggtgattagagggttggaactttcagccccctgtgtccccctcacctctagggagaggagggtggctgaaggttaggt

SEQ ID NO: 112831 - DNA, 1049 bp, Homo sapiens
gctgtggtcttgaggcagaatagcttctccaggataccttagtttttgctcttaagggctgtgactaaatggatgagggccacacatgttatggagggtgatctcctttacttacagtaaactgattgtagatgttaaccgcatctacaaaatacctttactcctatatcagtatttgattgttagatgttaaccgcatctacaaaatacctttactgctatatcagcgtttgattaaataattgggtactatagcctatccatagtatacataaaactatcagtgtattacctgtaagcaaaatgcatttttaagcatcacccgtattgttgaaactgctgggggtgaggagtggaggtgactgagaaaggattctgaaaggtttcttcagtgcaagtgataaaaaatggaaattcataatatagtcctcactataatttaagtgggaaatgttattgatattgtctgaatttagcctgctgttttgtttacttttatgtacttaaacattttaatggctttcactatgtttctacaaggtcttaatttcctcagcagttaattcttttactatgaaggtttttcagaaaccatacatttatgtgaaccaaaaaaacctgataacttagtaagtcataaaatgataaaaatgctacatttttaacaggttttttcttttttaaaaatgttatttgtataaatttaaggggtacaaattcaatttttaacatgttattaatagtttatgttacttgttttgttatctgaaaattttagtgtgatgatcatattaatgttttgtgtagctataaggtagtgttaaacagataataatttttattttaaaaggaagacttgcatataggaaacaaagtcatttttgtactattatatagttgacagttccacagtacatcatctagttttgcattatctattcctgtagttctttaatgtctttgcattattattttgttttcacactagttgtctccagctctctcactctgctacccaaggagctattgattttatacatttttatgct

SEQ ID NO: 112832 - DNA, 1032 bp, Homo sapiens
cctctgagaatgccaagcccacgtccttcttgtccagaatatggatgaatttatgatttttatggaaaccaggtgattttctgcctggtgggcttgtctctcaagtcagacaaaactcagtgcttttttcaacatcgcttgccagaggctatgaagaggattgaaacatatgaaatacaatgtccagtgccttgtcagaatttgaaagtaaatgatttaacccttttatgttgctcctatgttgtggatttagcgttttaggctaaaaacagattaagttggattgtaaataaacattttgtgttgggtaaattagttaatatttcaaaagcatctcttctttgggcatgaagatttgcagaaaaacattccagaagaaaaaagtcgtttattttagtatgttgatttattgtactaatccttgttcaatataatcattgctactcagggtgaaaagttcggaccctttgctggagagaagagaatgcctgaagacttggatgaaaatatggattacaggttgatgtgggaggtgaggatatgacttattttaatgttaaaaatatatttgtattgtaccatttaatgcatttttaaggctacattaattgatattgattccagttaagtatttaagtattgaaatgttttaggtttttttttttttttttgagatggagatttgctcttgttgcccaggctggagtgcaatggtgcgatcttggctcactgcaacgtccgccccccaggttcaagcgattctcctgccttagtctcccgagtagctgggattacaggcgcatgccaacatgtccagctaattttgtatttttagttgagacggggttttgccacattggccaggctggtcttgaacttctgacctcaggtgatctacccgtctcggcctcccagagtgctatgattacaggcatgagccactgtgcccagccaaaatgttttaggttttaaaaaaagttcagcttttttttttttttttttagagaaagtggactgttgagatatcttact

SEQ ID NO: 112833 - DNA, 1046 bp, Homo sapiens
cctctttcctttataaattacccagacttagggaagttctttatagcagtgtgagaatagattaatacacttctcatccctttaaaaaaatactctggagttatggttttatatgtgaggtttcctggatctgttctctaaatatcatatttttatctggtcatggttttcacttgagattttgtttttgaatttgattctaaatatcatatttttatctgttcgtagttttcacttgagatttttttttgaatttgattcttatctctttctttcaattcattctgtaaagatatttaattgggaagttaatggtttttaactcttaaaagtttttttttttttgagtgctgtatttgaatctccttaaattttcttagataattcaggtattccctttagttgaggtattctgtctgctgcagaacacagagcgtgggtctaattcttctgccttatcttcctttttctagcagctctgctcctttgtatgggctgtatcccttggttgactcattggagctcaagactgttattgaatagtcctctgtggcgtcagtcctgcaggtggtagaaggcaaatgggtctctcttcagtgggcctgcactggcagataggctgtcagttccctgtcagtcagctttctggtctccttgtacttttgtgggcatcaagagcaggaaagattgtgggctgtgaccccctccatctctgactttcaaattctttttgggattccctggttttcagtccttgtccctggttactctgctgtcctctactttattactaagtctactggagagaacacctcacaccagatttctgccagaacctaaggcttcacttgcatccatttgcccacagatgctagtagtagttgttttgctcaagagaggaaagtaacaggtttgagggtgaaggggaaaggtgttgcattcaggtcaccatatacccacaattctttttgtcgcatctcttctgcatttccgttttgtattatttcataagtgatgcatttcataaagaataattccattttatt

SEQ ID NO: 112834 - DNA, 1028 bp, Homo sapiens
ttttaaaaaaaacataagtttacaaaaataagaaaagagtaaactcacttcatcatctcacacttctttcgacggtatcttgtggaaattcctgtatctaccttggctctgttttttttttttttttaatgtctgactatagtctatgctgtggatgtgccataatttttatttattcaggtcttgttttacacattcatttaacaatctttatcactctatatgccaagacctgtactattcactttggggtacaatagttaagaaaataggtattctggctcttggggagcttgcagtccagtgagggaagacacaagataacagacctataagataaattttatactatgttaaatattataagaattatagaaaaaagaaaaagagctaggtatggttgacttggcagaaaaggtgtgtgggtgtgtgtgtgggatgctatacatgttagatgggtcagttaatcctcactaaacaggagagatttgggcaattatttgaagggtggtaggaaattagccaaacatatatctacgggaagagcattctaagtgcagaagaggcagctacagtaaaggacctaagacgggagtttgcctgttgtggtccaagcacaaggaggtcagtgtggctggaatgcaatgagcaagcagttgaggaggaggtcagagggctaatgaagggatgagtgttaggggaagatccactgcttagagccctttaggccactgcaaagcctttgacttttactttgcgtgaaatgagagggcactgcagagttttgaacaaaggagtgacataagtttatcaagcatgactctggctgttctgttgagaaaagtttgccacagggcaagtgtgtaaactgggagagttaggattctactgcagtaatccatgtgagaggtgatagcagtttagaccaagatagtggctactttggtagtgtggggtaacagaacatgctgataggattggatgtgaagtgtgaaagaatgggaaggattcaggatgattccacggat

SEQ ID NO: 112835 - DNA, 1050 bp, Homo sapiens
aattttttgctgagttaacagacatcatctaattggcacatcctcattttacaggtgagaacactgaagcccagagagttgcagggagtcttgcagctcacagttgcctctcagattcctatgccttccacagtgtcaactccctcctttccaaaccaaggcacacaccttgattctcactgagggatttgtactaaggtcatttggtgaggtaaaatcctaagtaaaaaaaaaaaaaaaaaaaaatacctgacgtaaaggcttaaaggtgagtttgtaaaaatacagtaagattttaaaacaaaagtcaaattttacaaagttaaaaaaaatcaaagaaagaaaaaagctgaaacagataagtaaataaaagcctgtagaggaaaaatcaccatgcataaatgttaatacaggaagagcagactttgtgggataaggtgttgtgttgatcagtgtagaaggtgacttgtctgaagaaacatggatttgtatcctagggctaaaaatctgccagccaatgtttgcttacatttcctggtggccgatgataactaatctggaaacataatcagaggaaaagtaatcatgaagcctgccgtatatgctatctcttccctgtgttcacacattcacacttctccatagtgactcaaggcagctttgtatttcctggtgttattaaacattttttaaactatgtaactactctaacattttctccaaactatattttttgtgataatggcagctacaattaattcaataagtatttattgaactatggcagtttttaggcactgttttagttactagtggcagaaaagcgagtgacagagacaacagtcactagatgctttacacagtttttagtgaagtcctgcaataaacctgcaagggggctgttagtatccctgttttatagatgagagaggtgatgttgaggaaggttacatcagtcataagtggattaatgaaaatttgaactcaggtcattccatatacacttttccttaaaaatgttttttctctattctgataaaatgctatatc

SEQ ID NO: 112836 - DNA, 1004 bp, Homo sapiens
ttagttatgatcccaaaatattcagtcacaaggtcatggacaggtttgttgatctcagaaatgaccttaaagcaagcttcagttccttttccttccaaaatctgaggacgaagacaaagctaaagccaaacagcagactttagctgaattgtgaggctgcagctgagtatcaaggcatcccttacctgcttatggaaggcaaacagtccctcaattcttaggtattttccaagtaaccttgtactaggcctaattctggacataaatcaagggatctgagaagagagatttatcagcagctacattaagaaccttacttaaaagtttttatgctctctattctaaacaaattttggaagataccacttttaatacatgtgttggaaattacagatgttttgccacacttttataacacatatgcttgtataacactcctgttttaaaaagtgcttgcaattcaagccatctgttgatttcaaattcagagaatctaatccagactgaggttggggaatcttgctagaaaccccaccctcattacattcaccaggttgagatgggattttcttgctggtggtacctcttaatcctctagtcctaccccttttcgtgcagtgcttcctagagtggtggtgtctttgcagcagaatcacctaattccctggctttaccttagtcctactagatttttccttggcaattatccttttttgctggtctgttgcctctgattttttttccagtataaaaatctgtatagtgacaactcaagaaaacgaaaagagtcagttagaaagcttttgagaagaaaaaggagacctgagttcattcatacttttacacattgtgatttgctaataatcagaataaggaaaaataatgaaattgacactttttgcatgctgtgtgccagaccctgtctaatgcttgctgtgttttctcgggagcacagttgaatgcttcagtgaaaatgtggcattttaggttgcaaagtattatgc

SEQ ID NO: 112837 - DNA, 1021 bp, Homo sapiens
gcggggcaaggtttgaaaacccagagctggacaaaggcgggaacgcacgccgccgcgccggggctaggggtgctgacggcccgcgcagctcgcgggcctccgggtttgaggccctggggtcagccctgctccgggcttcgcgcccgggcgcgggtcagagccgccaacttcgggccaatcagcgagcggcgtcccggcgcccgcagcgcccaggcccgcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaaggtgggtgacccggcggcggcctgcgcgcccctgcacctcgcgcgccctgtgcctcccggagtcgccctgccgcagggcccggggcgcggcgggcttcaccccggtcgcccctcgcccgggccgggccaggcgtccgtgggaaggccggggaccgcggggcacggcgggggtggcctttactcgctgcgccacccgagcaggcagcgccacgtaggtggcggcggggtgcgctccgctgccggccggtccaggggcggaactgccaccggcctccctgccgcaagatgtctttcctctctcccgcaggaagtgagcgcggcgggagcctccctcttcctcggttacgggtgtgagctgcgtctttgcgttggcgaaggcacgcgtgggcgggtgttttcccccgcgcgcacgctgctccgctgtcgcctcttttcctttaggatgaattaatgtggctagaa

SEQ ID NO: 112838 - DNA, 1068 bp, Homo sapiens
tcaagacgtgttttttgctgccgaataaaatgttgcaaccagtctgagaaactggcttacactatttgaagataaatagaacctttttaattttaaaagaacattcatatcaattatttcatttaatctcataacaatcctgggaataattgtctccattttgtagatgaggtaattgagcttgaaggggattaagaggctcactcaaagtaccaaagccgatcatggtttaatcaggaccttttcaacttagatctttgactcagatcttactctaagttgagtgatctttttctattttgctttggcagcctttaaactgtttcaaaacttgaataaatgaataaatgcatgaataaatgaataaatacacgaataaataataaaaattacataatcgttggtggggggatggtgggggagtaaagaacagaccaaaaaataaattcaggtgtttgcaagaagactcaatcctgaattgaagaggaactcagacatgagaagaggtcacctgagacattgagctatgagctaggagagaagagacagagaaggaaaaggaaatgatatgtttattctttctccaaatcgtgagattgtggacgtgagggcgatctggctgcgacatttgtcaaccctttgatcgccagggttgattcagctgatctggctggctaggcgggtgtccccttccttcctccctgctccatgtgcatcgctcccgaagctgtgcacttggccaaagagaatgaccatccccgatgaaggaggaccggtctttggtcaacggtatatgagtagctgcgctcccctgccagaacctccaaacaagctctcaaattactaaattatcaggaaccactgtctttggagaatattttctaacctttccggaggtgtttttgtgtgttttggggggccttggattttacaagagggctggtagaataaatacatacttgaagactgttccttttaagttactttcttttacaaaaacaagttaactgcatacttgtgtgccctccccttttttctggaaataatatttccagggcgtggaaagag

SEQ ID NO: 112839 - DNA, 1445 bp, Homo sapiens
caaagcaagatttcaattgagcagaagcttttagtttagcatgtttgtggtttggctggcccaaaggacactagagagtttacccatgcacttttagcttgaaacattaatttatcatgcatgtctgcatgtgagacaagcagatgcaaagcatgttctgcccttctgtctcggagggagagccatgacagccctgcagccccagcactgcccgtgttagctgatatataccaagtgatagaaactattctgtctagaaggcttgatttgactatagttgttaaagttgcctgattctttgtgttaccagagggaatactgagtgtctgaggttacattggtaggaaactccctgcataacattcctgatgtgaaagtcacagagattacccacttgggagaagagtcttatgaataaaatttgttgccagttatttagttttaaaattttctatggcttctgtgagtcatggaggttaatggaatacatttggtttcagggagatacatctggggactataagaaagctcttctgctgctctgtggagaagatgactaacgtgtcacggggaagagctccctgctgtgtgcctgcaccaccccactgccttccttcagcacctttagctgcatttgtatgccagtgcttaacacattgccttattcatactagcatgctcatgaccaacacatacacgtcatagaagaaaatagtggtgcttctttctgatctctagtggagatctctttgactgctgtagtactaaagtgtacttaatgttactaagtttaatgcctggccattttccatttatatatattttttaagaggctagagtgcttttagccttttttaaaaactccatttatattacatttgtaaccatgatactttaatcagaagcttagccttgaaattgtgaactcttggaaatgttattagtgaagttcgcaactaaactaaacctgtaaaattatgatgattgtattcaaaagattaatgaaaaataaacatttctgtccccctgaattatgtgtacatgtgtgtttagatttattattaaatttatttaacaatgttctctctttttaagctaataattgacagtggtgttagttgagaactgaatttacagttggtcttttgggcagtaagaaatgcaaaccatagactgaatttccttcatagtacatgatttttcctaaatataggaaagatcgaaggggtctctggtttatttgcaccatgtttatttaggcatctattaaagcaatgcttgtggtgctacttgcttagtagaaaagctaattataaaacttaatgcaaaaattcagagtactacctttctctttcctctttcctattgtgaacttgcctcccatttactgtctgtcactttctttgagataaataaaaaagacaataattttttctagaaagaag

SEQ ID NO: 112840 - DNA, 1065 bp, Homo sapiens
ttagcttacagctctttagcctctggtacttttgtgtttttatagaagtagagctataagcaggaagcagcacttgatttttaattacttaatcctttacatatcaaaatagcatttgaccattgtattgtttattttcttagtgaaatctattcgaagtatacctgcctaccttgcagagaccctctattatgctatgaaggtaagtggagaccatgaaccttctatctaatacatttctctttctaattattattcttcacttttgtttatgttttagatgatagaccttgggaatttttcccttataacattcaacccagttctactaaattgttataccttattgattcacccgcacccgggagcatttgatcctatgtttgaagtttttaagcattttgcttctctctttttttttttttttaaagggagctgggacagatgatcataccctcatcagagtcatggtttccaggagtgagattgatctgtttaacatcaggaaggagtttaggaagaattttgccacctctctttattccatgattaaggtagtagaacctttctttaaattacgtttgggaatccaaagcagactggtatgttgcatgaaagacaaggataagagaacctgattcttgtgttaagtttaaaattttagtgacacgattagagcaatgagttaaaaagcttagcataatgtttcctgaagtagagatgatggctcccaagtgaaagcatgggtattgatgtggctgaggctcttggtgaactcagaagcattatttagtagtggtaacagatgactcaacaaaccaaaccccttgcctatgataataatgtgttctttctgtcttttatcaattccagctgtctttattagtccttcttttatttcatatcagcttttcctttctttatcgtctgttatcaccttatctctgatgctggtttctaattcaggaaagagccaaccaggtcatattgggagtaaagagcccctaggtattagtatcatttttgttctttttaaaacaaggtgctctgtggcctataattaca

SEQ ID NO: 112841 - DNA, 1194 bp, Homo sapiens
ttaaacgacccacatagtatttcagatgtttggcttaaattttctaaaatatattttttgttgacaaagtacaaggagtaactgcgtgttttaacagcaagaaaaaataatttgtacacaatgttacttttcctgataaatagccactggttgtaatcagttaggatttatttttattttaaattcactatcaggtttggcaaatacgtgtagacctacatttattaaatcatgatggaaatattattgatgctgccagcattgctgcaatcgtggccttatgtcatttccgaagacctgatgtctctgtccaaggagatgaagtaacactggtaagctcctatgtgaaccaggatccttgatatgaatgaatgaggagggtcttaaatgtgcaggcaacttgtttttagtgaagttatgttgtagatggcaattgggtcgtttctaaaaatttgtttgtaagactgaaactgcatatggtcaaaattgccctggaaatctcttaaccgttcctctgttgaaacatttgtcagtaagaacataccctagcctggttttccagaatagaattagatgactattttggattgaacattagatgaagtggttgacttatgtttaggggccatatgtgtgaaaaatacatgaatctcagcacagtgagatgcttaccctgcaagaggcatgcaatagctgaaaagcactgaggaatcagcaggttcatatttgtctccaggacttttgttcattaggcaaagagatgacgaaagtccatcagaaatacctggagggcttgttaaaacgtatagccagactactcccaaagtaaaacagggctaggacttaagattttgtacttctaactttgagttcttaggtaatactgatgttgctggtccagggagcacattttgaaaaccattgacctacgttgtctttatcttttgttctgagtatgtcagttttgatttatataaattacatgctagaatagtgaaagtgcactgtagttgtagtttgaatcctgaagttgcaaaaggacacatcagatgcccagattttctaagcaatgattcataattttgattttgggcagtagactgaagcagaaccattaaaaagtgagaaatagggacaaaggtttattaacagtagaggtaatattcttttagaggagggagtttatataaggaa

SEQ ID NO: 112842 - DNA, 1261 bp, Homo sapiens
agaattgcttgaatccgggaggcagaggttgcagtgagctgagatcgtgccattgttctccagtctgggcaacaacagcaaaattccatctgaaaaaataaaaaataaaataaataaataaatattagccgagcttggtggtgcatgcgtgtggtcctggccacttgggaggctgaggtgggaggattgcttgagcctaggaggtggaggttgagtgagctgagatcgtgtcactgcattccagcctgggctacggaatgagaccctgtctcaaaagcaaataaaaatttttaaacatccaatagtagacattatgtaaaaagatagttttacttgcacttttagaactacaattggcagtagttctgaaacccagctatatatcatattcacatgggagcttttagaaaatagatctccatatagcatacagtgtagatgattaaaagcttctttagtttgaattctagttctgcccccatactagctgatcttgggcaaatgattttatatctttgggtctcactttctttatctgtaaaatagggaatgatgttattgccaacaccttgttgttataaggatataaatatattgcacagtgtctagcacacatttattaagtgtgcaataaatgttagtttctggtatcatcatcatcatctttaccagcatcacaagtactacccagattacccacagaaaaaggaagttagtgcatcctggagcatatatgtgtctgtggcctcttctgtggtatcttttatactgttgtataagaaagtttttatgtctgttcccttgatgtgacagtccttcacatatcttaaaacaactttcacatcttgccttaatctgtgtttacattgtattcatgtttggaaaagtcaggcttaaattataaaggtagaaaaatttcatggttttagtttcattagagaaaactatttggtttattgtctttaaacaacagaattcacttttataaataggttctgagatgcagtaaaatcgctggtgtgaaagtagcagaaattacagagctaatattgaaagctttggagaatgaccaaaaagtaaggtaagtaacttttccagaactaagtggtcttttattttcattttttaaatttttattattttttttagtataagcaagctttattatgcatgaacttgatttcacatacaaagttagaatggcaatttcaattaaaattgactcattaaaaagtgtaaataccatggtatagttatgtta

SEQ ID NO: 112843 - DNA, 1034 bp, Homo sapiens
ccttcagaagtgtatctttatttggtggtttttgcagtaacaagattcataacacttggcattataatattaggctatatgaaggatgtgtatactgaaattagtttttgtaaacactgtactttgttagagaaaacacttaaaatacaagatagagatgtgagtcatattctgttgatggtataacattcagcttctattcagttatcctggaaaaaacagattttaaggaccaatttaatttagtactataactaaaatgttgagagaatctgtctcttcacatttcttattaattgcatccataaaatcttgcctgagttttttttcttcttcattgttcagccatccatagtgtagctatattaagttttttttcccctaggaacttggggcacacttgaatcaatcttacaagaagaaaactttcattctcatcttcaacagttcatcaaatagcaatatttttgttactcagttttcttaacttgttaagtgtttctacacctgtgctatggactcctggaactgcccaaattggagagggagtagaaaactcctggggtgatcttgaagactctgagaaggaagatgatgaaggcggtggtgatcaagctatcattcttgatggtataaaaatggacactggagtagaagtctctgatattggaagccaaggtaggtgacactttatggcacacttactatatattacatacatatagtattaccgtatagttatatatataatgcataaaatgtgtgtatatttatattatcactgtatatagtaatatatagcatattagctatatagagatgtatagtggataaataacatacaggatactatatagagagaatatagatatgtagttatatatagggatgtaagtattgcatttttagaggggctaaatattgtgatttaaatttcaactaaattattgtggctagctgcaatactaatgctactttctaaaagaatatgcatatctttgtagagtagtggaacactggcataaatgatagtg

SEQ ID NO: 112844 - DNA, 1854 bp, Homo sapiens
tgcacaacagtcaataagagaaaagtacaaaaattcaaagtaagaattaacttggatattgaagcttacttttctagattatggttcagagatctttgacattttaaccttattcatgaatctgccatagcctccttgagaagctgttctctaaattggttatgtgtttgaagaaggttgtagttcatgctttctgccctgggtctgggggagaagagagaaggaagggggcatgcatgtgtgtttcagggaccagacagtgtttctaaaaccatcaagtcggtcagacagaaatagcattttttagttcccaatacatgagtacaaacattattccatgatctcctttacccagtgagtgtttactaaaaatgctttttttttccctacttacaggtatcatggtgtttctctcctcaacccaccagagacactaaatctgtaacaatgaaagactgcctttgttttctaagatgtaaatcactcaaagtatatggtgtacagtttttaacttaggttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgtcaggataataaattgatttggaaaactttgcaagtcaaatttaacttcttcaggattttgcttagtaaagaagtttacttggtttactatataatgggaagtgaaaagccttcctctaaaattaaagtaggtttaggaaaacagaccctcaaattctgacattcattttcctaagcaactggatcaatttgctgacttgggcataatctaatctaagcatatctgaatacagtattcagagatagatacagtagagattccccagactttttcgctctttgtaaaacctgtttgtttaggttttgcgaggtaaactcaacagaggttgggagtggaagagggtgggaagcttatatgcaaattaacagacgagaaatgctccagaaggtttattattttaaagcacattaaaaacaaaaaactatttttaaaatcctgctagattttataatggatttgtgaataaaaaatacccagggttctcagaatggaataaatatcccttttaatagttatatatacagatatacaactgttagctttaattggcagctctcttcttttttcttcttttcactggctttttacttggtgctttttcttgttttgcactggtggtctgtgttctgtgaataaagcaaagtaagaatttactaagagtatgttaagttttggattattgaaataagaggcatttcttagttttccagtaggatctaaaatgtgtcagctatgagtaagactggcatccaagaagtttatattatagatttaggtcctaatttttataaatcacaaggtaaaaaaatcacagaacagatggatctctaatgaaaaagggatgtctttttgtttatagtcatgtggcaagatgagagtaaaaccagagagcaaacctctataagtgttgagtatatgtatacatttgaaataaaccagaaatttgttaccttattttctttggattcttgtctggttccaaaatgatcatttcttcttcttcactatctgagagtattatgggagcatctttgtttttttattaatttaaaaaaaaaaaaaaaagttaagcaatctcttgcaaaatttatttctacatgaatttatttctatcagacgttctaaactcttatttctggggctgggcgtggtggctcacacttttaata

SEQ ID NO: 112845 - DNA, 1050 bp, Homo sapiens
caagagattgcttaacttttttttttttttttaaattaataaaaaaacaaagatgctcccataatactctcagatagtgaagaagaagaaatgatcattttggaaccagacaagaatccaaagaaaataaggtaacaaatttctggtttatttcaaatgtatacatatactcaacacttatagaggtttgctctctggttttactctcatcttgccacatgactataaacaaaaagacatccctttttcattagagatccatctgttctgtgatttttttaccttgtgatttataaaaattaggacctaaatctataatataaacttcttggatgccagtcttactcatagctgacacattttagatcctactggaaaactaagaaatgcctcttatttcaataatccaaaacttaacatactcttagtaaattcttactttgctttattcacagaacacagaccaccagtgcaaaacaagaaaaagcaccaagtaaaaagccagtgaaaagaagaaaaaagaagagagctgccaattaaagctaacagttgtatatctgtatatataactattaaaagggatatttattccattctgagaaccctgggtattttttattcacaaatccattataaaatctagcaggattttaaaaatagttttttgtttttaatgtgctttaaaataataaaccttctggagcatttctcgtctgttaatttgcatataagcttcccaccctcttccactcccaacctctgttgagtttacctcgcaaaacctaaacaaacaggttttacaaagagcgaaaaagtctggggaatctctactgtatctatctctgaatactgtattcagatatgcttagattagattatgcccaagtcagcaaattgatccagttgcttaggaaaatgaatgtcagaatttgagggtctgttttcctaaacctactttaattttagaggaaggcttttcacttcccattatatagtaaaccaagtaaacttctttactaagcaaaatcctgaagaagttaaatttgactt

SEQ ID NO: 112846 - DNA, 1055 bp, Homo sapiens
agtaaaggctgggtgcggtggctcgcgcctgtaatcccagcactttgggaggccgaggtgggcggatcacttgaggtcaggagtttgagaccagcctggccatcatggcgaaaccctgtctctactaaaaatacaaaaattagctgggcatggtgatgcatgcctgtaatctcagctactagggaggctgaggcaagagaatcgcttgaacccaggaggtggaagttgcagcgagctaagattgcaccactgcactctggcctgggcgacagagcaagactcttgtctcaaaaaaaaaaaaaaaaaagaaagaaaaactaaatttaaaaatgaaaacatgaaacatgttttcctaagacttgtatttcctaaattttcagctacttggtgaactctggcattgttcccatctcgagaagtctcatgcctttcatttacttcctttgactgaactggggaaaatatctcaaaagtcctttattgatttgggccttttaattagcaattagctatccagtctctactagaaatgatgatcaagtgtctggaaatgcagttggtgtggattttggattcattccatattctgctaatgggatttcagaactgggataaggaagcttgcttctcttttaggactgattacttaaaacttttttcattgtagaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatggtgagttaactttcattttgttgaatggtgattctttggtaataattaggggtaagccctaattcctttgtaaaggaacctagttcctttgtacagcagtggtgaagagatttagtattcagagggagattaatgctgcagtatggaagaaagcctactgctggcaaaagataatctata

SEQ ID NO: 112847 - DNA, 1036 bp, Homo sapiens
ctcagcttaaaataatcggaagcgtcgggccctaaatcctacctctccccgccccgcgcaggcgttttctcccgccccagccagtttgtttctccctcctgccccgcccctgctcagtttcctttggtttacccttcactcgcctgcgaccctgtcgccttgaatgacgtcaaggccgcgagcgctttcattggtccatttcaatagtcgcgggatacttgaactgcaagaacagccgccgctccggcgggctgctcgctgcatctctgggcgtctttggctcgccacgctgggcagtgcctgcctgcgcctttcgcaacctcctcggccctgcgtggtctcgagctgggtgagcgagcgggcgggctggtaggctggcctgggctgcgaccggcggctacgactattctttggccgggtcggtgcgagtggtcggctgggcagagtgcacgctgcttggcgccgcaggctgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggtaaagggatgcgggatatctgcaggagggtgggtcgagcagggtttggcattggcttagcaggcagagaagagtggcgagaaggcatgtcctgggcttttggaagggggccagggtctggagtgcagttggtgctggtgtgtggtttgccacagtaggagttctcccatattagcatcaggaccccgccaacactgtgtgtatgctgccggtctgctctctatagggggcatctgcctgtacataatggggtcaaaccaagctctaaaacgtgtagtcttcgctcagctccgcgcctttctctccacttttaaaccccaggc

SEQ ID NO: 112848 - DNA, 1083 bp, Homo sapiens
atgaatcttttcctttgttcattacacagatcccttctaagctcctccctagacttttcctcctaaactgtggctagttaagcctcatgttgttctatcccaatgactgtttactccatttgcatgtggcccttccccttaactggagctctaagcaatgctgtagttcagtctcagcagaatcctctctaactcttggtagttaagccataccactggctcatgatcatccttgtggtccccaaaatgctaatgctctgcagcttcctttttattttttatgtctcccctaatgtcttactgaaagttacgtgtttactggcttcacacattttgtctcttttcattaagactaatatgttctgcaatattagtttctcttctcattagtataagaagtttctcttctgattagtactttatgtaactgtaacaagattcctgtgttaagattattttgtagcctaccatgatatttaaaactctctattaatattgctagtatgggaatgagtagatattttaattttggggttaaggataaataatgtggaatcatttagtcagtcatagaagcaaaaattttgctccctttgtttttattttattaactcaaccaataaaaacccattttgtaaaagcaaatgtctcaaatttttgtaaacatcctaacgacctcaaatgtttatacttatatttgacaaatttgtatgtgtttttctccaggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacaggtaagcaaaatgtctaatttcttagttttatgactggatctattttgcaaaccagtcatatgtactaattattattgaacatttttagttttagacagtaattttattttatttttatttttatttttatttttttgagacagagttttactctgtcacctaga

SEQ ID NO: 112849 - DNA, 1058 bp, Homo sapiens
acgcatgcctgtaatcccagctacgaggtaggctgaggcaggagaatcgcttgaaactgggaggtggaggttgcctgagccgagatcatgccattgcactccagcctgggcaacaacagcaaaactccttctcaaaaaaaaaaaaaaaaaaaaaaagaataatcacattcctgttattttgagccagagtatagtaattgaaccttagttagtgcttacatttagaatggtgaaatcaggacattacaagtatgatccattctcttacattttagtagaaatgtgggcatttttgttgtatttttgcattctcatcattgaaggaaacagaaaggtgatttaatcaacttcgtttattaaattcaccctttttttcccttaatgatttctgttgcaattttataaatctctgattctaaatttaacctttgaaatcttttaggcctttagatgttgttctggaaaaactttagtaatggatcaaaggaagaatgagagtattgttcctagtataactcaattagaagattttcttacagaacacaattccaatgttgtttggctccttgttggtaagtggaatatttttcttctattttattgtgttttaagtatggattaacagctgccagattttaaacagtggttgactgaagttggaacactaacactaccatttatttatttttaggaaggaagattgttatttatatttcttgaacatttgttctggaaactgctctgaaatgctctactttttcttaggctgcattctcatctgacttaggggaagtggaaagagaagaagaacactgcacttagcttatctttctggtttcaggtcacctccccaacttctcgactcaacacacacccaaacacttttgttttgttacagaaataataaatcctcaaatataattttactgtaaaaataattctatttttatagtaaaatagaattatatgcctaatcttttaatctctttcctcattccttgtgcacttggcagtgagatctgctattaataattttttggtataatctagaagttttc

SEQ ID NO: 112850 - DNA, 1086 bp, Homo sapiens
tctagttacaggtggcctatttgatatgcctttatactaaattccgacttcttttacttaaagcacagctttaaaaagcagaaggtttttctttaaagcagagattttaaaaatcattacttttcttcctttacaagtggctatagcttgtttcaggaaataacttgggaatgaacttgtgtatagatgagtttttggcctaataaaggtgaatttgtttcagaatattcagaaatatggcctttcttctcccaggccatattttttacataatgtttattaactaaaacagtacaaagcagtgataaagtaaacagaaatgaaagcaggcatacttgaaacattgctctaatggatctgatcggaatttatgcttttctggattatgaatgaagaagaggaagaaagctggataaagtataatcaacctctggttttaaaattccaagtattaaattgtaagaggacacattactgtgtagaagtaaatcctattatttctgatttttttcctcccaacagctaccattttgtcctgtggatggattatttacctcacatattataattcccggaatgttggtcttattttaacactagttcttaacagattatacaagcatggctatatccatattggtgagtttgagttaacactgaatttttttcttccttataatcttgagatgttgtcttaccattttttgttgctataactgaatgcctgagactaggtcatttataaagagaagcaatttatgtctgatagttctggaggctgggaagtcccaagttgagggggtgcatctggtaaggacctttttaccagtggggactctgcagagtcttgaggtggcacagggtgtcacatggtgagggggctgagcttgcttgctcaggtctctttttcctcttgtaaagccactgatgtcccaacatcatggcctcatttaatcctgagtacttcccaaatgtctcacatctcaaatactgtagtcagatttcccacccttctaacactgttaaaatgagaattaagtttcaacgtgagttttagagggaacaaacattcaaaccatagcagat

SEQ ID NO: 112851 - DNA, 1109 bp, Homo sapiens
gaaaaggtcttcctctgccacccaggctggagtgcagtggtgtaatcatagcttactgtaactcagcctgaggcatgttcccacctcaggccaagtagctaagcctactggcatataccagcacacccagctcattttttaaaatttttatagagacatggtcttgctaatgttgtataagctggtctcaaactcctggctcaagcaatcctcccacctcagcctcccaaagcactgcgattacaggcatgagccaacatgccttgcctcaaaaggtgctttttaaatgcttacagacttgctatttgttcaatacttttctaaggtgatttttggaaggaaaagagtgatttacgcattttgttcaaccttaaaatttttaaacctatttattatttttatttaataatttaacaattatttattcaacatcttctatgtactagtcactgttttaggcaccagagatatggcagtgaacataggaaaaattatgcactaatgcagaagggtgcattctggctgcagaggtgaaaataaataataaaataataaatgagataataatggaataaaagctgaaaaacaggataaggaatgttgaggaggatcttacaatattttagtattcagtatttagtgtttatcagtgttgtcaacgtacattcagaaattaatacctttctctttatgccttggcgtctccaattaatgaagccatatcttatcatagctgttatattgaaaggagagaatctgtcgtacatgcccagcaagttagagacggatttgagagtaatcctgttttcatttttatacagtcaccgtttgtttatgcatcactgctgatccaattaggggcaggtccaggctcttaatttccctcattgctgcttctgcagctcaccaactggcctttaaagtgtatgcctaataatcaggacatttgtatgcaggtatcattagtaaactattgcttatgtaaatttgaaaacaaacaatttaaaagagtttcctggtaaattttgattgagttgtttataaccttgaagaatctcataagaattaatttctactggtataggtctatctgggaatagaaacatatc

SEQ ID NO: 112852 - DNA, 1050 bp, Homo sapiens
ttaaacattttactgcatatattttggtataaaaatatggatatattagggtaaaggtgtacttttactctttaagtggtactttactgttcttagcataaaaatctttaaattttttcagtatataactggaatctagaaattaaagttgtttttagaatgctaaattaaaatataacagaaacatcaagttttttctttttttggccagtgttttgtatttattttattaatatgcttctctgtatcatggaattctattttaaaataaattgaattactttgggtgtataaaaatgtttgagtaaaaactttgaagttcttaaaaagttgactaaaaatttttttgtaattggtgtctttagatccaaaggcagaaaccaggttatacatcacagtcaatgactttgaatttcatgtctataatcgctcggatctttatggacgccttcaagagttgtttggtttggagccaacaataattccacctaagaaagatgatgataaaacacgggaaattggaagaacaagaacccaatcgaaaattgaaaggttcagtatcatacttgaattttattaaactctagcatttaaacatttgcctttattagaatatcattgaggctatgcacctaaacagagcctaatatttctttgcaaattaactgaaacttttagtaacataaataattatataattattttagaaattgagataatatagaatatgtaatctaaaaaagtcccgttctattcccttgcacacaaatcctacttttctccgtattaataactaatgttatcaatttagtttttatccttttgaatgtatgtacataaatgtatacatacatatttaaggtgcttataaaatacatgattttgttctgtgtgtttctaaacatatgtgtttagaatatgtgcctcatatagtgtgtattgttctgtaatttgctttttatgtagcagtttgtctgtaagattgttccatatctgtatatgtaggtctgcttttaaaaatacatatctgtgtatgtaggtctacctaca

SEQ ID NO: 112853 - DNA, 1173 bp, Homo sapiens
attttttcttgttagagttaaagtaaaaacagaatcccaagaccccacatcttcatggagatcacttattccagtcataaaggtcaatgtgagcacagtaagtaaattctgctacaattactgtttcatggggtagtaatgtagaacttttaatttttgcaaatatgattttaatgtaagaaaattaaatagttttgtggagttttttttagttcccatttctgtatagtgtgagtgaaataattattttaaaatactgttttctgataaatttgtgtttaaatttctttaagtacttaaattttcttttaactactggtttaaattgaccagtggaatagtttaaatagcacatagtcctaaagtggaatcattaagctgttgtttgaaaatgtttgttattagtttagctaaagaaagaaatatggccagaatagcatgatataatatctcttatctgtttatttttttttttttagggacgtttggcctttggaaatcactaccagccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgagtaagaaaatcttataaaaataataaaaaacttcttataggtaatacagatacagctagaaactttaacatccttttactttttttgctacaagttgtacaaaaattaggtatatttctctattaaagcagttaacaatgtagtccttctttataggataaatggatatgctatccagtgataaactctaattttaaatatttttctgcatgattataactataatttttttatccttttctccttctaattgtattttggaaacttactttgtgcaattagttcctgtttgtatgttaggagatacacattacaggtaggtttttgtttctagaagatgtgactaaagagtaaattgaacagattcattgcagtggaataccactttgagttattgaaagtcgaaaattgaatcgaaattactcttggaaaatttggtgaagttaagatggtatagttttgagacccacttgacatttctttaagttccaaactgtcag

SEQ ID NO: 112854 - DNA, 1733 bp, Homo sapiens
tcatatggagagttttcagtacagtgtctcagcttttatctttgtgtgtaggtaccttatgaggttttatgtgaaacatgattattcctttttagttgtaactcttggctggcctggtattcgattttccaggatttggctagaatgatagaaagagggtttttcctttttgagtatcgcggtgactgtgggtcttcctggcctcactcttcaagatcatggacttggttaagaatcttctggaatgtggactgtgcacacaaatgtgtatgagtgaaggtataatactgaataaatcaggatttttttgaaaaattatagagagtaagatgaaaaagtgtcttgctattaataatttgtataaaaagatttaaaattgtatttttcacttaagtgtggagattacatgatgatattaaacattaagctttgtgatttaatacatatttagaaaaaaattgcaagtttttgcatttaatatcatctaatgattgagaagttaattttgatatgcaagaagatattgtgatgtatgtatgacaaagagaaaagttgtttaatcaaagcaagcaaagattaatggtttctgggaaattattgatggtagaaaaacgttcattccagagttagagttcacgatgtttgctctagatttatttcaagttgattaaatattcatggaaataggtaataagaagataaaaatgataacttttttattatttaatgtttttgaatgattatagtttaatatacagatagataaaatgatacttattagttattaatattaagtggtcaaattttaattttgttgtaaatgcagaatatgatcattttattccagtgatcatcattccattgtatttaaactttgttttaaatcgatttctctcattcaaaactgaaaatgaaaaatataaaactaaattttttctttttaaaaccaaatttttttttcttcttgaagtaatttactgataaatttttagtatcattttattattaagtccaacatagaataaaacatggaacaatttcttaggatgattgttcattggaaagatgtttttctttcttttcaggatgctacttgttatgtgcttgttagtttttttttccttttcttttcacctattgccagcattaactaggatactgaacattttatattctggagatttgtttagtttgctttcccctccaccttcttatagaccaccgagattaatgggagaaggttttgtggtgatgcagtcaaatgatgttgacatctactactacatggatgagccaggtattgttgttgttgttgttgctgttttttttaaagtgacagagtgagactctgtcacacaggctggaatgcagtggcgtaatcatagtccactatacccttgaccttccaggctcaaacaatcctcctacttcagcctcctgagttgctaagatgacaggaatatgccactatgcctgactaatttttaaagttttgtagagatggtatttcgctatattgcccaggctgatctcaaattcctggccttaagtgatcctcctgcctcattctcccaaagtgctgggattgtagtcatgagcccatggtgcctggcctgtttttttttaaaagtatgtttcatagctacaattctatttcttctatgaaatgctgatatctagtaatattttaaatcttcttgcttagccatcaggaaatggtaaatgtagataag

SEQ ID NO: 112855 - DNA, 1077 bp, Homo sapiens
tgccatgcactgctaagtgttttccatgtgtcttaccatttaaacctctgagcctttgtatgagacaaggtatattattcctgtgttacagaagaggaagcagctcaaattttctggggaagattgagtaacttgtccaggttggaatgatgattttaattaagctatcctctgtcagttctttgtttgccatttgagcaatttatatacttgtagagagtctttagtttgtcgtagtaatcttgaatagtgcaaattttctcttatgtctcatttgataatagtatatctattgagtaatcaaggctcattgatctctggaagtgttaaatactacagaaaacagtctaattgtcaaatgtgatagcaatgataataaaaaattagaatattgattatgttcctttatcagaagtaattttgtttgaataacatgtcattattctttctacctccttaatgtagagattgtttgtggaagtttttctttccacctgactatcaagttctgaaagtttctgaaattgcacagcctgggagaccaagacagatccttgcttttgaattacgaatgaatattattgcagatgctacaattgatttgctgtttaccaaaaatagggtaattattataataatatagtagaaaatagtatttaaaattttgacattatttttcagagttttttcctggtgactagtcccatacttggattaatttatatgagctgttttcccttgaaataattttatgtattttactatcatcataattttgttaaatgtcaaataatgggaagaaattaatagtaatagaccttcatgctatattctggctcattttctcctttatatctggctaaattgttttagtgtatttttggtaaaaatttgaacttttgttcttaggaacttgtaatacttacttaacatcaataatttcttctgtaataataactgaaaagtaaagatgggagaataattataattaatgttttatatgaattaatttttttcttttggtaggaaacaaatgctgtacatgtaaatgtaggagctggctcatatttagaaatt

SEQ ID NO: 112856 - DNA, 1098 bp, Homo sapiens
tctcaaaacaaaaaaaaaaaaaaaaaaatgccaaactgcagaaatactaatgttactttgtgtgacagtacgcatcacactctatcttccttcacactgagcctgtcacttaacagatgaggcttaaggagaaattagggatgtcggttgttaccccattggtttatctggagtgcagtatcaacactgtagcctgatttgttgttctgaaagttttttgaccacatcttgacttaatatttcaaggagctagatgtagccatggatattgaccttcagccacagcaatattaaagtctcaaagggaccttctgttcagctcagtaggaaaatgttttaattactcactagcgtgtgtaacttcatttctaatgctgttcacacagtgtcacattttaagccttaattacttttacctaacatttgttttgcagttccacatcaatgccagctacccccgaatatggaacatgccgcagacatggcagtgtgaattagaggtttataaagccacttaccacttcatctttgcacagaaaaacttctttacaggtaattttctaatagatataaatacagtgagatttatcacagtgaacttgtttacatttgataagttttacttttaaattacatagggatatgatatgattcatattttcttcaacatttcattttgggctgaaaatgttaaagagaaaatttaaatatagacattttgcattcttttctaacctaaacaaggaaaatataaaccccaaattgagcttagaaggaaatgaaagaactcaatttaggctgctgctttgtatcagtctagttggagggtaggatggagatgatgaatcaatttctctctcttcccaaattaggcatcagcatggcttcattattttgttttaataattataatacacaacagtatacgcaaatagctaaatgttatttttatacttggagcccttatttaatcttttctgttggcatggataattgagttggtgctgtcactagttggaagaaacattcctttatttcttgcagcatttattgatagctttgcatattttgtgactataagaacacatattgttggtc

SEQ ID NO: 112857 - DNA, 1047 bp, Homo sapiens
tagtaaaatgataaagtcagaatttaaacccaggactgtctaatgtcagtctgtgctataataatactgtttccaattgtttctctctctctctctctctctctctctagtgtcaaagtctgtgctataataatactgtttccaattgtttccctctctctctctctctctagtatcaaagtctgtgctataataatactgtttccaattgtttccccccccttctctctctctctctctctctagtgtcaaagtctgtgctataataatactgtttccaattgtttccctctctctctctctctaaagtctgtgctataataataccttttccagttgtttctctctctctctttctctgtcacatacacacacacacacacacacacacacacacacgttctaattttatgtacatggtattgtgttatgtactgtgagtatacaaaggtgagtttgacacctctaggaggagcccttttattgaaagacattgctgggagtgtacaatgcatgtaaaacattgtggaggccagaagataaagttgtacaaactgctatggtagatggtagatcagtgctaatgtctttaaagagcttttatttattgggattaaaaaaacttaaagtaccaaagggtaaacagacaaaatatatgaacacaattttaaaaagcagtttaaacatacagtgaattggcaatgaacaaatatgattgattataattctaagaaagtcaagtctatgtttcattcaccattgtagtcctagagtctagaacagagcctgagacacagtagacagtagatatttgtttaattaataaaacaacatgaaaaattgttcagccatgcttgtagttaagaagttcagtgaaagcgagataccatttttcagttattaaatgtcaagtaaaacaaaacaaaaaacagatagatgatagaaagaaatagaatgcagaagaaagttcagtgaaataggtagtcaagcatacctttccggtaggagtgtaaatggactcacttctcttcgagtgcaatttataat

SEQ ID NO: 112858 - DNA, 1010 bp, Homo sapiens
aaaatatttgagttcagtgaaagaagcaacacataaaaaatgtgcatataggatagtgtcagtctgtgtagaaaaataactggaagaaactgtatccacaatgttggctatttgggtagtggaacagcaggtgatttttttttaattttctaaaattccttaaaaatagatatattaatatataaaatttctcttatttggaactgtgattagtaagtaaacatctgtttactgtcaaattatttaaatacatcctaatcaccttttaaatatttcagtataaaatttttttagttacacaaaagaaaaattcatttttgactggtgttagaaaatctgtgttttacttttctgagtttcaactaactttacaatttctattcactaccccaataattttagatttaattcaagactggtctagtgacagtcctccagacattttttcatttgttccatatacgtggaattttaaaatcatgtttcatcagtttgaaatgatttgggctgctaatcaacacaattggatcgactgttctactaaacaacaggaaaatggtaagacattaaaaaaaattaggttaaatatttctctcattaaggcaaataccaactaagaaaattagtattgatttgatagttttaacagatactagaagttatttccccccattatctttgtgagactctcagaagactgtttcagagtttgtattggactaaaacttaattttgtttagttgtgcattttaggcaattttataattgaaatttaatggacattaaaagtaaatttactttttcttctttttttttttttttttcttttgtagtgtatctggcagcctgtggagaaacactaaacattgatttttctttgccttttacggactttgttccagctacatgtaataccaagttctctttaagagtatgtatagttgaatgcattatttattccacaggtgtattagtaaatttgatttcccaaagcttatcttcactctctt

SEQ ID NO: 112859 - DNA, 1518 bp, Homo sapiens
caggagtttgagactagccttggcaacacagcaagaccctgtctctaaaaaaaacaaaaaacagcacattcctctagtcccagctacttggtaggatcacttgagtgcaggagttcaaggcttcactccaacctcagtgacagagtgagaccattaaaaaaaaaaaaaaaaaaagataaataatacaataaaataaaaataaataaaatttgttaattttctttcaaacttatttccaagattgttgtagacaggtttgcccgtaagtattaaccaacatatttatgcactaattttattactttggcttattataattattttttagggagaagatgttgatcttcatttgtttctaccagactgccaccctagtaaatattctttatttatgctggtaaaaaattgccatccaaataagatgattcatgatactggtattcctgctgagtgtcaaagtggccagaaaacagttaaaccaaaatggcgcaacgttactcaggaaaagtgagtacgtaaaattagtgacacaggccaggcacagtggctcacgcctgtaatcccagcactttgggaggccgagatgggtggatcacctgagatcaggagttcgagaccagcctggccaacatggtgaaaccttgtctctagtaaatatacaaaaattagctgggcatcatggcgcatgcctgtagtcctagctacctgggaggctaaggtaggggaatggcttgaacccaggaggcggaggttgcagtgagctaagatcgcaccactgcactccagcttgggcaacagagaccccatctcaaaaaataaatcaattagtaaaataaaataaaattagtgacaagtattttgtgcttatatgtggagaaattcttctttcaaaaaataataataaaatttgattatctgcaactggtatctctgtacaattaaaggaatgagtatctgactagaaactgtctgttttactcttcaaaggtctggttgggttgaatgctggactgtcccaagtgtcatgcttacaattgattatacatggcatccaatttatccacaaaaagcagatgaacagctgaaacaatcatgtaagtgtttttatataatttgtgcttttatacagctgctattatgattgataatcatgaaaaataagaagcaaataaattgaaatgcatctattcttgtgacatagtataaatatagtcttacatattttagattaattgtagctaccttttgagcatttactttgtgtcaaatgttgggccaagcaattttctggcttctattatcttctattatgtttaatccttataacaactctgtgagaaagatattatcattatttttatcttaaagttgaggaaatatgctcagaaaaggtaagtaatattctcaaagtctgccaagctagaagcagcagagcctgaatatgaaacaaggtatgtgtgaatctgcatatttaaggtgcatgattttgtgaaatgttagtttctttaatgcattttg

SEQ ID NO: 112860 - DNA, 1025 bp, Homo sapiens
tacattttgttgataatattcagtaactacaaatgtattaactcatgaaagaatcctagtgttttataactcctttagagcaaagtcactgacacatttaataaaaattagcaaatgttctctgctatgttggacattcagtgttccctaaagaatttgatatgaattatttccatttcagataattaaatggagattgctttagtagcaaattgaacattagacccaagggtatcttttttctttttactgtaataatctacaggaatctaaatttttttaagatttacaatgataacagactacaagggaatttttaaaaaataagagatctgttggctaggatcattaaaaatgacttaaaatgagtgctggtaactgttttgttggtacatgttagtatgctgaaacctaatagtagttgagtccttagatcagctgtttggggagaaggtgggacagaggtgattttctgggggccatttacagatggaagtatcaaaggagtttttccactttacacttgaccctggactctgcctactgcaaactttgtgaacagtcatcaggactggggtggaatgtgtatttcataaaggcttctggaggggagaactactgctttgaacatctttaagttttgtttgtttgtttactttatttcaatagttttggggaacaggtagtttttggttacgtggataagttctttagtggtgatttctgagattttgctgcacccgtcacctgagcagtgtacactatactcaacgtgtagtcttttatccctcaccccccccatccttcctctcgagtctccaaagtctgttatatcattcttatgcctttgtgacctcatagcttatcccccacttatgagtgcaaacatatatttggttttccattaataagttacttcacttagaataatggtctccaattccatccaggttgctgtgaatgccattatttcattcctttttatggctgagtagtattccatggtatatatatgtgtgtgtgtg

SEQ ID NO: 112861 - DNA, 1088 bp, Homo sapiens
gactgattttcagtgaattgcttcccccaaaggatgtcctcggtattgcctgagaactctgaggagcagtgattgaaaactgtttaaccatgcaaaccttcagaggtctctgaggacctaaattacaaggttttgctgtaattggggcaatgccatgaagtttttctataaaataggctctgtaactttttgcattttttgctactgaatatttgccaagcagctatgtgtaagtcttaacatatgttttcttttgtattttaagacaataggcctgatgcctttttattaaatataataggttaaggaaatgcataatttacaaatttaggctcataggtgaaaatatatttacatacctcttttgacagcaatttgtgttttcttaatatttataggaaaactactttggggaagatgacatgtatatggattttgaagaggttatctcaagtcctgttttgtcactgtcaacatcatccagctctgggtggactgctgttggaatggaaaatgacaaaaaggaaaatgaaggttcagccaagtcaattcatccacttgccttgcgtccttgggatattactgtacttgttaatttgtacaaagttcatgggcgtcttcctgttgtaagtgtttacacatgaaagtagtctggaatatattataacatccacctgtgtatagatgtgaagcattcagcacacacttagaaaaagaaaatcagatttagaaacttctaaatttattcttttactgttataaaactcatgtattttcttcataatatgattacttgatcattggtaatttttattttctatttttcttctaatttaactttagctccttctttgctatatgtgtaatgtcaggacatcgtgtcatacattgagttgttgggtttataattaacctgatgggtgttcaaggactttacattttcttagcttttatctctagaccccagaccagtttggggccttatggtggacctgttataaaatggagtttctggcttgaccctgggggttgaattatgtagtttggatctagcacggtatcctgggtcgctctaaggacaacctgtg

SEQ ID NO: 112862 - DNA, 1044 bp, Homo sapiens
atttttttcttcatctgtcgttatactatctaatgttctttcacagtgagagggttcacactgtgtctactcccaaggctcaaatctgggttacccacttgtagtttatcctgggtagcatcagtctcttaactcaaggcttcaagatgaaggttctaaggtgactgatggactactgtgtcccattatgacactatgcactttttactttgtggtcatcttatgtattaatttcatagggatgccgtaacaaagtatcctatgctaggtgacataaaagaacagaaatttattctctcacagttctggaggttcaaagtcctaaatcaaggtgttggcagggtcacattctgtctgagctgtaggggaagatccttccttgcctcttcttaggctctggtggttgctagcaatctctggtattcactcaaatttctgcctccatctcgactggctgccactctctctctgtgcctgcatgtcccactttttctcctcttatagggataccagtcatattggattagggcccaccatcaatgtaaccttatcataacctaattatatccgcaaaaatcctgttttcaaaaaagatcatattcacaggttccagggcttcagacttgaacatatatttttgagggatgccattcaacccacgcatgatgcaaactgtaataacatttagaatataatatttattggtgtatcatgtaggctataccttaggaaagcccaagatccacatgtaattttgagattaaaaaatttcataaaaattttatactgagaattattgagtctcagcgtcagaagataactttcttgaccactctccccagttccctcagtaaaaaaggtaaggaaattaatgcctggagaagtcaggtgattttatataaagtcacacagcttggatgaaaataaaatgaaaattggatcagaagagcttctagagtgattattgtagtcacaatttgaatttttttaaaaaaagtttcttatgaattagagttagcccttatccttaaaaaaaattttttt

SEQ ID NO: 112863 - DNA, 1017 bp, Homo sapiens
aggactactgtaataaaactaggttgagaaataatttgcgaactgcctcaatgtatactggtatgttgaaggctctgtgaacacttgctgtgaagaaatctgtctaatcagcagcatctactttttgtggtcactgttaggtgcagtgatacttagtacacaaggcagaaatggttattaatgaacctgggggagaagataaatattgagaacattaaaattaagataaataatttcaagtgtaaaaagcgccacaaggtgaggtaggcagtgctctggtagcatttaatggtctggaggcaagaacaggatcagatttgtatgtttagaagatctctgtgattactcatagagtatggagcagagagatgtaaaaagttaatgccttgaaaaggtcctggcaagaggtgatactatttggaccaggatgagagcactgaagatgaaaaaaagtcaatgcatttgtcagagactgggaggtagttttaacagaaattggtgactgatcagtagggcattcccaaacttatttgattctttattcttaataatgtgtggaactagtgttccatgaaataatctgttttatgacatatcctttatttctctgaatacgttagaaatgttccctttgaaatacgtgctgctttttagtagtgagtatgaaattattctctgtaagaaaactctccttgtatttacatagtcctcagaatctatatggaagtttacttttccccaccattcttcattgtttggtcttaatggtctgagttcttcaatgttgtcttccttttaaaaatattttaatctcatgattcttagatttcttacaaaagactggtctcttgtattccctgtcaaagtactactgtagtttcttgttattcataaaggcagttaccaatcagagatctgtctactatttaagactcagctatcttgctttttataatagttggactctcataggtattgttcattaaagatgcttaactcagaatacctctgcgggta

SEQ ID NO: 112864 - DNA, 1049 bp, Homo sapiens
tatgatatatacttacttaagcttctatttacataaacaaaagtgctttaatcttcaaaatacctggttttaaaaaaactgtagctcaatgtgatatttagatactttttcacataaaagtttggtttatgattggagaattttaggtgcttttctatgtggagatttcagttagctatataagagggaagatatataaccttgaataaaaggatttgcgttaaaagttgctgaagtgaaatttttcagttgcaattagttttcattttgacagtgcattttgtcattcataaaggaaaagtaacataagcatgtaaatgatattaaaggtagaaaaaaatcattggctaacaagttgcttatttagcagaagttttaagacagtgtttgggttctttcaagctacgttaacattcttcagaagcttttgaactctaaacccttgtttagaatgctaacagtgttgtcaacttgtcactgattatctgtagctggcatgcctcttggagtggggacagacatttgtttttcatgtggtatgtcgggagtatgaactggaaagaccgaaatcagttataatatgtcagcatggaattgatcgtcggttctgtgaatccaaggtatattaacaaatatgttagcaatattataaacatttatgaattttaaaaaatggaatattgagatatcagcttcaagtcaaatacacatagccatgcagcaaactacagttttttcagttaataaaattattttttaaattcttacccattttagttttaagtatctaaaatatgagataattattaaaacatacaaattaaaaaagaaacagaattataaaaattatattttgcttacatttttactgttaacattcatgtcatattgcattattatacttgttgggatatggctatatatttatgtagaagatttagaaattgaagcaaagagaaggttgaattcttcacatgacatggtttgcagaccactctggacatgccgtttctcccataatgtaatagcaaggttggtcatttgccagg

SEQ ID NO: 112865 - DNA, 1019 bp, Homo sapiens
aaatctgtgttttaggagtaaaataaaattaatgtggattgtcttagtgaatttgtgtgtgtgtgtgtgtgaaaatacatctgtgcgtatggagtacctgtaagaaaaccttacaactctaaactcatacaattcttgtaaacctgtggcactgttttacttttcactttactttgcttatcctctctagtttcagtaagaaattgtctatgtattgtccattagacttgctatttgccccttctgaatgaaaatggtgcatgcttacttattgttttctaacgtatagttttctaattgataacactttaactgctgatttcatttattattataaaagaatgaaattagactgatttttaaaaaatacatcaataactagattttttgtgtttatttaaagaagatgacttaagtatcaaaataataagttgatggtgatgatttagatgtacaatccttttttattttagttgagttgtattcctgggccttgtccaacttcagatgatttgaaatatactatgattcgtttagcagtagatggagccgatatttacattgttgagcatggttgtgctacaaatataaaggtaagtgttttgcttggctggtgtagtgctttttcgtttttactaaaccaaacctctatttcttgaaataaaacacacatttatagtttgtcatctcacagacagccacaaaattttaggagaaaactttctaatttttactaatccatgttctcttccagtattatttttttcaaggcatactttcaccagttatttactctgagttattgtaacattgctttatgggaaggatataaaatagtaggttacttttatgtcagggatataaactggcagtgcttttaaatgatttgatttttgaatgtctttaggattcatacatttatattttctgcctggctcttgaaaacatttgtttcccactcttttatggattgtagtgcaaaatcaagccttgttaagtttctactatttcattattta

SEQ ID NO: 112866 - DNA, 1053 bp, Homo sapiens
aagtcagtaggtcaatctcctcttagatctcccttgaaacgacaagcctctgtctgttccacccgtcttggaagtactaagagtcttactgctgctttctatggggacaagcagcctgtaacagttggagtccagtttagtagtgatgtctctcgaagtgatgagaatgtactagactcaccaaagcagaggagaagttttggttcattcccatatacaccatcagcagactctaattcatttcatcagtatcgatcaatggattccagcatgtcaatggctgatagtgaagcctacttttctgctgctgaggaatttgagcccattagcagtgatgaaggccctggaacttatccgggtagaaaaaagaagaaaaagcaaacccagcagattgactacagtaggggttccatatatcacagtgtagaagggccacttactggacatggagaaagcattcaggattccagaactctgccattcaaaactcatccttctcaggcttcatttgtttctgcgttaggtggagaagatgatgttatagaacatctatatattgtagaaggtgagaaaacagtggagagtgaacagattactccgcaacaacccgtgatgaattgttatcagacttaccttactcagttccaggtaattaattggtcagttaagcacccaaccaacaaaagaacctctaaatcctcattgcatcgtccccttgatctggatacaccaaccagtgaagaaagttcatcgtcatttgaacagctttctgttccaacttttaaggtataaaccaaatcattagtttccattgatatcttgatttagaaaaacagatttttaagaagttattttcataattactctcattctttttagctacctttctgagagagagactttctgaagccatagctttatgtatgataggtcacagagttattgatgaatattagaaatttaagtaaattaaattgagaaatggtttatgagttgccactgcattaatctaatcaacacatattctgtgtctgcattatactctaagattag

SEQ ID NO: 112867 - DNA, 2194 bp, Homo sapiens
gaatggaacataatggaagtggtgtagaagcggttgggaagagaaaaggggttcggtggaaacgagctttcatgaaaatcttccttttcctgcaaaagcacataattttcttcgataacttatactattaagattcttatgatatgtcatataaatgaagaacacaggaaatcttcttcagaagtttgttaaagaaaagatcattgcccagtgtggaacacttcatcttggggtgaaggtggtgatgtggggataacctcagaaatgtttcccttgtataatttctaaatatgtggcttagacattctcatttcaatgttgagcaattgttgtacatattcagatggtgctacgtttcatgatatgtttacataaactaagttgtagaatcaacgacatttaaatatttcatttactgttttttcccctcagatatattgaagcaatggttcattgtgctagtacccgacatccagctgcaattgtagatgatcttcatgctaaagtcctcagggaagctgtccaaaatagcaagactaccttttcagaaaatgtaagaactttttaattcaatgggcatagcaaattgaatatttatcatggttacagaatattcaaacttgaaaaattttctttacaagttaaatcagaatatttggacatgttctaaaagcgtttatatgtcattggctctgtaaaagataggacatataactgtactatagatggaatagtagtaaaaatatttatttaaaaaatatattaatagctttctttgtttcttttatttcagaagcagcttagttccaagccttttctaaagtgctttggccctaagtgaatgaatattctttaggactgacaccttgcttttctaagacagctgtttatgttttgattttcctctatgattagatgacttgtatcttaatattacttttgagattttcctcgttcacttcagtgaatcaagtcactactctcattgtatgatattctacttacattgtggttccagccacgaagccagttgcttagcagtcatatcccagtgctcttccagagcttctccatttgattttcaaatttatctggattatacttagagtagggaccagaagagagatgaaagtgagactgattattttagttaactatttatttaatatatattggcatttcatgtgatagagtagaagagtgaaaaaaagaaatttgaaaatattcctagccaaaaaggggccaattatcagaaaccaagtttgttttcaagccagaagagtttagtgatcttaaaaaatgcctgtaattactgtaccattttttctgtctgcttctctgtaggctgatttcaatttaatgtgtattacttttctcaaccatgatgctaccagtctttttcctagcttatcgaaagtttggattttaaggtgggatataaaactagaacgcagctggcacatagataggcatagaggggcagcgtgaataagtgagttgctgttgtggatgatgtggaagttatgaaaagcttgtgaaataatttcacttacgatctttttagttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaacaatttaatatttaaaaattttttcctgaaagaggagagcattttgatggtgtttgtccttttcagttaccaacgtgaataatggtagaacagtgtgtaatattaaaaaaatatgttttatttctatgatctaatgtagatctaatggaatgtaaatagtttacttaagcagaatattaggtaatagtagaatgttccacatccatccagtaaaaatttaattatgattattttatgagaatctgtattcataagctttgtcttcactgtcaaatacatagatatgccattcttaacagtagtttttcatttttgtgcatattttatgtttaagtggtaatttttcacttgtcagttctgaaattttgtgtgtgtgttaggtaaacttatgtttgttacaagcctcagtggaagaatctccaactacggctcctagtaggagtgtgactcatgtttccctagtggcattgtgttttgac

SEQ ID NO: 112868 - DNA, 1050 bp, Homo sapiens
tatgccatataggatataaaaactgtaaattctttattcagcgaaaaatatctacttagaattatatttgcttttttatatattcttgagtaatagctcaaaaaggaaggttgaaatgtgtataacactttttttaggtttagtaatatataatatagtaactactataaataatagtagttgtatatgcctacaattatttacctgataattcagtgatacattacttttatagattagggcaaagacttggtgagaaaaaaatagtctttatgaaattttatacagatattgtagagtacagcattaagacacttattcaccatttataataaatgcttttttttatttttataggaggaagacagtctggtgctgttttatataacagttttggaattatgggtaaagctagtgacacagaaaggggtggagtgctgacatccaataattcttctgattctccaaccggcagtggctataatactgatgtctctgatgataatcttccatgtgaccggacaagcccttcctcagacttaaatggaaattctgtttcagatgaacaggttagtgactttctaatagtaataataatggtgctttagaaaaataacaaagaaaactacatatgcaattcaaaattagtttctggagtgtatttgcctgtctttccctattttggatttatgatatctgcttaaatgttagtcaaagtgtgttggtgaatatactactagaatataatttccaaagtatatcatagatatatttatatccatcatagtcctagcattatgccttgctcaaattagatacctaataaatatttgttgaattaataaattaacaaaatttaagagaaatccacctatagggtgtggaggattttagcaggcagaagtcattttgttattggtagtattttatgtcagttctaaatatttttgtcagtgtttgcttatttcagttaagagttctgaatggcaccttatattcaactcactttttatttttattatggtagaattacatgggtggtgatgagta

SEQ ID NO: 112869 - DNA, 2530 bp, Homo sapiens
atatgaatgttctctggcacttccacaaacatgctatgtataactttctgaagtttcaatatactatttactgctccttaggtatgaatagtgcttcatttccaccatctatttgatatacggtgctatgtggttttatgtcttgtcaccagattccctcatcagattaagaagggaattaaagatccatggttaaaataagtggatgtgcttcattataatattgataataaaagtggctctttgtcttgtactatagagttgcaaaacatttttacctacatttaaggacgtatgtaaaaaggattcaccacaatcctagtatacatgatcagttttggtattaatgtgcaaagtagctagcagttatagcaacagtaatagtaatagtggttgtagttatcagctgtcatttttatatacataagaaataaccctaagttacactttctgtagggcattcacccatatcattctctgagctataccagtggagacactgccactgattctccagtgcatgttggacgtgctgggatgccagtaaaggacagtccaaggaaggagagcctactcagctacctgactggaagcttcccaagcctgcacaacctcctggaaggtactcctcagagaagcagtgctgctgtgaaaagtagctccctaacgagaacaggtacgtcctctagatttgataattacatgtttatatttacgggggaattgagatgaaacaggacttaagtttagttagatatatactttggtagtacaactaatctctcataccttatctttgagaaaaaattttaggaatccattgttctgtttgtaacttttcggagtcttcatgcccttagtttgcatttttaaattgcagctctgacgaatgtcaatgtaggcatttggtgtggggtactgtctagaccagcaacatagaatttcccctgttataataaaaataagctatttattaatgcattaatatccaaataccaacattatgcagtgagaattcaaaaccatctgcaaacatacattttaacttgattcttcaaatataggtatataaattacatttttttgctccttagtatataaataatattatactcagaaacattttattttcaggaaatacagtagccactgatatgttatctgaacatcccttgctatctgagccatcatctgtgagtttctataattggatgtcaaatgctgtgggtaatcgaggaagtgtgttacaagaatctcctgttacaaaatcaggacacaatagtcttcccacaggtattgagttatcacattattttgcttaactgtcttaaggggaacatataccaaaatcttatttttcaggggatgggttaaaaatcaaacaagtactgtttggttgaaattggtccatttatatttttaaatgcctttgataatattgtaattgagagagtagtaagcagtcactcagtgttcttgttgaaaggcaaatatgtcaaatgtgagattgtatataaagagtttaaagcttccttttaatgtggctggtttaagtggtaaatgaaaaaatgcaaagtgtaattacaacatcatatacttgatattacaaaagatagttttaatttatctagatccctctgagacctaataactatcattctaaacctttagttacttaacaaatatttaattaaatctaaaacagtatgtatgtataaggatagataaggatgacatgtgttctgaaaagttaatttcatttttcactaataaatcatgtctgtaaaataacctaaaagtatgcattattttttttcttttcaatttaatcagtcttgaaatggtactactatacaggcttcaaaagtttaccctgctgtacacttttatgtgtttctattccccaataatttacattttattcttaaaaatttactccattaggtgttgcacccaatcttccaacaataccctcagcctcagatttcaacactgtcttgtctagtgaccaaaatactttggatgggacacattctcagcatagcaccagtcaggatgatgtggcaggtgtagaagaagcaaaccaagggtttcctgctgttcagcttgctgatgcacaggtgagccagcctgctttttcctaattataataatacctccttaggcattgcttagcaactggaacctccaatagtacgcaccttggaattctagtgaggctataccttacctatctgcctacagccttcatgcaaaacaggaggagcctttaaaaagtacatggcttagttataaatgcaaattaattatctatatgtaatcattaaatagaagagtctcatatagtaacctttttgttattcgtaacaaattggctaagcaacatgaatagataatcataccctatggtttttagtgctacgttaagactttattgagcgagcagtggggaagcattgatgattttagagcagaggaataaagtaaaaaactatagatgtagaaatattatatgagtagcaaatgtatt

SEQ ID NO: 112870 - DNA, 1474 bp, Homo sapiens
gcattgattgtacacttcctgtgagtttatgcatttacataaattacactacaatggggcatttttcttattaattaagaaatactagtattcattaaggaattattgctctgtagttataaattctttaagttaaatgcaaaatatcaaagcagcttctgatttttttctttttgttacagaaaaaactcccatgtctgcacattcatagtgtgcatggaagaagagggaaaaatacctttttacagttttggtgcttggggcttattgttattattggtagctggtttatagaaatttgagatatttttgactttctatattaaaatttactataatagtcttacatgaaaatctttagataagcaggaggatttgccaaaataatttttttatcagattttaaggttttgtgtgtatttctaatttttgtttcaattgcttttcctgtctgctttcaacttagcatgagggcttcctatctaatatcaaataaaattatgttaaatatgaatatattagatacagattgtaggagggggggatggttaagtgaggtatcctaattgatctatacttaactctaaattccaatactctacggcaataccatcaaatgacagtaaaagttgtgttatcacttcagtgaaatcatttcttaacataagaagactgattttgacttactagttttagaataagattaagtaagaagacttaaaggcccacctttgaactcataaaaagcctggcctagtgaaaaagcatattttactggtttgcttgcttaaaattatttaagactcatattttaccttggagatgattttgcctataaattaataaagatgtatgtttctggaaaaatggaagaaaaaccgtgtcctttttttatttcacgtttttaggcaaggccatgtgaatcttcctccacttgagttcaaaccagcattaatgttgggaacctttagcatcagtgctgttgtaatggaaaagtccgtgtgcacccctcagaactctaccagtgccctttcttttcatgatctcagcaagcggtattataacacctttcactgcaactttactatttcctgtcagtcaataagccagcatgtagatatggctttggttcgtcttattcatcagtttagcacaatgatagatgacatcaaagcaactcagactgatattaaacttagcagatatacagccggatctgcttccccaacacctaccttcaaaaccagaaaacatcgggactttcgttcatctgactttagccgcagttctagaggaagtcttaatggtggcaatagagtaaataatgcaaagaacaaacggaccaacaatgagaataacaaaaaggaatctcgaaacaagaattcattaggaagatctgaaagaagaacatcaaaagtgtctaggaaaggttcaaaagatgtggtggatcacatgactattcatatggatgact

SEQ ID NO: 112871 - DNA, 1088 bp, Homo sapiens
gactgttcatcatgttttcttaatgtcgtaagtggataattgaaatggagagaaattgtctatcaccagggaaataaaacagtaatggaattcagatatcctgccaccacatttcccaaccttttaaactcttacgtggtatgttcttaaaggatttagacagacctgatttaaaatatctggctctactattcactttcagtaggaacttggaaaaatgttgaagaaatttttaatcattttgttggggattaggagaaagaggactggttgggaatgtgaaggaaagaaaggtaagacaatgtttggaatgtccttccatttttcagtcttcgtatctaaaattgtatattttcatttacttataaaggagttcggagccctacagagccaacatgtaaagttgtgtttgagaatgaacaagacaacagcagtttgactaagactcagaggaaacgtagcttggtaacttctgaacctcagcatgttactctaatagtgtttgggattggcatggtgaaccgcacacacctagaggcagatattggtggactaacaatggaatcagaactgaagaggatccatggcagttttactcttaaggaaaaaatgaaaggtatgaatgatttttctaataaagtgctatgtatacataataattagtgctacttctctgaagaaaaccactgccatgtctccaaaattcctaattggcaaattttttttttcccagaaaaactggacttcccaaattctgaggtaccaagaactttgttgtaattgagtatcagtgaattgaggcagctttgatgtctaaatattttagcacataaatattgagtcgatgtacctatactcggtgacatttattctttgtcttttaatatcaactactaagatgtctctaaaggctgaacattttaccaaaataatgaaatttatgaaaaatttgcttttgttaactaccatagaaatcttataatctaatactaagtatctctataaaaagaagtccctttagttgatataaaatttcctaggttagtgaaaacataccatttatcttgagaatgattacacaaggtatg

SEQ ID NO: 112872 - DNA, 1026 bp, Homo sapiens
cacatttcctaagaagtcttttcaagaaaggcaggaaattccggtggttgtgagagatgagatctttttttgttcattcaatataggagaaggggttattattatgtattaattataatattattaagtgcctactgtgggccagaagcctcacctagattattatatttaatcttcactgcaattttgggaactggagtggtcttatctacctttacagaacaataaattgaggttcagaaagatcaacatagtgcctaaaatacttaatatagtcagtaagaagagatgcctgaatctatactctttcgaccttataatgcttctactgaaagtcatagaccatggattccacgaatccttcatttactctaaatttgaagtaccatgggtacgttaccttcagaaagtaaactaaatttctttaggtgtcccatgagttttatttactctatcctcctggatcacttctcttcattatttgttatctcttaagagaagggcttccaatagtctttaaccttgcaaaacataatgtttatagaacagatttttggtaaagtattatatagctgatatttcttgctcttttttcccccaagtaaagatcccttaactgttttatttgaaaaataaaaattatttattagttactgccaaactcgtagtgtattctttggtatttcattttcaattgcaatgaagaggaaatggaatggaaaaaaatggttcaaatggtactttaaaggaacattttaagagtgggaaattagaaaagctttccagatgattggtcatattgtaactaatttgtgcatgaatgtttatttgcctcctttttgttttcccactttctcttgactcttcatctgtagactggaggattttcctacatctcctacaagtacagccaaacaagagtttctgtatgtcatattattctttttcatggctttgtaattactgtagtattgaatagtttttaaaatatttaaatttttttcatggctgtgaattatttagtta

SEQ ID NO: 112873 - DNA, 1391 bp, Homo sapiens
tatttgtttgaataattatgtgctagattattgatttaagtgtttaaggtcaatagtaaactaaaattcataacatatccttatttgatatatggtcccatgaataattatgaaggtcaaagagacatatgtttgtataattttatactttatgaatgtttcagtgagtacaatttaattgatttggcaattttagctacttccacactgaatcaggatcagtagacatattgttaactacctactattctctgtgaataaagcactgtgtggactggggaaatttttttaacttgattttcttgttacaatgcttctgtaataagggcactttatttctgttctaccttctatgaaataaagaacataagtgtttttctagtgcctaacacactgccagtcttaataaataatacttgcttaataatactggcttaataatacttgctgattgacttgcgtatttaaagatagggaatattttataagcaactttaaaatatcctttcatatatttcaagataggtttgggaatatccatgcatttttcttagataccctttttggaaaaagtgaggaatgaatgagtgaatgaacactagcacaaacaataacttttctcatttcttacaggtgcacagacaagatttacatttgagctgccaaatcacagattgcgttttacttcaaaagtttctgccacagatatgtcaaccattcctccttctgccagtcttaaccttccccctgttaccatgtcagggaaatatataatggaagaacatgatagttattcggatcaggtgtggagtatagatgaactgccttctaaacaaggttactatttacagggaaattatctgcgttgtgtggcagaagtaagtttactttaaaattttcttactcttcgtaatttaggagtcttcaagatttatatgtaccaaaatatgtagtaatccaaacttttaaggtaaagtcttaaaataatttgttttcacagaagaattctataccaaatcaagtgtgtgtgtgtgggtgtatgtgtgtttttgtgtctgttagtctgactaccctgtagttttatttacacatgcttttaaaaatatgtattagttatgtattccatctctgcaatattttcatagttcaaatgattattaaaagcaaatcacagctaacattcattatgtgctttacacgcattgacttctgcagtgcttaagtaaatcctatgaggtagaaatatttgttctcattttgtaagtgagcaaactaagccttagcaaggtaacaaattcatacaggtatacataattattaagataatctaaaggtcatattgaaagataaattagacttacagattaatttctttactaaggttaagttga

SEQ ID NO: 112874 - DNA, 1028 bp, Homo sapiens
tttttgtttttattttgccaaaaattattatgtagattttaatcttttttcctctttgaagaaccaagtagaaaaatgccagtcacagtttcaaaactgaatcgctgcattaaagatacgaggaaaaaatgaacaaaaatttcttgtcatctcttagaggttctaattattctgaaatatttaatacattgccatttagaatatggacctcatcctaacttttatataaagtttatctatgacttcatatttacttcttgcatggctattttgtatattaatttcaagtgtttatggtacagagtataaggaatatacattaacagctgaatttgagaaaaatgtattatagtttttttggtgaacaataccattaataatgtttagtttcatattaaaactttttccattattttattttattgagctttaaattttattttaggtttatgaggaagctggttctgattttcatcaagttgcctattttaaaaccagaattggattaagaaatgccctccgagaagaaatcagtggttcttcagatagggaagctgtgcttattactttgaatagaccaattgtttatgcacagcctgtggcctttgatagaggtaagataaagtcaatcactactatcctctgggatctaggaatgctttgttaatgctagataagaatcttgtagtttactggtgtaaatgcttgacagctaaatggttcctaaatctgaaatgtgtgtatccaaaaaaaaaatcttgctttttgccttcagtttttaaaagttattttacattttaaagttattttgtcttctggctggataacataagagtgtctgcttcagattatgtaattgtaatgctgattttttttgttttgataattaatgcacccatttgtgttttggcactgtgtttatttttatattctataaacatttatcaggtactgcctagaagtggaatacaaaaataaacaacagtatccctgccctcaaggacctgtcagtccagtggaaaagaaaa

SEQ ID NO: 112875 - DNA, 1019 bp, Homo sapiens
catgaaacaaagttttgacagcattttggctgcagtctcacatgagttcagatgtggaattttccacttgtagcatcatatcaacattcagaaagttttgggattttggatttcggattagggatgctcaacctgcatttgcttttcctcctacttctctggcctctccatctttatgtcctttttagaggcccctccatctatacactgctgtgaaatgaaggttttccttaaggtttgtttctgtttaacaaactcaaacatctttgacttttctctgtaaatcagatccttttaatggtatgttcctagcattatgtaccttaaagaattttaaaagaagtaacagctctacagatgaagttaagcaccatgtctgttttcatttgttattccatcccagtatctaacatataataggcatttcacaaataagttagagggaatgaacagacctggattttcttcttccttgtgccattatgtggttgcctgctttctgttttattttttcatttgttatttaaaaaatggtgactatatgtcctcttagatctttcctaattctaatgctacagttttctgggtgtaatttttattaagcaacaggattttgcagcttttgagttttacttaacatatagatttacagtgttgattttaattttctttctgccctgtcttaattatcaaaagctgtgctgttttggctgaattataaggccgcctatgacaactggaatgaacaacgaatggctttacataaggatattcatatggctacaaaggaagtagtagatatgctacctggtatccagcaaacatcagcccaggcctttgggactctttttctccagctcactgtcaatgatctgggaatttgcctacctatcacaaatactgcacaggtacaaaaagtcaagtcatattccaggattaagagccaggcatttctacataaccatttctaagtatttagaatataacagtacatttttcagtgtaacagtttataactg

SEQ ID NO: 112876 - DNA, 1032 bp, Homo sapiens
aattaacctaattaattctgtctaatgagctaaggtcatggcaattcctactgtagctataggatggtggatcaacttggggtcagggagtgaacctgtagttcatagggaaaaagaaaataggtgctatacagaggaaacagtagatgcacactgtacacatagagaaatcaatcctgtagtctgatgtttctgacaagtttagcagtgaaagacattagttattatatgtggccattattactttgtaaagttatttcaatttctatacccaggacttaacaaaaatgcaacttctttatttaaacagaaagcagtagtgctggaacctggacactcaacgtattgtggaaaatgtgtgggattgatgttcacatggatcctaacattggcaaaaggcttaatgctctgggcaatactcttacaacactgacaggagaggaagacatagatgacattgctgacttaaattcagtgaacatagctgacctgtcagatgaggatgaagttgatactatgtctcccactatccatactgtaagtaaactcactgttagaatttttcaggattggcttttaccctgagacagggatattttttgttcagtgttatttagtatattatagttgctatttgtggaggaagagaagggaatggtggttcactgtgtctacatttcataatactgtcttttaatcgagttctgtgctacatgttgactgtcatccaacttgtgctttaacctataggtaaaataataatattaaaactgaaatgagtagggagtggggcagggtggggaatgggaagaaattgctaacaggtatgaggtttctgagtgatgaaaatattcccaactaagattttaatgatggttgtacaactttgtgaatatactaaatgggtgagttttatggtacgtgagttatatctcaataaagatgttcaagatgaatttcaaagcaaagtgcatatacaaaatgaaatgatacattttaaaaatacgtattttcatctatactatacactct

SEQ ID NO: 112877 - DNA, 1050 bp, Homo sapiens
gttcttgggaagaaatttttttaaatttaatattactgtttattacttagagttcagatggaagttcaataagtggagatggccacaaactcacctttgggcagcgacttgtaaatcacctactaggcctgacacccccaaatcagcgccattctgttcctgcagagtatctgtgtgacccagagatgtggggctcccctcagtctagccagtcccatttgaaagcatgcagagcacactcatggggaaacgtaggtagcaactaaatagattccttatgaaattgaagggatttaaatcaatggagaattccaaccttaatatagatggttttgattcttgcatgctttgatttaaggtgttaattttgtgatagtatagatttgctgtgtgacttgagggtggtattgacagatacacttttgacttttcaggaagccacagattatcgaagacaggcagcatctgctagccagccgggagaacttagaggaagaaaaattatgaagcgtatagtggatatcagagaactgaatgaacaggccaaagtaatagatgatctgaagtatgtacaatgatttttaatttaatataatgttccctaattttagaatcataagatgttaaaagtggaagaaactgtatttggtctaatacaaactctttagtttatctgtgatatcaccagggtccagagttgtttaataatttggtcaagattatacactcattagtgataaagttaggcatgaggctgggcatggtggctgatgcctgtaatcccagcactttgggaggccgaggcaggtgggtcacctgaggtcaggagttcaagaccagcctgggtgacatggtgaaaccctgtctctactaaaaatacaaaaattagctgggcgtggtggtacatgcctataatccctgctactcgggaggctgaggcaggagaatcgcttgagcccgggaggaggaggttgcagtgagccaagattgcgccattgcactccagcctgggtgacacagcgagactccatctccaaaaaaaaaaaaggc

SEQ ID NO: 112878 - DNA, 1021 bp, Homo sapiens
gagaaactgaagagctcccagaaatccgtgtggatgcagcatctcctggacctagagtaacttttaatatccaggatacagtaagagatatataatttgttagagatatacattgctaagtagtttttacaaattacaaaattatggtattatactatttcaaaatactgatttcttactataatcaaagtatggattgtgatgactgaactgtgcatattaccaagtagtgggcactgcccttataacattttctgagagccatgaagcaggtgttagtattttacattttacatgcacaataaaggctccataactgctttctcttaagtagaaaggtttttgttgaataatttttctttcaagtgagaatccatattaaactacatcttacacaaatgtaaacgtggaatattgatactcatttatgtattttatttatagatagcagaaattagaaggaagaagatcagcttcaaagttgtattctaatttcatagcatattaaacattatattaaaatgtttattttgttttttgtgtatttacttttaagtcattgttatttttcatgagttttttttttttttacttttctcattattttaattaagttgaaaaatacagtatggggaagtacaccacaatccagctgtcctggggaagggtattttcaggtacttactaagaacaatataaattttgctttaaaactaatcaaccacactgaaaatctactttcaaaatatcttcctctcatttcaaacttaacttagacctcagaaatattttacataatggtttaagactgtttgaatctcataacctcttgcatgcatttgtcttggtttttacttctgtgtagtttaatactattaaagactaaatcagctaatcaaatcaattcaaccaaatcataaaaaaaactacaatttattatttcctaatccctaagtgaagcagtttttccttatattcaactacaaaatgaattttttcataaacaaagatcagttcaaac

SEQ ID NO: 112879 - DNA, 1043 bp, Homo sapiens
tattaaaatgagacttagtgacttctttgtctaatatagccatattctggacagaagaacatcaaaactgcaggttcccacttcatttatgtagcattttccatgaaagtttgatggaaagaagttcggttttttaataaattgatattcgtaacaaacttgctaaaccttgctagtgcaacttcattaaacaacagttttttagattctggaattatagaatcatagactattcagttcgaaaggacattaaagattatctgaaatgacctttttattttaaaaaatgaataaaagcaaagaaacttgccaggatcacaaagctaacttttaaaagttaaaacagtcttctgacttccaatgttctttctaccacatttttctatatttcttgattttcctcatcttcataattttaattttaaaagtttatttatttcaatacagttgcattacaattccaagacgctaaagactgaatcacctaatgcctccaggggatcttccttgccaagaacactgtccaaagagtccaagctgtatggtatgaaagatagtgcaacatctcctccttctcctcctttaccttccactgtccagagcaagactaacaccttacttcctccccagcccccacctattcctgcaggtatttaaggagtatatactttattttttgtcattttaaaaatttttagttattacctacttgctcttttgagactttccaatgcacatgtttaagaaaaaaggacatacatttgtcaataatgactctacagacttcatatatggaagtgtgggccaaccattttcacctgtttttgaaattgacattactttagaatatctgttataaaataaataatataccaaatagtttacgtaattaaatttttaggtctgtatatataaaaagagtagttttatgtagctcaaatttgggagcttatgagcagatggaaatatcaaacttgagagtacattgggtttaaccacatttattacttctctgttgtataacacattacccagaatttagt

SEQ ID NO: 112880 - DNA, 1682 bp, Homo sapiens
taaatacatgcaagctaagcacaggaaagcctgaaaacagtgacgtttttcttcacttgccactaaatattgttaaagttctctatatcttcttaaatggacaaaaggactaatgctaatgagagtctaaccaaaatataaagctgaaaaactggaccaaaacttgtgacgcagagcaagtaggaataaccaacttattatatgttattaatcgcctctgtattctaacattaacatatcattcctatcaacctgctacttttattattttcttgtaaggccttaaatgtgaggtactttgcttgattaaactttaatataattcaaatttctgtttaattggaactttttataaaatccattaaatggaatttataaatgttctagccaaaggaaaaggaagtggaggagtaaaaacagccaagttatatgcctgggtagcacttcagtcattgccagaagaaatggttattagtccctgcctattagactttctggaaaaagctctggaaactatcccaattacaccagttgaaaggaattatacaggtaagcatccttcttatatacctccccataacatatattttgggatcttattatatagaaggttttcttaatgctattatacattattacataatatatgcaattataaatgttaaagaattataaactgtaaaagaacttgagagatcatctaattgtcatttacaaatgaagaaactaagtcctggtgaggttacataactttcccatggccccacctagttaatgacaaaattaacataagttctacatccttagtgtgtcccttggactggaatctctttgagggcaaggatataatcactagtttctttgtacagtgtttggtatagcagcaggaaaatttgagtttgggggaatgagcaagaggtgcgaacagggaaaaacgtatagaatgaagggctacagaagcaaatgtttccgggtgttcatacctttcatctcactctagtataaacaataaggatcttttaataaatagtttgcctttgatctaataataaaacttaaccaaatattttaaacagctgtcagctcacaagatgaagatatgggacattttgaaataccagatcctatggaagaatcaacaacatcactagtgtcgtcttcaacatctgcttactcttccttccctgtagatgttgtggtttatgtacgagttcaggtgacatacttcatttctttctttttgttttaaagagaaatgtttttcttaagtttatttgaacatttcaacattattactgtttaaaagttttcttaacctcaggttcatgaacctttagtatgtttgtgatggcttggaggttgccagaatatgtgtgaagtatgtgtaaaattttatgtatatacagatgctcaagttatgatgctgttctgattaacccatcacaaactgaatagcgtaagtcagtaatgcatttaatacacttaacttactgaacatcatagcttaaactagcttaccttaaatgtgctcagaacacattactcttcagttgggtaaaaccgtctaatacaaagccttttttataataaaatattgaatatctcatgtaatttattgaatgttgtactgaaagtgaaatgcagaatggttgtatgggtcctcaaagtacagtttctactga

SEQ ID NO: 112881 - DNA, 1049 bp, Homo sapiens
ttagatccctctgcttaaatttttacctcaagtgattttaattcatggcatattacagtatattagataattttcacctaactagacagctgtgtgtatatatgtatatatagatgtgggggttgtgtttgtttgtttgttttaaagggaatgtggatgaggagcccacttcagtcactggtcgaaaagattcactcagtataaaccttgagtttgtaaaagtgagtttgtcacggatcaggcgttcaggaggtgcctcattttttgaaagtcagtctgtaagcaagtctgcaagcaaaatggatactacgttaataaatatatctggtactcaattttatagtttttaaattaaaatactgttttccaaaattaaataatggcctctgttttaatagtgtttaaatattaagtcacttaatgttaagctttcagtgataagttgatataaaggagaggaatgcccagcctacggtactgtgtcaatccaagtaataaatgttaggaatataatttctagataaatagacatatcacccaagggccaagtatgcctaattaaatcagtaaaagttgcttcttttcttcactttttctccaccatgaattggtacagtttctttttgttcttctaattgtaaatgcttaaaacactaaaacgggatgagtgatgtttaaaaatgtttacttgatgtcagaaaaccttgaattgtgtgcatgtatactgctggttttataaacatctatataactatgggcaagtcatttcctttacattgcgatttgagtgtttaaaagtaaatgcaaatagacattctgaagaatccagaatactgagtaaaaactttcataattatgaatcaaataaatatggtatgttcacttaacccaatattctgaaaatatatattaagcctgtgttttagggtaaacttttacctgagattgctaggtgattgaggggagcaggcatgaataagacaaggtcttatgtgtagacaaataaatgagtccaggataataaatgctataatggagctttctacaaa

SEQ ID NO: 112882 - DNA, 1789 bp, Homo sapiens
agtagtccctgccacacagctatttggtttacaattccttttgagaaaatttgtataccagctcatcctgatgattcattttccataatagaaaagactgctgtgttaaaattgaaagctggctatcagactgatctttagaacttctctgaggatttcatgataaagtgataatagaattccaacttgccatcacctcaaaaaagggaagtggtactaacagtgttagaatgtgctgtttttgtaatttgtggaagaatgtaacactaatcataatatgtaacttaagtataattcagctgtgtaataaccctgtcttatacctaccatgtgaaaacattaaaggttttagaaatctgtactaacaaatgttatttatgtatcagctgtttgtgatatagggtctgcctcctttaaatatgatatgcgccgactcagtgaaattctggcatttccaagagcatggtatagaagaagtattgcaagacgtctattccttggagaccaaactataaatttgccaagtaagcttgttatgtaattttaattttggttactgtagcagcaagacctacaattgataacacaaacgtgatcttacttggcagggtgtaccatgtgatgcgttcagtcattcaagaaatgtccattgggcccctctaatatgccaaccacaagggatatattagcactgaggatatatcagagaaccaaaaagacaaaaagttttgtcttctttgagattacattctggctgaataaatatagtttattctataactatcctaacaaattagtaaatttataagttagttaatttgttagtaaatttattctataatgattactctgtaatccttttaaatatccaagttaatcatggttagcgaagcatgggaaacagaagatgctggggacatgttactagcttgcctgcatttgtctgctggatttagatattgttgtaggtaatgaaatcaagagatttttggaaatgaaaactagagtcagttacatagaggtaaatttgagaaaccctaagtctgagtgtattccctcacctgtaaactgagaccagaggtcctgttttgctcttttcatggagtttaaacaaaacactggcatgttctttgcaaactgtaaattgctgtacagctgctaaatagagaactagaaggaatatgtaatgtgattagaaatgatggatgggtgaacttattttataacatagggattttaccctgttactttggattttttgtttgttttgtttgttttctactagcatctggcccagggacacctgattccattgaaggggtaagccaacacctttcccctgaatcatcaagaaaagcttactgcaagacctgggagcagccaagtcagtcagcctccttcacccacatgcctcagtcacctaatgtgttcaatgagcatatgacaaacagcaccatgtcaccagggacagtaggacagagcctaaaatccccagcttccataagatcaaggagtgtatctgattcttcagttcctcgaagaggtaacactgctctttttgttatcagtagccctacagtgttctcaggataaaatcttagttactctcagatttcagccctaactataggaaaataaattcttgaggtttttatgacacgtcaaaaaaaaaaaaaaaaatccccaacacagtaaaaacaacaaaacaaatatttcaaagtattgccatcaagacagctagatggccagtagctttacaaatagataaggggagaggaattagcatatt

SEQ ID NO: 112883 - DNA, 1565 bp, Homo sapiens
ataaatcatcaatacaggggcagaaggtggccaggagcggttcagtaacagctgtttctccacgtataaggaaatagcaagaatagggaaaaaatggttctcccttcaaatatgtttagcacatagcactcagtaaattttagcctttttctcccattatgccacatgcttatgaaatctactaaaattaaccagatgtccttttatatgtttaagataactgtataacaggcctaaaatattcaggatgaaatatagtaaacactattgctgtgtttaggttgtcaaagagatttataatcatacatatattattttttgaatgctattattatggtgaatccaggaattatgggctcatttatacaaatgtacctactgaaaatattttgtcttgagtatattatagaggcttagtgatgttcttttcctaccattagaaccatgctttagggcattacactccttaataataactgtaatttttattttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaaatgtagacttatataaatacctgtttgtatatagcttgagtaattgtgatatgattgtataccactaaaatattgttaactattataataaagtcacagtaatggtttaagtctgtagtagtttttcaatctttttctcctttttataattaatagatgcccatgctgtgtcacagctgatcagatgctttcatagaagatgatgatttatacctatattagagttgggccataggttctacctctgtggattcaatgaactgcagatcgaaaacaaacattcaggaaaaaaaaaatattccacccaagttccaaaaagcaaaacttttgtatttaccaagtacattaagtccacatgaatgaagtgatgtgtaggcattttattaggtattgtaaataatctacagatgatttttaaagagtatccaggagaatgtgcgtaagttatattcaaacact

SEQ ID NO: 112884 - DNA, 1152 bp, Homo sapiens
taataaattttaggtaaaatatctttttttttctttagatagaggctctcactctgttatccaggctggagtgcagtggtgatcctcccaccccagcctcccaaatagctaagactgctgcaggcatccaccaccaggcctggctaattttcaaaatgtcctgtagagaaggagtctcactatattgcctaggctgacctcgaactcctggcatcaagagatcctccaacctcagcttcccaaagtgatgggattatgagtgtgagccagtgcacccagccaagatgtgtaatatacataagaatcatctgggccacttgttgattatacaaaattctctctgatttagtaaacctggattggaacccaggtgatcatgaagaaaagaacttgggaaactgaagtctgagatgttatggggaaagcagtttacccagaagcagtcaggagttgcttgtaaaacctagatgtacatattaaagagttaatgtaatataattgtgagtatgtgaggaaataagagtggggtttatgtgtggcagcattgtatgtagccatctgtaaccaaagagtggagagtcagattcctaaaggcctcctaaagtctaaatactaacaagcaaaacctcaaacagaagaatctttgacctgtaaatacgggagacaagacaattctatttcattttttatccaaatataaaagctaagtaaataaattgtgatgactggacattcagtttaattctttagtttatcattatgttttggttttctcttcctctctctccccacctcctctcccactccccaaccttcacagctgtaatgggttgagttgcttataatgccctgatagtacacagggtttcttcaaagagatctcttatattctggagcttaaaagtatattagggcaatccaaggggtgggggaaattcagctttctttgttttaaagttttaaagacgtttgtatttaagttttaaagatgtgagatgttacgtgaaatctccacattttatctctcactagccgtttgacagatagtggagtgtttaccattgccaggcattatactagacactcactgttactccacgtgtgatcagtactctactactggccctattgctcacactgaatctggagctg

SEQ ID NO: 112885 - DNA, 1055 bp, Homo sapiens
taggaaaaaaaaaaaaaggagaataattgctctttaggagtgttgggaaggaaattttttagcttcaaaaatattaaaatataggaattaaaaaagactttgattaacttttttaaatttcaagctaaagaaacagtattggggctacttttcagcaatcaaatgctgcctattttctataattcattttttctttcttctctagtgtatgtctgcctcctatcaagaagctaaatgtaagttgaaatcctacttacaacaacatggctatggatcctggattgtgaaatctccctgcatagagcaatttaacatgtgaaataggcaatccattatcacattaaaaatcttgttttgtttggtgtgttttgactagtaaaaatgtttttaaaatattggtggttttcaactttcagaatcagagtcttattcagcaatgtgcaatgattgctgaaaatttctaaatattcctgccaaattacattgaaacattagggctttttactttttcattttctcagaaaatgacttacctgtttgaatatgtagccattttgtatttattttgatagatattgtaaagccattttcctttttgtagtttaatagagatttccttttaagtttttgctttaaagctgtccatatggctaccatattcaacattgtatcctggcatctcactcagttttttaaaaattaaatattggaagtcaagaataaaaataatgatttgtactcattgatgaattcaacaaacatttgactgcctaatatttgccagtcaccatgctaggtgttagtaaagaaacaatacctgaaacagctctcatgttaaaggagttcatgaatgcaaactgcacatataaatgtagaaaaatattaaccatgttaaggaatagtttgataaagtagttattctattaatagaggattatcgtatgtgcattaaataagattgcccattttcaactgttctacaagatctatctgtaccaaatgtgatttaattatttataatttagattaacagggatttctaagtcagtaaaaga

SEQ ID NO: 112886 - DNA, 1089 bp, Homo sapiens
aggcgtgagccactgtgcctggcctagatttctaatttctaactaaaaacatttggtcatcaaaatgcataatccaaaaagtggaaactgacttacagaatgagagaaaatgtttgcaaatcatagtttgataaggatctagtgtccagaatgtataaggaactcttacaacttaccaaaaaaagactaactgctctatttttaaatggtcaaaagacttgaatagacatttctccaaaaaagatacacaaatggccaatgcacatgaaaagatgctcaatatgaggaaaatgcaagtcaaaaacacaatgaaataccacttcacattcactaggatatctataatattacaaaatattacaaaagcaaaaatggaaagtgttcagtatactggactgaatatttccccccagttcatgtccttctagcatctcaaaatgtgatcttatttgaaaatagtttctttgtagatgtaattagctaaagtgaggtcatactggattaaggtgggccctaaatccaatgactggtatcactggattataagaaggctgtttgaaacagaggcagaggttagagttatgcagtcagaagccaaggaccactaggagcaactagaagctggaggaagcaaggaaggattcttcccttgatccttcagaaggagcatggacctgccagcattttgattttgggcttctagactccagaactgtgaaagaataaataagtattgttttaagctacccagttgtttgtggtaatttggtatggcagccctaggaagctgatgcagtgaggatgtggagaaatcaaaaccctcatacattgttggtgggaatgttcagctgttatggaaaacagacagttcattcaaaagttaaagatatttgctcctccttttcatgcctgtggctggatgtcccacagcactataggaaatgtgagtcaggccttttgcattaagcaaccaagaactacagactccaccttttcacccaaatcatgaatgaccagtgaaaagcaacttatttcagaggaagaagcagcccttgaaatgttaaggcttgggcttgaaagttgaagagc

SEQ ID NO: 112887 - DNA, 1025 bp, Homo sapiens
tgcttgcagatacctgctgcagacagtcaatactaatccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaa

SEQ ID NO: 112888 - DNA, 1035 bp, Homo sapiens
agctgtacaagtcacacacctgtgaagctggccctgattagtagtactgtttatgttcttctttttgcttgtcagtattgcattgcttgtacgtcttactttggtaataagaaaaatgataaactaagaaaagaaagggcatcaaatgtgatgagagttttggaatatatacgtataaatatagatatacataaacatacacatatagatataaagagatagataatttttttcctcattgcctaccctctttatttcttgcctaaataatttggtcctggggagtaggttagtggcccagcaccagatggtggagcccaggaggaatgagaacagcatccgcattgagtagggcaggcagtgctgtcatggcatgtgcacccacgcaagataaggaaagcatccaggcagggggcagccacctatgatgggatgctggaggctgaatgaggtgagcactgatggtgggaggagattggtcacattgaggattgatccaataaatatttttaagtaatgggaacaaagtttctcatttttagaaaaaggagttacaaatatggaaaaggagaaaagtggaataaactcggtggcatgtaagactaaaatagaaatattttaatcagtggttttgtcttttccataatatgtgtgtatacatacatatatgtagacatatattatgtattttctagctctttccattgggcaggcctgagagcaatgccattgcaataacactgagcatacctagtgtccagatctcaggggttttgttttttgttttttgttttttttgagacggagtcttgccctgttgcccaggctggagtgcagtggcacagtctcggctcactgcaacctctgcctcccaggctcaagcaattctcctgcctcagcctcccaagtagctgggattataggtgcccgccaccatgcccaacttacttttgtattttagtagagacagggtttcaccatgttggccaggctggtctcgaactcatgacctcatgatccgccctccttggcctc

SEQ ID NO: 112889 - DNA, 1006 bp, Homo sapiens
atgtcaaaagaacataaaagccatcctgaaggagtctctactagccaaatctgggacaatttcaccatcaatacagaatgacagaaacacccagctacttgagagtctgaggcacgagaattgcttggacccgcgaagcagaggttgcagtgagccgagatcacgccacagcactccagcctgggcgacagagtgagactctgtctcaaaaaaatttttaaaatttaaaaattctaaaaaagaaacagaaacaaagaaaatttttttttgatttaaaaaagaatgacagaaatagatattgcctattgaataaaataatcatctattaatccatgaatccatactatgaatttatactattaataactaaaggaaaaagaaagcttttctttacaatataatatgccaactaataaacagggtaggaatgatggaactaaaaaaaagcaattggcatcatagtggaaaatcatatatgcttctatgcaaagaacagacaactttcaatggtaatttacaaaggaaaaataactggactagtaacagacttgttatctacaaccttggttgaaccagataatttgcatttacatttacagtacatggtatattggcaatatccctatatcacgaaagttatcacatgtgagatcaaactaaaaaagtttttgcatattacaagggttctaaaaatattctacccgtatatctctgtgagaaaattctctaaccaagtgaaaattaaattttatgaaaggaaagataagaaattcaagaaacattgatgaataatgactcataatatttacaattaaatctaaatgtgctgggcatggtggctcgcgcctgtaatcccagcactttgggaggccaaggtgggcggatcatctgaggttggaagttcgagaccagtctggccaacatagtgaaatggtgaaacccatctctactaaaaatacaaaaattagcagggcatggtggtgcacacctgtaatcccagctactt

SEQ ID NO: 112890 - DNA, 1024 bp, Homo sapiens
acaaagaaaatggtcaatatatatgttctcctttgttcctttaaagatatatgttacacgacaaggccgggcgctgtggctcacacctgtaatcccagcactttgggaggccaaggcaggtggatcacaaggtcaggagtttgagaccagactgaccaacatggtgaaaccccgtctctactaaaaatacaaaaattagcctggcatggtggcgggtgcctgtagttctcagctacttgggaggctgtggcaggagaatcgcttgaacccgggaggcggaggttacagtaagctgagatcgtgccactgctctccagcctgggcaacagagcgaggcttcatctcaaaaaaaaagaaaaaaaaaaaagatacatgttacatgatgaatgtgatgagcagaaaagaatgagtagaaggtaagagtacctgactgagatttcttatctattcttcagctatccagctcatggaaaccacagtggtccatctctgtgcaaaatgacaatctttcccttcaagactgcaagtcaaaattttaaacttttatagcctaaagttgtttcctgtctctacggaaacttaaaccagggagtattgctttgaacattggtgttttaggcacttttcggataacattgaaatgactatttcctagcatttggcagacttaaacctaacaaatcacaaaacaagaaatataaatgtccaaggaaaaaaagttctaagtaatttttgaattctatagtaattttaaaattcaaattaagccaataatgaattaccactttttgcacgtcaagttgtctgaagattgttttaagacaatgcctaatggtgaagagaatgtggagaaagagactctcatgatgattttggggaaggtttaagtcgacacaccttcttcagactacttgataaaatgtaacccaaagtttaaaaacattcacttgtttaacaaaagtatttatagaacatctatgtcaaaggctggaaattacattctatcaaatgactagacattaca

SEQ ID NO: 112891 - DNA, 1006 bp, Homo sapiens
ccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgtttgaaaataaattatggggatcctatttagctcttagtaccactaatcaaaagttcggcatgtagctcatgatctatgctgtttctatgtcgtggaagcactggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgttt

SEQ ID NO: 112892 - DNA, 1054 bp, Homo sapiens
agtcgatttagtggtgcagcagtttttcaaacggcctctgagggttttataatctaattgaaggcatagcatgcaaattcaactatggaaaaatctctcacactggaaactcaaaataatctttatcctattgagcaatatggcaagaagcatatctgtaaatataattgagctagttatttcaatgtttactcatcctcattcccagacttcttacctcttcacattattttctctcctacttgctagtaattgctgacaagcccgcttatactgcaacagtgtcactaataggagaatcaatcgttttatcttccagtgtgtgggtagacacaggtgttgtacccactgatacttatcaatgaccaaacaggtgatcaaagcactaccccagtcagcatgacaaagcagaaagctgtgcgatttggaggtgcacattctgggtttaagtaccaggttctgccatgtgcttagccaggcattaggcaaattgccaccaaaaatatttgcttcttagcttgctttttgtgaataacgccagctctaattactggatagatgcgttgatcaaagatgaaactaatttgtaaacttaagtaccaaatacttgttatattttttcaataaaacaaattttgttgcacttaatggtagatgttttaggatctttataaatagtaattaatcctcctaacaaccctttgaggtagatagcattattattcctattttaaagatgacagtagtgaggcacagagagaaaaatttacttgccctggctctacacctttcttactgcactatgctaccttgaagaactcctgctggttctgttgttataattgaacaaaactaactgaatggtagtgcctataaagagagactatttacacatgaagtccgctattcttagtctttatggactaagaagtccatattcttggtggaataagaagtcaactattcatattcttttagaacatgaactattgatgttttgttaccaacaactgaagttagagggataaacaggcaatatgttgttagcttcaca

SEQ ID NO: 112893 - DNA, 1008 bp, Homo sapiens
tgacaaaattcctaaaacattccagaattcccttattcatcttggactcaacactatgaagtctgcaaatatatgtataggtcgaccagtgttgcttactagtttgaacggaaagcaagaggtaagagtctttttcatttccttagtttagaaatacaaactgaacattgcaaatccaagaatctaaactctgaaatgcttttgagtgccatggtagtcaaaggaaatgctcattggaacattttggatttcagatttgggatgcttagccagtaaacataaggcaaatattccaaaatggaaaattcaaaacgctcctggtcccaaacattttggataagggatactcaacctgtgtttgagatgtttctgattttaattttcaacacaagcaggaataaatgaaaaactgtattttaaaagacattaacatgtatattaactctgttcctttgctgtctatgactctgctgggcatagtagcccctaaaatgttatgtagagagaagtgttgcctccggcgatagtgacagtatttctccctgtcagttagttatatttctttataaaaatattattttgggggtaagaaggtcacctgttctgtatataaatattttactattctcccttgtttcagctgtttctccttgctgtcatttttcatacctgagattctaagcctggaacctttcctggatcatttttggcagcttggctttcttttctgctaccagccccttatctttcatggcttcctttgatgcttctctgatttgctggggatcctttggaaatactttgaaattttttgtctgctgatggcacccctcctattcttttcatttttctggcttatgctttaaaggtcctttactgtgtcttttagaagagaggactataaatgtgtgagcttaagctagaaattttcgctcctccctcttaacatttaaatctgataagacccaggttctgacaaagctcttgttctgtgtccctcactatttc

SEQ ID NO: 112894 - DNA, 1019 bp, Homo sapiens
gtttttgcctatgacaataaaaaatggatttttcatcagattctttgtatatacacatccatagataatagtgctcatatgtgtgcatgtgtgtatgtatgtgttagaagttaatgttttacaaagcagtatttaccctttctatattcagtgtaccctgcatttcttattctattaacaaagtgctgaatgaggctgactgaaatgatttcattacccttgtgttttgaagaacattgatttaggccactaaggcaccagattccaaatgatattttcatggctatatgtttctgaaaaatgcccatcatttcaaaattgtatacattatttattttaaggttgcaggtggattattcttttgattaagtctatattataaccatatacatgtaattttacatcacagtttagtttctggtgtacctaatgctgatttctgttcccttcttatccttttacagtgacaaagatatggaaattaatgaagaagaactgactggttgtatcctgagaaaactaggtgagacaaatattttaaattgttttcttaagttttaagctgcaaggcatcagcaaataaagtgtctttgagggcttatatatgcatagtagttttcttcaaaatagctttgagaatattcccctcaatgaatgaatatacttttaagatagggatgtgctacttttcctggttaattggcagttgagcagtggaaagaatatatgacttgtctgtggaaagagtcagtggtagaattgagacttttaacctttgcattcttgccctttccagtgacagatgctatcttggagtgttggtttgggtgtgccattttcatttagtttattattgaatatggaatgcctggctatttgttgatgtgattgatagaatctgagatctactgagtgtggaggatttcagagaatcatttccttctgtctccagatggtgttataggggaatattaggtcctcaattttttatgacaattattttattaatactctgtctt

SEQ ID NO: 112895 - DNA, 1898 bp, Homo sapiens
gacccatgataataacacttacaagagaatcatgtataaaatagtgtcctagtttgtccatttacagtaagagatgtgactgttaagcagaccaaatgtttgtgtttatggatgaccatattttcaccttgatggcaaatatagagagctgtcttataattacaagggttcttggtaggtaggaaatcagatgaaaggcttagtgttggagaatcttaattatttcaatctgctgtctctttctctgccactgggataagcctgttgtggattagtattcttgcctttgggcaaggaatggaaacatgtgatactgatgttttagtctgaatatttttaagggtctgtttttgtacttctaaacttataattcatagattcgctgtagtccatgcattgtctgttggcacattcagtataattgattaggtttgagctttttttaaatttttttttttaacataaattgcattccagttatgcttgtctctgggtcatctgaatagaatattggataatttctacaggtggctgatcatgatcatagttctttattatttggttttcctaatttcattttcagagagtaaaaatacctatatattcaaatgtggctgatacttggatattggttatattgttgactcttattttcaggaatttaaaaatgtatccatattaaaaaaactagtctataagcgaagactttttagataactttctaatagaatcttgttctatttgagtattatatgtgtcagaatcctgactttcaagtaggggaaaaggactgtttaaaacaattaaaacaattatatggtacatattatatatatgttattttttatgagaatgatacagttaagatgtgagaagtaagagagatgtcatagtagatggagaggtgagtattgtaaaactttctacaggaggaagcatttaggctgaacactgaaaaatgtataataaaagtaataaatgtataataaaaatgtattactaataaaagtaattgataggtaatgaaagcgtaagaaataggacttagtagcctggacagttagatgtttcatccttgtctatacagccagtgtgtgcctctcacttttttttttctaactttcagaaaaataaatttattttcattttattttgttaggaagtaagtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtgagtgtggtttgctatggtgagtctctattgatgcacttatctccagtttacttacatacaaataatttatattttacagatttcttaatggaagtagctttgtttctaattataaaatgtgtaatttttatttgaaaaaatttttattggaaaaacctagatgattcagaagactataaaaaaaaataaaaatcactcaatcctacctctaaaggataaccaccattatagtgtatacagtcagccctccatatccttgggctcagcatctgaggagtcaaccaactgtggtctgaaaatattcaggaaaaaaaagttaaaacagtaaaaaataataaaaacttaaaaaatatagtatcacaactacagttgacccttgaactatgagggcttgaactgcatgggtccacttatatatgaatatttttcaataaatatattggaaaattttttggagatttgcaacaatttgaaaaagct

SEQ ID NO: 112896 - DNA, 1652 bp, Homo sapiens
agattgtggacctgcatgtttgtgctttttatatgttgtgtctctgatgattttccctcttctggactgccgcatagtgaaggaagctctgtactttttaacaaaagttgtgcacgtatgtctagtaatggcatgaattgaagtgattcagaatttcttagaacatagtgagctatgcttcctgattgtttctgtaatctaaaggttattgtttgtaggatatgaatacaaaacctctgtagtgtttgtgtagattgtacatgccttttcagaggatagaaggtttacaatccatactttgtgagagtgataatgcgtcttttacagtgtgcttactctcaacatctctaatcttttattccaggttactaagtattttccatatcttttaactttgttcccataatgaatatgaaaattggaagcactacaataggaagtgttgctttcaacccttagatctcacattatctgagcagataacaacgtttggtgtttgtgattgggtgtgaagcttattttcaaaagttatattttctttataattaattttttagctagagtgtggtttgatatgtcgtgacttgtccaaagagctaatgttttgtagttcacctttttaaagcaaagagcagctgcattttgaaatgttttatctcaaatgggcaagttgtttacaagctagactctaacacatcctgacatttagtgtctgtgtttgtattcctgctgggattaggctgcctttctaattaattagttgcatagccttttattaattccctcaaaatttataatgttttaaattaacaacatagataagcatactgcattttttgggaaaacatgaaatattaattatgtagcagtgacataagtttcgtaaactctgttgaatgttagaagatgcttacaacaatgttttccaaatatagggatttattataaacttatccttctaaggctgcctgtgccatttcaggagagtgaatataaatagatcttgatttcttcaagaagtggacttagtcattttgtttatggtgaaaggaagtatttgctttgcgtctctaagaattgtctttagcatccttgttaattacacatcatttcaacatgttcttaccaaattctcaggccttgataaggtagcataacagaacaggaagaattaaaactcatatttaaataattattttgttattacagcacttaaatctgtctagtagcaataccgaatctaataattgtaactttttctgagatggaaaattttatctcttgtccagtgttctgagatatttttagctcatttgtccctccacccccaactagcttactttaacagggatttatggagcatctgctatgtatgtaatagtccaactcttatgaaaggttctgtttctaatattttttactattttttcaattctgtcaacgttgttttctaagttagaattaaaatattgatactgtagaaatttgatattttaaaataaagtccagggaaataatgggacttattgcaaagcttatggtgagctctacattcagatgctatcattatactttatcagctgataaacattgagcaagctattcaacctcttgggttttatatcctcaccagctaagtagggataacacta

SEQ ID NO: 112897 - DNA, 1217 bp, Homo sapiens
tttaattattctgattagaaagtactctaaataaagatattttcctgttttagtaataaaatattaaggaataaacttcattgtatatgtacatatggatacttagaactgagttttttcattttattaaaatttttttaaattaatagactttttttagagcagttttaggtttacagaagaataaagcagaaagtacagataatttccatgtaacttcccttttttccagcttctcccattattactgtcttgagttagtgtggtacctttgttataattgatgagctaatattgatacaatgatatttcattttaaactgcagtttataatttctaaaactaccatccctcaatgttatttaaaccagctctgtgttgttgctttatttatagtttttttttacttgcgccacactttttacatacttttttaaaataaacttctttctcaatgtattgcatgtatacataagagagcataagctaaaatatccatgtgttttccaaagtgaacacacttgtgtaaccaccactcagatcaagatacagagcattactagcttcctggtacctctctcagaccctttcccagccctacatgctcacctcaacccaaaaggcaaccactctcctggcttcgaatgccatagatcagttttgcctgttttgccttctcttctttcacttgttttatggtttgggagcttcatcattttattctgcatagcaggagttcatttttattgctgaattcgattgtttaagtattatgagtaatgccatgaacattcttgcacatgccttttgctgcacaaatgtatgcatttctgtctattatttgtctaagagtggaattattgggttataggattcttgttactaaatactgccaaaacgtttttgtagtgattttaccaatttacctttctacctgttgtgcgtgaaaattccagtttcttctcgtgggtgctgacatggagtttatagcagtatttcattgtggttttagttccctgatgactgagtctgagtactttttatatttgaattgaccatttagatgtctttctttgtgatgtgcctgtcaagtatctattcaatttttctgtagggttactttttaaaaatatattgatttgtggaagttattaatatagcttagttgtgagacctttgttagatatatgtattttaaatatcttctactctgtggc

SEQ ID NO: 112898 - DNA, 1042 bp, Homo sapiens
gagccttctacacttattcctccatccctgacccctcactagcctccccttttagatctctcccttgctataatatcaaatcttacatgtatgcacatcactctgaagtttgcttcgctcttgtatttcaaaatcacatttccaactgccacctgaatgtttgcttgcaggtgttttcccagtaccttaaaactttgtaattctagtttgaatgtatttaccaaaagggcaggggcaaaagcatgttttaattttaatattttactcttttaaaagaagttccccaaacaaattattttgataaatctttttggctttttttatggatgttgttttgtaaattctattttatatttgtaaataatgctttctcatattaagtatttgtcatattttcattgccaaaactaagtgcttggatttttacatttattcttcacattcttccacctctcttccaacctctcatcccctcccctacaaggacaaaatgttttaaatgctgtaatcttgcatggggtttgggttttttaatatttttattggtgataattctgtcacaggatccttagggtgtcacttttccagccagaaacctctgtggccggtggcacctctgcccgagttatatcctcgggcccactgggcttgttctgcccacttggtccagcaggctgtacttggcttgtgctattgacctggatcctacacctgccaagggtgagccaggcgcagagcagtgaagggggtgtgagtgagcccgaggtccggccactgcacacagccaggcatgctggctgcagtggagtggacagccccaggtgcaggcacaggcaccggctctgtgtgaggatgtggctggaccaggcataccacaagtgttttccaccgtgggcaccaggtaacgtggtggtacctggaagcttggagatgttggaaacagcagagccccaaagagagtgtcacagctctggtatcacagctctgatcacagcccttgcatctgggctccccagagggccacagctcctcttcttctcat

SEQ ID NO: 112899 - DNA, 1652 bp, Homo sapiens
taactttggtctgaaatcagagcaggcaaaaagtttttctgggactggggagaggccaggcagtagaagcaggcacttcggagcctgttggggcagggggtgcttcctgggttctcgagagtggagggatacctgggtccacagccatggctgggcagctgcagctgtgcctgggtgagtggggctcacaccccaccaacttggaaaagagcagggctcctgcctgttcccagctcccactggcttcgtggagtatgcagccctggccacgcctcccccactgcagccagtgtcttcactgttgccactccagatgggccaccggagccatcaattcagtctgtatttatgaaggaaaagacaaatcttgtgttactttcctctctttataggtctctgtgccttgcggagaatcctgaaaaaacagcctaacctccctgatgtcaaggtggctggactggtgaagattactctgaaggatttcttgcaggcaatgaatgatatcagacccagtgccatgagggaaatagcaattgatgtcccaaatgtaagtcatttatgtcccacactagctacactgtttgaattaaactctgaaaaaaatttagagttcagggagactgacttcctaggctaaactttaaaaaaatatttttcttaattgaaagttttattgagatagctgtaaattcagtgcagttatacgaagtaatgtagggagattctgtgtatcctatacccagtttcctccagtggcaacattttgcaaaactgaagtacaggctgggtgcagtggctcatggctgcaatcccagcactttgggaggctgaggtgggcggatcacttgagcccaggagtttgagaccagcctggttaacatggtaaaaccccatctctacaaaaagtacaaattagttgagtgtggtggtgtacacctgtagtcccagctacagctgaggtgggaggatcatctgagccctggggaatgttgaggctgcagtgagccatggttatgccactgcacttcagcctgggtgacagagcgagaccctgtctcaaaaacaaaaaacaaaacacccaaaaaactatattacaatactaaaaccaggatacccctattgatacaatccattgatcttactcatattttttcagttttacttgtgtgtatgtgtttatttagttttatacaattttatctcatgaaaaggtttgcatattcatcacagatactaagtaattccatcaccacaaagatccctcatgttgtcttttataatcacacccacctcattcctcccctcatttctaaatttttatttcagaacctttatataaatggaatcatactgtatacaaccttttggaattagcttttttcacatatgagtaagatcttttgtctttctgtgtaccttaacttatttcagtaggcataatgttccccagattcatccatgttattataaatgacagtattttcttctttttataaggccaaataatattccattatgccacatttctttgtaccattataccacattttctttctctgttcatctgttgagggacacttagattgattccctatcttggatgttgtgaatagtgctgtagtgaacatgagagtgcagatatcgctttgaga

SEQ ID NO: 112900 - DNA, 10043 bp, Homo sapiens
ttggggatactttatatgctaaagataaaaatgattgtgtgttctataaagatctacaaaaatatgcttggaagtagttttgctaaaaaacaggtataagaaattagatatatagatgagaccttggatgacttgactcaaaccactttcagacagatgaaacgtaacttctaaatctttctagaaggttagattttacgatatgctcaatcatttaaacagttatttatatgagacttacaagcagaatttttttttttttagtatttttacaatatgcagttcacattttatgtactcctaatttacttcttgttattcttggaattttttaaaggattttcctgattcttaaatggttctattcttttttgcagttcttctgttaatgatatgttttttatttttttttagttctctgtttgtcctggcaaaacttatatttggaaaatgttctatttttcaggtatcctggtcagatataggaggactggaaagtatcaaactgaagttggaacaggctgtggaatggcccttaaaacatccagagtctttcattcgaatgggtattcagccacctaaaggagttcttctctatgggccacctgggtgctctaaaacaatgatagcaaaggctttggccaatgagagtggactgaattttctagctataaaggtagggtgttaaattttttaatcgctactctctcttggcctcccccaacccccattctctgactcctacctttaggagaacgaataaaggcatcttaaggagcagtgattcttttttttttatttgatgttgatggcaatataatatagggagatgagtgataagaaataaattcgtgcatgtaatcagcaaatcatggtagacattgggaagactgctttatttagtttcttgattctggtatttcttatatccatgtgtaacagaagctaatctttttttttgtttgtttctacatttttaattatagacttttgcttaaccaggacttaaagataaacatgacagtgaattcaatatttacatacctagaattttcaaatgaacaagacacttgttatggtacactaaattctttaaaaatacttttccattcagaaagtatatgtgcattgtttttattctgaaccacacacacattttatttgttcattgcttcgccccgattaactgggatagataatctttcatgatatgtagttgtacacttactttaggaccagatattaattttatgtaacattatgatatatccagatacttaatccacacatataaaactgtaaatccatttctgtggactgtatcacaaaaatatatacctaaatagattaactatcaattcatttcagaaaaggcacatgatcatctgttttgatattaccagggaattttttacataacagaatgcattttctttagcgtgatcttggctcactgcaagctccgcctcccaggttcatgccattctcctgcctcagcctcccgaatagctgggactacaggtgcctggcaaattttttgtatttttagtagagacaggtttcactgtggtcttgatctcctgacctcatgatccgcctgcctcggcctcccaaagtgctgggattacaggcgtgagcgactgcgtctggcccagaatgcattttctgtcttagaacattgaaatcattggcagtttgaaagcacaaaacttcagagtagtttgtcaacttttggctttacttaagatttttatagaatgatacttaggtgtgattaagctgtttgttctttaagaatcagtatcttcaacatattttttattttctggaagatattggagagtaaagatgggggaggagaccatttacagcatgatcacttatggggaatcacaactacagttttaaaggtttcaggtttatttgttatttttttgagacatggtctcactctgtggcctaggctgaagtatagtggtgtgattatagctcactgtaacctcaaattcctgggctcaagctattcttctgcctcagcctcctgagcagctaggactacaggtgtgagccatcacaccagctaactttttaacatttttgtagagacagggtctcactgtgttgcccaggctggtctcaaactcctggcctcaagcagccctcccaccttaccctcccaaagtgctgggattataggagtgagctgctgcaacacagcaaaggttgcggttttaagggttgaagtaatgagtgattttgtcacttcccaggacaacttgatttctccttggtccttgtccttttatcatgtggtaatggggatggctgtgtttactggcattttctagtctttttactctcatctccattttttctgttcttaccttgtatattctacaattgtatattcatagtattagaatttttcttgtctactggaaatctaaaatttatttaagaacctgtgagcgaagtcctcatcagataagttttcgacttaactcttaagagcacacttattttcttacaaactagtatcttactttttctgtgatccaaggtaataattttagatactactaagactgctttctggactatcctagaattacttagaaatatatttattatcttttttgaacataaacatttcataaccttagacaatttcatttttagtctttttttcactatgaggaaattgtaaatgattctttgaaaggtttaactttgtacactgctatataaaataaccaggcacacattcatttatttgagctttttcattagatttttaggtcacagacagaaaagccacatgatgttaacaaattatcttcatcaattgagttcataactcagagattattacatgtcctagttactaattttgatttagtgtggatttttattcagtttagaatttagtgtggttcgacagtattattcaatttttgaatctgtatggaggatatacttaatgaatgatgggtttttatttttcaaattgaatatcccttatcaaaatgctttggacctgaagtgtttagattttgaatttttttgcattttgaaatatttgcattatacttcccagttgagcatccctaatctgaaaatttggaatctaaaatgctaaagtgggcattttctttgagtgtcatgttggagctcaaaacgttttgaattttggagcattttggatttttagatttagggatactcaacatgtactattcgttcaactctcctataggtttaaaatttttttaaatacaaagttgggaatatgaaaataatttgtcttctactagcattttcattggtccttttattttcatctattcagtgtttgtgaggaaagttttaaagtaacaataccatacagcttatgtatgagaaaatggagccaaagaagttgggaattcatactctgttctctttttttttgagacagagtcttgttctatcgcccaggctggagtgcagtggcacgatctcagctcaccgcagttcccacctcccaggttcaagagattcttgtgcctcagcctcccgagtagctgggataacaggcaagcaccccaacgcccagctaattttttgtatttttagtagagacagggtttcaccatgttgcccaggctggtctcgaactcctgagctcaggcaatttgcccgcctcaccctcccaaagtgctaggattacaggcgtgagtcactgcacctggtcctgttctgtttaattttaacttcctgtttaaaaaacttggcaacttttgttcaacccaaatgtttggtttcaacctatatatttgttttctacaagctttaagtgttaaaagttagtttgaaattttgaaataacaaatcttacacattttgaaagtgatcagaaaaagtagacatacactagaattctctagccagttaggaaacacaagtattttaaacagattgaaaggaaaaactccctatcacttttcacaatggtagttactacttttaatcttcaagatattttgatagacttacacttcttcctctaagtttatgaaagaaccttttagcttcctctatgcatcttttctgaacagggattaaaagatacgtactgtactcagggtggagacttcagcttggcttgtgtgagctcttaatgccctctggcatatatatgtgtttttgtgtagattgtgacatttgacatactgtgtaagtttagtttgttatctgggacagttacgtaaaatactttccagttgaaatttcctttctgcttctctcttgcttttgtctggagtgctacaatagattaattgccctgggatagctgcattgctttactatatgaagaactgtcactaattctgcaagaaatgtggttaggtctttgacagggattttcagcaaataattattctggtaaatacaggaatgtaatgagcttagtatatccttgactttttgggaaattttcttctctatacttgtctcagagaggaattgtataaaatagatttcatttccagaaaaacctgtggtttattcaaagtagtgcacaattcagagtacaggtgctccccaatttaagatggatttacttaagttttcgactttacaatggtgtgaaagtgatatgcactctgtggaaattatacttcgaattttaatccttttttttttcctctgagacaaagtctcactctgtcgcccaggctggaatgcagtggcgcgatctcggctcactgcaacctctgcctcccgggttcaagcaattctctgcctcagcctcccaagtatctggggttacaggctcccaagtatctggggttacaggcatccacgactatgcccgactaatttttgtatttttagtagagacggggtttcaccatgtaggccaggctggtgtcggactcccgaccttgtgatccacccgccttggcctcccaaagtgctgggattacaggtataagccaccacgccaggcccaaattttaatcttttactgagctagtgatatgcagtacagtactccctcatgatgcctggcagtaacagtgagccacagctcccggtcagccattgtgatcatgagtgtacacagccaacattctagaatgtactgtgttgccacgtcactttttccaactgtaggccagtgtaagcattctgagcatgtttaaggtgggctgatctaaaatatgatgttcagtaggttaggagtattcaatgctttatgacttaggatattttcaatttttgatgagtttatcaggacataacccccttgtaaatcaaggagcatctgtaattactatttgtcatttaactagatatattaatattctcttatcaaaggtacaagataatctgaaatttaaaaattccaaattcatctttaggcttctgttttttaatttttgcatgggaagctgcatagctcttttaattacagaatgctttaagattacaaataaggataatgattttaagaaggttaagtgacttttcgaaggtctaagtggtagtgatggcactgaaatttagtctcagaactttctgactcaagagtctgagctcttaaccactgtattatatatatgctcttccatttccctttttgttttttttaaaaaaatagaactagtgtccaatggcttttttcattaattacacaaagttaccagggaagatagtttaagtagtttctgtagggtaggtttagagaagtggaaagatgtttctgggaactggtttgaaaaataattttgtttctctaggacaaagaaaacagaaaaataacatggctttggtctaggagtaaaagttaataggaaagggcaatcacagccaaagatacaggaaactgttcaatgaaatagaagtgcctggaaaaagactgatggtgggataatggggagcttaaaatttacctgttagtatataatttgtgcccttgatattgagtatgtcacgatgaaaagaacactaagctgggattcacattgcttggatttacttcctaaccttagcactttttagttttgcagccttaagcaagttctgtaagtctcatttttttcatccagaaaagtataacatttgtacattataagctttggggagcattatgcttaaaaaggcaaatgaaaaagtttttggggggcataactccccactccttgagtgtgggcttctttccaaagaatttaatatcaaaagaggggaggggaagagctactgtacaatggtgaaacctgacaagccgtgccacagccagatgatcaaggttaacatcttcagtgataagtcatgttgacagtacagttgatgctttgaacaacacatttttttaatacatttttttttcagtatagttgcccttccttattgtaggttccacaaccaaacacagattgaaaatataatatttgtggtatatggaaactcccaaataaggagggctaactatgtgtcctcagattccacaggctgactacaggacttgagtatgtgtgcattttggtattcacagtggtcctggaaccagttcccgtagataactgataaatgactatatatacccttggataatgtggtgataatagcactttacttctgttgtcttcctcctgagtgctcataacccctctccaaccatgagaaaaattttaggcaaacccacgttaaaagacattctgtaaaatcactgactagtactcctcaaaactgtgaaggttatcaaaaacaaggaaagtttgagaaactgtcaccaccaagacagtacccaaggaagcatgatagctaaatgtaatgttacaatatcctgtgtaggatgctggaatgaaaaaaaaaaaaaggacattagggaaaaattaaggaaatctgaataactatggtctttagtttaataataatatctcaatctgggttcactgattgtaacaaatataccatgctaatatgagatagtaataataagggcaacagtgtacatgggtgggtgggcatatgcgagctgtttgtactatctgctcaattcttctgtaaatcttaaactttgctaaaaaataaaatatatttaaataaattttgaggtcagtataatagatctgggcatattgtagatgaagtaattgaagtttaaaaggctaactctgagttctgtactgcagtgaacaggatgcatggagtaaggcaaagaagagtcatgaagaagattgtggatttcatgggtgagggctttgatgacctctcctattcatagtccccctgcccataatgatagtggaaagttactgggaaaagccctgagaggaacttggctggggaacctgggtttggggctgccctgaacttgcctgtttcactgcacttctcagttgaagcctataaaggtgtgtgttagttctggccccaaacccagaccccaacactataaagaactctttctcttagtgttttggttattttttctttcaccttgggtgcagcttccagtttagtctcaccaggaactatgtcatttcatgccttttgtggatcctaagtctgtattctccttctataggtttattactgtttgggctcatctagagtctgaaaccttttgagtttctatttaatttcctttagagttttgtttttttttaactttaaaaattcccttgacttcagcaaatagtgttgtattatgtgccttatttgcttaaatcggcagttattaacatcaatattaaacaaagacatatacttagttttatccctgtttgaatgactattagggaataactaatagtaacctgttattcttgggacaagtggaatagttattgtgccattgtcagttttacaaggttatgaagaagttagatcagatttacttacatttgtcattatttgtacagtatactatgttaaagttgtggcatcatatgttaagactatatatatgttattttttttgagttgggcttttatcagttgataaagctgatatataaaaaaaagtcttgatgtgaaaatattccataaataacatttatctaaaagcagaaaatgacaataagaactataacaaaacctttagcatttggaatctaagaagacctagagagatttagaaaaagaaggataattttataaggaattttataagaaaaaggataattttaaacttataagaagtttaaaaataagcacattttattgttgggtttaattttttattcatggataaattagctgatgtagagaaactagttttttctttctatctcaattcctttttgaatgaaatttagaggtgaaataaatattacaatgtcatgtctgtaatacttttaaaaatatttgtaaaagttttacaattggaatagcaaaaataacaccttctgtgtgtcaggcactgtgcatagtaaacaaagatatattagatgggctcctcgttatgtatcaactcattatttagtgggagagatatttgactcaacaactaacatgaagaaacagttaacagaatctgcagctcttggttgttgattgtatgtgagaaatgagaaagaaaagcagtcaaaggtgataaaaatttttactgtcaatgactggcagatggaagtatcctaactccagggagaaaaggagaaacaggttggaggtgagagagaaaataccagtgttgagtttgaaaagcctttgggacaaaatgttgaatatgtcctaaaggcagttgtatatatggatttgtagctcaagaggatgattatttcgagagatgaaaatatggaaattgagatgaaaatgtggaaattggaaatcagtgtttgagattctgcagacaagtcagcaaaggagactgagagtgacaaaagtagtcattaatagcagaaggggatttcatgggcatgtaaatatgtgtaaatacacattttacaacttgcctaattgtagccagcatggtccctgcaatgtaagttctgaagaaatgtgtcatttttctttttcctgaatagaatgaatgaatttggggaaggattgtattatactttatgagaggaacagctcgaattctgttctcttccctgccagcccctcttgcatttcagggtttttacttgcccacagcattcttgcctagtaattaaaacctattttcaaactctttgaagtgctttcccagaatggccttctgtatgtgctgatactgtactttttattaattttcaagttcctttactcacattacatatatgtaattctatcttatgtgagtttggatttttatgagcatattccataacatttaaccatagttaacacttaggttaacgtgccttccccagacactttagaacttataaaaacttcatttgaattgtaataactaaaagcaccaggcaggtgtcagacacatttaaaaagcccttgggaggactgaaaaaaacccagtagtgattaaaggggcaaaattgtaagaacatgaggtgtaaatgttatactcgagtttgtgactgatatgatgtaaaataatgaagcacagtaaaaagataagtcaggtttacttctcactagattaatagaacagctggacaaatattttcacatgtgtttatgatatttttgttattttgtaaacttggatacttgaaatattggccatggaatgttaaaagtaatgctattaaaaataactcaattaatggtacttattaatggcagtttttcttgatcattcttatcagtaaagcacatgctatctaggaggtaaaatatgtggcaagactaacatacattcttaaaagtaacataacttatgagcaaatacgggactgagactatactatatatacctaaactctgtagttagatataaatggtctcttgtttataacgggtactaataaaattcttattttcaaattagcctatgctactatctattaagaaagaattatacttcacctttgccactcgatctgctcaccagaaatacatttgaatttgaattgctggtactgtgtaaaatcttgttttaaatt

SEQ ID NO: 112901 - DNA, 1032 bp, Homo sapiens
ttaatcagtgggaaaaattacaagtgttacataacttttaaacattttgtcaaaacattaagaacgttcattcttggttataaatgttgaggcagtgcattttggctgtataacagatcccttgctagtttccctacctcttaacttatttctttgactagcccttcattcacacactgacagcctagtactccattttatgaggacacaacaatttatttactcatttttatgttaatgaatttttaagacacttccaccttttatttttattgttgttataaacagtgctcagtaatattcttattcattttcttttgtatattggtaagagtttctgtagggtatacgtatctagaagaagttgttattgttattggacatgtacgcttcaacattactagatagtttgaaattgctttttttgtgtgtcattaattttttttgcttaatttgtatcaatcaattttttaaatattttgaagattgttcactccttagcaattatgtcattgacatttttgatgacttttgatcttatagacaaaagtgaactctttcaaattatatgagattaatctacatcagaggtcatagtctttagacataatctggcctgcagtgtattttggtccagctccctagctaagaatgaatttttcatttttaaagggatattaacaagaagaatatgtgacaaagactttatgtggcatatacagcccaaaatatttactctctggctctttatatttcgtctttttagatcccacaatacgtggaaaactgccttcaagtttatttacctcagtgacggctgtgggtgtaaacattgtgtcgctgttacatagtctaacctgtatctaaaaataagcttgtaaaattgatttggtattgtttctttttcttcaaaatccttagaagtatgagaacattttgcctcagcataattaatgtttcattgtttgtctttttttaagttaaatctgtttggtagttgcattatttaaaaaattgagatatggaagtatt

SEQ ID NO: 112902 - DNA, 1086 bp, Homo sapiens
ttgtgcatgcatgcatgctcgtgcgcacacacagagagagggagagagagacacacacacatgtctcttgttcttcgggatgtatgaggaactgtgtcagaatagccagatgctcggagaaacatccccacaactgaggtcatctatcattatgggacaatttaattcataacttcttgtggtgactgtttatcttaagagagtagatatgtatgtggtaaaaaagaaagtctgctgtgtttcttacaatatttgatattctaggtacttgagaaataagaaatattaaagttcagaaatattaatgtcaaaaaatgtgcatcttcagatctggtaagtagacctgcttagagctagccagtggttaggcctgagaaatggctgttccatcttctgtgcctagcaccacatctgatatagtgtaaaaatgtggatagagttatagacagatgatgaataagttgttaaaatattatgattagtcacagcctttcctttgtattgatgtgtggtttttggaatgtagaatggctttaacttttaaggcacaaataacaaacagagaaaataagcatgctaaagggattaataagcagattttgtttattttctcttttgtgtatattttttctacttcattggaagaaatatacatgattgcatttataaagacactgaacagttgttttcttttcatgcaggggcctgaattaatgaataaatatgttggtgaatctgaaagagcagttagagaggtaagaaattgtgcctttagtggcactcagcacaggagaatcacacttctgtcctgtgcagcttcccttttgttttaggtaacagactttggcatttccgaagtcagatcttagtggtatttttttttcttcaggtaaatattattttattatttaaaaatgcagttttgatcatctgcaatacttcagttttgtttttaaacatcatattaccagcccttttaaaactatcattttttctgataataatagccagcatttctgttaaaatagttaatgctgttactaatagttaataatacctatcatttattgagctcttactgtttca

SEQ ID NO: 112903 - DNA, 1051 bp, Homo sapiens
tcccaggttcaaggtattctcatgctgcggcctcctgagtagctgggattacatgtacatactaccacacctgactaatttttttattttttttagtagagacggggtttcgccatgttggccaggctggtcttgaactcctggcctcaagtgacccacctgcctcggcctcccaaaggttttacagacgtgagccactgcgcctggcccgagtttatttcttaaaaacttatatttagtaatttttttgtggtcaaaggacatgaagttagaggatagtgtgtttagaactggctttgtaatggacttggtacgtaaaccaaaggaaaaaaaactagcctgctttctttgcctgtttctcaagaaatcgggattgtggtgattacctaccttctgatgtgttttaaaaatattcttaatatttatgaagaaacatcagaaatatcctagttgctgtggatgcgtaatgagttttttatttcacatagactttaggtttcatgtgaggaatgggtttgcatcttactcagttttttattctaatttctgtcaacatatttaccatgtagaatataaacattgattgaacaattctctatgtatttgatgaactattttaaataatcttatatcttgttttccagtgcttttatttctgacatttatttaaatatttttgttttggaatgaaaatgaacatggttgatgatagaggaaaataaatgatttgaatacagtttgttttgagatatgataatgcagtaaataaagtctcaaatgcatacttcatatttgaaaatagacatgatttctcttgttatagactatagaacctttaaaaattaatagataatagtatttgaagataagtaaagatattttttaaaccgtactttcaaaatcagttctttaggtgctgggaatgtagccgatcgtgttttggctcagctcttaacagaaatggatgggattgaacagctaaaggatgtgaccattttggcagctactaaccgtccagataggatagacaaggtaagagagaaggcattgt

SEQ ID NO: 112904 - DNA, 1689 bp, Homo sapiens
tgccctgggtgaatggaatcttgactgcatatgccccacttgcactgcagctgagggcctctggaaagcaccctgttccaggttttatacactgagtatgtgagactcactgggctaaagtgttggaggacatcctgtttttaggggaggactggagtagaacctgggctgttccagccggtccctccctgtctcaggatgttgcatttcctgcacatgctacagttattcttgagagctacgatgggagagagagaacttggtcattccaagaccacccagagagctgtcctacaaaggatcttaaactaaaggaaatgaagagaacaaaggaaagcttttatttacatttttattgcttatgattcagtattaatgaaactatttcataactcttcaatatctactccccaatcttgtatcttacttttagcatatttctctagagaattgaagttttgaaattctttgtttcatctaatttattcttccagagttttcaacattttcatctatacgaaggtacattctagctatttagcaagtactagttagactccagttgccatcaacacaagaactttgaagaagtactgtcctaattgttgtttttaaagtaattagaataaaaataatggattcttctatttttttaagaagttagtcaggctgtcacattaaattaagtagtataggtgcaaaaccagtccttttaaactattactaccactttttccctaggtcataatttaataaaggagttcagtaatttaagttcctcatctatatctaatatgtaatattttataaggatttaagttgagtaaacatttgctctcagagcgtgaaccagtttctcttttttgttgttgctggcattattgccttgtgtatgactttatgagctactttcttcctgtgtacatatacacattctttcagttttaaaagatgtgatttttaaaaaagacccctttgaatgtaactattatgtggcaagaaagccttgctttggttaggtattttgctgtgtgataaagatcctttggtaaaattcaggaaagctttggaccttaaaaaatcattcccttcctgatgcagtattttattagaagataggtgagttctgagtatttatagaatctgggttggtgttaaggcatctctgaagtctatacaaagtataagactgtatcttaacaaggactgtagaaactgctgaaagagcccttaaagtttacctaattctgcctctggtttcacaaataaagggtgctgaatccagaaaaatctttctcctggtaagaattcattgtatttttatgatatttatttcctggtttccctgtggttaataagctctaaaatgtcttaggatttttgtcactacggcttaatctaatagtagccttctttggcttcctaatgttgggtgtcctcgatattagatatatttcttgaagtaggatgtaaggcttacagtaaacttaactgcatttttctaaatcaagctgtctgacttggcctgtttagtgcttgtattgttgttttctttctgtgtaacaaattaccacaaatttagcagcttcgcacccatttgttagttcacatttcttaggttagaatgtgggcacagcatgactagtttgtctgctcaggatttaaactaaagactgaaaacacagtgtt

SEQ ID NO: 112905 - DNA, 1047 bp, Homo sapiens
aaatatctaactgtatgattaaagttgaatcacttataaatttgaaaaagcttcttgtcttctattgttaatgctcctagaatctcatgtttgagaacgaatgttcagtgtagccaaaacctaaatctgggactatatgttgaatgttttaaagtcactagtagaagggcaatttggtggctaattttaaagtacataaagagtattaacaataatgaagtgtcattttgttcctggcattctgtgtgtgtgtgtgtgtgtgtgtgtgtgtgtgtgtgtgtggtgtcaaaaaagtatctgaaggggcctgtaatagaaaacctagttcctttatgatatacacaatctagcttgaaattttaatgcattaaattcataaaacatgaagagtttaagctttgcaacacttaattgacacatgcgtcagaataagtttggaaaaaaatgaaccttcatacattttgacttctctgttttctatttgataactttggtattgcagttactcttttttgacacaagatggtgatgttcacctgaaatgtttcctgagtacaggctctactgcgtttagaggctcccccttatttatccaaagagcagcttaaagaaatgaatgaaactggctttgctttaagagataatagttgaagaaaagcaagagagtgtgtcctcttttataactgatttaacaaataatgattcaaatttaagtgtgggtttgtgtgagttgaggactggggagcggagagcactgggaaaaaggaaagttgaacagtggagaattagcagtcattaggtatgcagtatgcattaagtctatgctatgtgttttacatatgatgtctagttaattttagtcaaatatgagcactttacatgtattttacacaatactagtgcattccttgtttaattgtgcaagtttagaagtacggtgtgtgtttgttctttcttaaaaaaattatgacgtatcatcagccagtgtagtagctttattcataatttaagtgatactgtttcatttttaaaaatacacaagtttct

SEQ ID NO: 112906 - DNA, 1077 bp, Homo sapiens
ttagagaatttgatttcttaataaaaatttggctaactagatattttacatgtaaatcttttagagaatttattcagcaacaaaaatcagttatgtgtgtattgacagtttctaatctaattttcataaatataactaaaattatgaaaatgtacttaaaaaaaaaagctagattatactcctgtctcctagaagggacagtgcaggtaaaccagaccagtgccttgtatcaataattatgtttcataccaagtaataatgtttacctttttgttatgccagtacaatttatggcctaaaagttacatgttgtttctgtttacatcaagatatttgatgacagacttagtcagaggtatgttttgttatgaaaaagacaatgataagccagttgtaaaacgagtgccttttggaaatcttgattccggaacttttttttttgtattagagtacaaaaaagaatatttgtcataggattttataaaagtatagtatattctatctaagtagaaagttgaagaaaatagaatgctaatgttggagaaggtgagcaaaattatatttttatgaatgtttaggatattttgggaatttctaagagttcagcctctttaattctatagtttggggcttaacgcatttttttttaaatatgtgtgtttttttagaggctagtagaggcctgacattttgagtttaacaactttataaggtttattcttaaattctgtatcagacttaatgtctttgaattgtgtatttaataatttgatgtccttttgctactgcatttataaaccagaattcagtctttgatgattgcattatattactaagtgatttgggtaaagacagaggggaaaaagagaaagagggaagatggaggagggtagagggaggttgaagtggtatatgtgtgtcggttgttgtatttatgttttatctttgcttgttagacaattagaattgaagttaaacactaggaaatagatgataagtttatctctatactcccaggaaaatttaacattagaattaaggcatttagctaaactaagccaagattggaaaactact

SEQ ID NO: 112907 - DNA, 1032 bp, Homo sapiens
gccatcaatttgaatggtttatattttgccgtccttgttgagaagaaaaacatggatgtatagatatacagtgatggatggactagcagcttaagaatcattttggggacattttttaaaaaattttttgagacagagtcttgttccatctcccaggctggagttcagtggggcaatcgtggctcactgcagccttgacctcatgggctcaggtgatcctcctgccttagccacccaagtagctgggactacaggcgggtgccaccactcccagctaatatttaaatttttatagagacagggtcttgctttgttgtgcaagctggtctccaactcccaggctctcacagtcctcctggcttgacctcccaaagtgccaccacacccaggctattttgaggacgtttctcttttcagaaaagttataagtattttgaccctgcatgaaagtttggaatgatggaatcatataaacaaaaacaacagaaagcctcaaaagatttttttaaaccaaacaaaaattattggaaccagcttttacctcaagcagtgaatgagctacacagaaagttgatttttcttttattaatgattgctagtaatgagaattttacactttattcttctcaacctccctccaggtcagttttggttgttacagctggaggaatgatactggcatccagtgggtagaggtcagggatgttaccagacatcctataatgcacaggaaaaccctccctgacccacaatgaaacattgttagcccaagtaatgctgagattgagaaaccctgctgtaaagtgtggatttttatcttgatgggagtttttccaaatagctacattgatgtttacaatgctttataaataaagggaagttttgttctgtttgtttgaattactaataagagataaaagaggctttagagacagattttgggatttatagatgcaataaacacataaacacagtcttcgaaaaatgttcatggagacaatatggtgatcttgtgatacagggaaatggaaa

SEQ ID NO: 112908 - DNA, 1058 bp, Homo sapiens
atgtctttattagcagcatgagaaggaactaatacagagatcaaatcatatttttgatagccgtcagataatagttgtttcatgaattttgcccgttaattaaaaataagactacatggccaagtgcagtggcccacacctgtaatcccaacattttgggagcctggggcaggaggatcacttaaggctaggagtttgaaaccagcctgggaaactttgggagaccttgtctctacaaaaattgaaaaatcagctgtagccctggctactcaggaggttgaggcaggaggattgctagctagatcctagaggttgaggcctatggtgatccgtgatcttgccactgctctgtagcctgggtgacagggtgagactcttgtctctaaaaataaataaacataagacacagaagctaaatatttaaatctctttagttttcacaggaagtcaataatgaaaccaggatctgagtagaaacagttattttaaaatcataatatcacagttttatcatatcagtttttatagttgtaaaaatttcacatcagcagagggcagtcaaaccatagttcattcaactatcttatgggaaattaaaattttctctgtgtttttctgcttaggacacaagctgtactttatataatcagtttgtaaatacatttcaaagctcttcagttggtaagctgatagaattgtattactgtttagccacggaaggtaaacagttttttttaataaatttaaataaaaggaattaatttttttagatcatgaaatgctttattatttggtgtttttgatggatggccactttacatagaaatttgttttttctgcctcagaagcagtatttctgttaaattgcctgttattaattaggctattttttattcaaaaatattaacttttatggaatacctttattttcccctatgaacttgagaaaaatgagtttttattagaggctatagtataacactaactaaaatgtagtttggaaagttttattgagtttttcttccttaaccttttctttggctggctgcaaacaacta

SEQ ID NO: 112909 - DNA, 3113 bp, Homo sapiens
ttttaagtaatctagcgatcatttaaagtatatgggataggcataggttatatgcaaatactatgccattttatataaaggacttgagcatccatggagtttagtatcctccaggttgcctggaactaatccctcatagatactgagggacagctatatatagaaaatcctaaggactccacccaaaactgctagaattcataaacccaataaagttgcagggtacaaaatcaacctacacaaaccagtagcattttgttttacactaacaacaaactgtctgaaaaaaattaagaaaacaatctcatttacaatagtatgaaaaaataagtaaaacaattagtaaacaaggaagtaaaagatttgtaatttccaaatatttggaaatttttcagtaactcagtgtctttaactaataatttaatcattctagtaagaaaacatgctttgtatgattttagtctttacatttattaatttatgtaaattaatatgtgggttttatgatcacccacgacattgtcctaacttgtcgactgttctgtgtgctcttttaaagaaggtagtctgttggccgggtgcggtggcttacgcctataatcccagcactttgggaggctgaggcaggcagatcacctgaggtcgggagttttagaccagccgaaccaacatggagaaacccggtctctactaaaaatacaaaattaggccaggtgcggtggctcacccctataatcccagcactttgggaggcctagacgggcggatcacgaggtcaggagatcgagaccatcctggctaacatggtaaaaccccgtctctactaaaaaaaaaaatacaaaaaaattagctggggtggtggcaggcgcctgtagtcccagctacctgggaggctgaggcaggagaatggcgtgaacacgagaggtggagcttgcagtgagccgagatcgcaccactgcactccagcctgggcaacaaaagcaaaattccgtctcaaaaaaaaaaaatatatattagctgggcgtggtggcacattcctgtaatcctcgctacttgggagactgaggcagaagaatcgcttgaacccaggaggcagaggttgcagtgagccgagatcatgccattacactccagcctgggcaacaaaagtgaaactccatctcaaaaaaaaaaaaaaagaaaaaaagagaatgtagtctgttgttgggtgcagtgttttatagaggtcatttagtcagtggtccccaacctttttggcaccagggaccagttttgtgaaagacaatttttccacaggtgtggggcgggggttggtttcgggatgaaactatttcacttcagatcaggcattagattctcataaggagcacacaacgtagataccttgcacgcacaattcacagtagggttcacacttctatgagtgcgcatctaacggtgcggctgatcaggcagtaatgcttgcttgcttgtctgctgctcaccttctgctgtgcagaccagttcttaataggctgcaatctggtactgatccacaacccgggggttgatgacccctgatttaggtcactttggttgattatgctgctattcatgtatttgatattcttgaagaatttctatttggtctattcttttggttcctgagagagaaatgatgaagtctccaagtgtaattgtggatttctctatttctcctttcattttcttcagctttgcttcatctgtgttgaagctctattcttagatgcattcacatttatcaattgttgcaccctctacatctcttggtaatttttgtattctgacatctaacttcctcagattttaacacaatcaatccacttttcttttgctggtgatcacgtggtctcattttacattcttttaacatgtatgtattattttattacagttgactttcatatagatagcattcaatttgtatcttgtttgctgtacagtcttaatcaggtttcttaaagttgtgtttataccatttagtataaatttccatatgtttgggtttatgtctgtgactttattgtttgctgtttgcttccgtttttcattcttcggttttcctttttctgccttcttttgaattattggaatattttttattactttaattcatttactggcattttaaaatttctttgttttgtgtgttgctctagcaattacaatattcacatctaagttttcacagtctacttagagttaatattttatcacttgaagtttctatacattagtatagaacccttacaatgatctaggtcaagaagatagggaaaatggatatttgatgacagctgggtgtctgccacaaaggacaacattaagttgccttttagcccacacttctcttaatcttttctgtactgcttgttatgcatcctttaattatttgttttattctatattaatttcagcctatagtgtgcaattatatggaaaataacgttatgtccatgcctcctttcttgggatatttcctaaattcagtatgagattgttgatatagataagaaaactgacttgcaaagagatttcattgccccaggtaacacagctaagtggcagagctgcaatttgtactctgagtctggttttggggtctgcacatttgaccacaatgctactgcctgtattttacttaagataatagttatgtttatgacaaacctctaagtatgtatgacttctaaatttacacattctttgagtgttctaatttcattgtcataaaagcttactattttctcatttttaagacatatttcatacttcttaagatagctcttaaatgtattccagaaactttaaacatttttgatattgttgaactagttttggaatcaaaacaatttgtgattcccacataattgcagttaaattttttcagtgtaattttaaaaataccttatgggaaaatactactgcaagttgtgtaacactttaattatctattttttgtaatcataacagcgtacacttaacatttggaaaaaaaataaatatattcaaaatatactttttcatttttttaaggtaatatttggtatttataggtcttcaagcccaggagcctacaaccgacagactgg

SEQ ID NO: 112910 - DNA, 1706 bp, Homo sapiens
ttttttatctgaacatgttgcagcaccattggaaccattgtgtcactttaaccaagcctccaatatttttattctttcagatcacaaggggtggatgccaaacctctcatttttttccctcatgattacactacaaggcaaagcgcacagggtttgagttcgttgcagttgctagggacatacacctagggactgactactagggcaacctatgctgtcatgtcacattgttcataagtcttccgtgagcaaagatctgtcccaacaaatgccccatactcctttcacttccaagttattttctatcctaaacaatttttccttcctttatactggaaactccaagatctataacattttatgataaacttgatcttattttatattatatatttgtgttcccatttcactcttctgttatcttactctaacacttaaatgctgtatgatcaaagttaactaatttcttaaatttaatgaatctctttaaaccaggagatgtcatgtcttggttgtgcatggtatacataggaatgatagtttaaggaaacccatttctagatctttagtgcctaaaactgatctgcttgagaattcacttgtgatgggggtggaagtttctcttctccaaactcctctttacctctgaagcatcaaacaagtgggcagtgggaaatacaggtattacgtttgagagaatagatggcactaaagccatctattattaaactggtactcagtaccagtttactgagtgtggtctgaagatcataataattaccatttgcctttttcattcttattttctcagtagttacaattaaaaaagattttcagttgttatctgtcatcattcctgatatataatatagacagatttcaaatacttgaggaatatgattagaacagaattacttctcgcttatttgtatgaacaaggtttctctgtactttattccacaaattttttttagaaattgaaatagaatctaaaaaattgaattgtagcaataagtaatagtttacaatgtctataaaaattcactggggagggagactaataagaggattccagctgtctcattaagaaacgaactttctataaccttaatgtttaattatattttccaaaaatcattaatacatttatgtaattgtacatgaatcattgtaatgctcattcaatccagaagaaacgtaatacttagaaccttatgttcatatgagtgaacactttttaaaatttcaaaatatgtgcatatttttctaagaattattacaagatgatcagagaaagaaggaaattctattgggatagtagagtagaagtacaaattcaaggagaaaaaaagagcagtgtaaaatttctcaaagatatcttttaaatagatggtagtgttaaatcactgtatatttaaatctgttgaatatgttgaaagagttgatgtaaaggtcttattttaaaatctcaatatttacaaaactctggaaattacatcctttaccactatttaaacatgggtacatgtgagaaggcaaaaatctcaattttcttttttaagtatacatacagttcctttttagcactaagagctacgtgtgcataatgattgagaccagaactccacattttgttgaaaagtggggagtgagggggagagagagaaatgcttttaaaattaaacaatgaaacttttccggggagt

SEQ ID NO: 112911 - DNA, 1117 bp, Homo sapiens
ttcatctctcttcatcttgacaagtgaagttcaggtgtggtaatatctattatgtaggggctccccaaagaacttcgggtcaagaaatacagagtacataggcagtatataaacatacttattattgcatctagtctatggaaaaaaaatacagaaagaacatttgagcacaataaatctcccctaaagagagttattacttgctgcaacctgtctgcagcagtcagaggaaggaagtcagcaagaaagggaaagaatgccaggttgcaaataccaaacggtcccatcatttgcaattcaagactaagagcagattcctaaaactcaaagttcaaattcagctgctaaaattacaatggtctcctagattttagaatcaatttttctaccagtaaaggtgatcttaatctaaaatattaatagcgaaaaccacagaggatatgtggtaaaagagactgcagaaattatgtctaaccttcttattttcagatgaggttaacatggattagagagtgtttatttgactcctagtccagtgttctgtccattacattttgttaggaagaattataattctaacaaattacttccaaatgccaggtaaatcaggcctgattaaaagtatgtcttttatagctgttaaatggttctgaaaaactaattctgaaggatttatagataatttattatttcgttttcttttgtaaaagttttggcaagtttttaatctgatattatgatgcttttggaagctaacagatgttgctctgaaagtcatatttctcacttaattacagttttaataaagcagcctgggtaatgttagttgggggagtatttaggacacataggagccaagtcagatagaagtcatagaagtgttgcagtcaagaggcgtttgattataaggtgcatcattactttgtagactactaagaaagaaaatgcagccaattaaactatgatatgcattgtctctgatttctgcatttaaaaaatgaagaaatatgtttcctatagtcattgaaatacagtaagtcgttggttaggaaaggtaaggacctttctaaaggggaagaagcagagtagaggtgagagtgcatagcatgtagagcct

SEQ ID NO: 112912 - DNA, 1599 bp, Homo sapiens
tgtctcaattcttgcattgtattgtacactccttaaggataaaagccatgtttcttcagaatcttatcccaaaaacttagcagagtgcctggtacataatcagtggtcactgaattttttttgattgattagatgatggagatttatgtatgtctagctataaagtttatgtttatcatatacaatattggcttaataagatattctttggcctcaaaattagaacctaataggaagcttaagacataaaactaatttgatgacaaggaagcatgaaataagtgctctaaaaagaaactcaagaacatttaggaaggatataccgcatccagcaggggtgactaagtgataataattacactaagtcttggggaagaaaggatgctatttcaggaggtggaggagaggaataggtagttattccatatggaaataatactctaggcaagggatacagacatgaaagcaaggaatgtatttgaaggatggtatcttctaattgcatagttcaaaattctaaataggaggtcagtggctaatagagctaggcaaggaagttgaaatcacattatggaaaagtttagaatttagtaggcagtagagagacgtaatttctgaatagaaaaaaatactgtcatgagattttacaaaggttaatccctgctctgactggattagaagaaacagaaactgtaggccaggggtgcagggttcttcaggaaagaaatataagacaagaagttaaactaaataaaaataagacaaggatatatatgagtgatattgtaatgtataaagaaaagtgtctcattagacttgcaagctggtccatttacatttgatcatatttttagagaaacatgaacaagccaaggcaagtccaaaggagagtaatcaggatttgacggggagggagggatgagggtctgcaagtggtgagttcctggttaatcagctggggaaaaaaaagaccaggaaggaggaatgtgataggcagcttcagttattcaaaggactgtcctctagaagagacaacatccttattctgttacttcagagaggcaagaagagacactataaaagtggattgtgtccggaagagtgtgaccaagatatggaatgatttggaaactgtgtcacacaagaagaataaaagtattttttatgataaaggagaattttaaggaacttgaacaccaccttcaaatacatgcaaggaaaaatgggacttttgaacattcagttaactccatataacagaaccatctaatttatagataagcaacttttctctttaccaattatagtgggccatctgtcaaatattatagagtacatgagtatgttggaaggaaatgttgacagtgacaaatgtttttaaaagggaaaattaatagtgtacactacatttattttattagtatctctaatatcagatggaaaagaaaggagaatcaatgggcccactgatggcttagaacttatgtctataaaatttactcatattattgcattaatatttcagaattcatagtctcaaataaatacaaaatatagagagacatatcaggaagtttaggttacctatgtataaataat

SEQ ID NO: 112913 - DNA, 1128 bp, Homo sapiens
tgacctcaaatgatccgtccgcctctgcctcccaaagtgctgggattacagttgtgagccaccgcgcccggcctgttctatattattttaaaacctaaaccctttcctcttaaacaagcagacatctgtaatatatgtaacctaattgtaaaatagataaacgtaacagagagtatggttggtatagtttctggttagtgctaaatgattggaacaaagaaaggagagattactctggactggaatgatcaagaaaagctatataaggatacaacttgaggtggactgtgaactctgggtagaaacagagttagggttcgttttggaggttctaacaattgtaatatttttagtagttacaagtagagctctgtcattcccatcatctaattataatgtgcaaagactgattgcatgtactctttgactacagttcttggcactaataaccctaaacaaagctggaggcgctaattacctccttttcctaatctgaattttgatgtgcttttgaactagtaagtcttctggcattctaagaagacttaccccatcactggggagacatttacttcagcattcagaaaactagatttttgaattaaagttttttagaggagtttttcacgcagtagcacaaataaattaatcagtgtctttatttttctatacccctatcgtcattgcctgcatataagaaggagataagtataacagtttactcatgggatatgtgtactttttgatagaaaacatggagactatgaaaagcattcattttgtctcctggttgtcagattctgtctgtaactgacagtatgatcctatatcttttaaatgtgctattacctgagtttcttttggtaacactaaaggtagaaagaaaaaaagttaacttagggtaaaggctatttgttcctttttcattaaaaaaccaggaaattcttttttgattggtgacatcgtattaatatttagtctgatttattagcatgaggcaaacagcttttttccccagagtgttgacttagagaatgtggacttatataaaaataaagataatttagtttatgatttttcttcttttttcaaaattcagtttctttcttaactttttgttggactttt

SEQ ID NO: 112914 - DNA, 1382 bp, Homo sapiens
atgtgatagtgtgctatgtagattgaaaactatgataattcattttcagcagctaaagtcttaaaacaagtctacacttctgcagaaaagtggtaagggaaagagtgggagaggacctgtagcccagcatcttatctatatttactactcttgccttgtgggaggtgggggaagggggaggaggaggaataccttctttaagcttttcctaaatgtcttacatttcccccaaaaggaatgagctgttgtaatgatagcatgttgatgctggttaaaataaaacatgcccaccagtgtaaaatgatagcattaatatttcttgtgggaacttgatttagctttaaatgtacccaaaagctttcgaagtacaaaagccctcatattagctccagagaaaccaagtttattatatcttaaggaaaagatttcttcatgaaccttaaatttagtgtctgtgtaatcatgttattttgtcatttactttttaactgtagaaaagagcttgatttgatttttttttttttttttttgagacggagtcttactctgtcaccaggctggagtgcagtggcacggtctcggctcactgcagcctccgcctcccaggttcaagcaattctcctgcctcagcctcccgagtagctgggactacaggcatgcaccaccatgcacagctaatttttgtatttttagtagagacggggtttcaccgtgttggctgggatggtctcaatctcttgaccttgtgatccacccaaagtgctctgatttgggagaccttggcctcccaaagtgctgggattacaggcgtgagccaccgtgctggccagaccttgatttttttaggagtaaagagacttcctacctccactctagtcctcttatcagtgatttctttttaaaaaagtaaatgtccttgtgtcttcacttcatcttccttaataagtatttagaggcagtattttcgatattaacagcatagattctttaatttaggaaagaagaaaacttaactttgatttttctaactttctgctcagctcttccaacgtgaatatgtaggtctctgtctcccggggtcctcattatgctttactttgccctttccagtgccctttccagtgtttcaaccacattgagccgcatggccgcataggggactatgaagatcagctcatgcatttgtgaagcactgcctccttgtgtcttactgttctctttcttaatgggctgtgttctggaatggtgtcttggtgttatgttttaaaacattattttgcgtaatttatgtcattttatagtcagccaggagaaagtacactacattagttttatgtcatcaaattgtttaatcatctctataatttacatgaatcttcatt

SEQ ID NO: 112915 - DNA, 1027 bp, Homo sapiens
ggctggagtgcagtattatgatcttggcttactgtaacctctgcctcctgggtccaagtgattcttgattctcatgcctcagtctcccaggtagctggcaatacacgtgtgcacagtcacacctggctaatttatttcattttattttatttgtattttagtagagatagagtttcaccatgttgcccaggctggtctggaactcttgagctcaggcagtccgcccacctcagcctcccaaactgctgggattacaggcgtgagccactgcccccaaccaactcacacatactttaagtgggactttatttaatatcttcatatcagcgatagaacttgatgtggttttccatacatgtacacacacataataaatatcatccctttgacaatactataagaattagtgcctttatcattggatattctcttaaaatcattaacagaaaatgtgttctttctagaggaattttatcaaaaaatttataaggtgtttgaacatgtgattacaaaggaaagggaaagctaataaagaacttagtagtataaccatggccaggcacagtgactcctgcctgtaatccccgcactttaggaggctgaggcgggaagatcacttgaggtaaggcattcgagaccagcctggccaacctggtgaaatctcatctttactgaaaatacaaaaattagctgggcatggtggcaagtgcctgtaatcccagctactcggcagagtgaggcacgagaatcgctcgaacccaggaggcagaggtcacagtaagccacgatcatgccactgcactccagcctgggcgacagagtgagactctgtctcagaaaaaacaacaacaacaacaaaacttagtatgtaactatttatttagctatttttcaggcacattttagaacaaaagtgattttttttcaaacctctttaccctctttggtggtaggagacagatttcatattcatagaggtccatatgtggtacatatgttacttaaaacttgtggttgacactgtagt

SEQ ID NO: 112916 - DNA, 2145 bp, Homo sapiens
taaggctgttgtttatgcacgtacacattagcatccatagtgctaccaactttaaaaaatgctccagatttgagtacactcagaaagtttctaagatattgaaaacagtattcttaaagttcctctgttttctgaacattccctagtgtacaagattttatatatttatccaaatgaaacgttgaccttcaatgtaatattgaatataagattgcagataaactattattacaggttattcctaataaacttttagttgctgaatgttaacaataacaatctttacttttaaagcactatagacaaaagtgtaatttttatttagcaccaataaataaatgatttaacattttaaagtatttaataagactgaaacccacagcaaagctgttctctggtgtacaattactggagaagttcactaggtcagagtaaaagcgaagaagatgtattttaacatctaatatgcaatgtattttttgtttcttaatcagaatgtgaaaaagaacataaaatacagaattttattttcattacaacttaaaccagagtttaacatctataaaatatgcttcaaaaattagaagtttaagaatgtcatcacttatataagacaaaaataacacatgtatagcccatctaaatcattcttgaaaacagaccacacacagccttacatttttaagacaagagggctttaaaatgtaaaaggggagaaaatgagacttaatgacatattagaactaacatcccctgagtattgattgaaaggaaaggtattgtgtaataaggaacatgttcttccaattcttccatcagtctcagtttactttccactgcgtcctagggtgagaaagtaattaattctctgtacttattgaattataagtgtttatgaagcaacaacttgaaatgacttcaatccctacttaccggccataggaagcagtagtattggcagggagaaagcaagtttggacataaggactagacttcagggctgtccaatcttttggtttccctgggccatgctggaagaagaatggtcttgggccacacataaaaaacaaaataactctgacgatagctgatgagctttttaaaaaattgcaaaaatctcagtgttttaagaaagcttgctaatttgttttgggcccaggttcaaagccatgttgggcccaattcaaagccatcctgagccacatgttggatgaccttggactagagaaaaaaactcactgaagcctccatattttttatagtatcttttctgtgggatacttattaaattaaggttgagccatttttaaaaaacgtattttctctgtgaggaaaagcaaatctgtcttaatgagttacatgaaatgatatgaagttatatgaaatctaagggatttgaaaatttcaaaaagatttaaaggaaatacatcagaattttggttgcatttcagttaacagatttatttatctagatttttgaataaagtgtttttgaatacttaattcagaattgatgatctgcccatgaccttaataaaatttcctggtttcatggcaatggcaaaaacagtttctaggtacttgggtgagacacatactagcaggtgtagaagtagtaataaaaataatgatttattatcagaacaacacttcttacacctattcaccaattttctttcaggatatccccataatattattattcctaaatagcaaataaagaaaataagccaaatgcaagtcaagtcactttatatcttcctcatccttccattcatttcctcattcgttcattcattaccctccttgtttcttaaacatcaaatggtgccttgaggcattaaacaagttgataaaataaaacaaaagcatgaatacttgacatatttctctcatcactaagacaacatgccagttagtcaattaaaaaacaaaaataaatgtatcaaaccacgtggtattatgtggagaagacttgatcccaaatgttcccttttctcgaagttatttgctgttgtccatactatccacgctatccaagtttacctggataaatagaatgcaatcagaattatgttgaagctaatttattgataaaatatataccaaaatgtattacaaacataaaacttcatgaggtcagta

SEQ ID NO: 112917 - DNA, 1651 bp, Homo sapiens
atatttacctaaaccaggatttagttttcatctttactaaatttttcagatatacatatgtatgtatgtatttacttaattataaaacatgttctaaggaagtaaaagatatctttggatgcctttgcagaacgtagaactacttttgtttaattctgtgcccttacatattttttgtttttcttaattcataatgtggaacaaggccttctttttttctctgttccaaattttgaggtaagaggtatggcaattcacatattatgattgttttagagatgaacttaaattcacagggctttaataaacatcagccctgaataaactgaatatgtaaaacactagcactgattactctattccaaaaggaaagtccacattttctatgttaatacattttctactgcaattatttcatatggtactcagaatcatgcgggaagttgcatttcttttctctactcttcctgtatgtcatcttgggagcccaagcgaattttatattcaaaagagcaatttatgctacttattaatacatgttttttaacaatctttagggataataagttgacatagctgagagtagctgagggactgatggcatacgcaatctgttaaaacatttctttgaagagaaagcttgtgcttgaccatggttgctcggtggagagtgctcctatgcataccacaagcttggccttcagtttggaatagctcttttcattgtttgagtttggttgcactgagaaggcaagcttgttactttactgtaaaaaataaagtgcttgtccaagcttgttgcatgttggcagttgagaggctgctcttttgctggctggaacgtggacaactttttaacctctccaaggcaacgtagctgtgacaagatgtcagttaccttcaaaaagtaaataaatcacagcctttgagtttcagcataataataaagatccaatgtcctcacatgagtttctcattccacaattttgaatcatatttttttgtggcaaatgctctaccttcaaagtaaagcgttttaaaaatacagtttagagagccaggttccctgagaggaagattattaactcacaaggaaagaacagtgaattatctttaataaaataagctaagaaacaaaaacattaaagttttgtttgaaatttaaccttccttgcctatgttctttaccaaatcaggaaatactagtgtagctgtagtgtgaacatccttgtatttaagagagtgaatttaaatgtttcaaatactttgtaagacaattaaacatttgctatatgtaagttcaccttagacttacaaatttccaggaattattctaaattcattctatagaacactacctgacaagttggaaaatatggacgtaagagtctttatggcttaactgtgttaactggctgatgtttaacaacaatctacgtttcccaagtttcactccaaacccgtaagttgtactgtttcagaacatcgacaaaaacaccaatcactagatgaatagagatatttgattgaaaacaaactgttctacaaatatattaagcttgaatttgctaatctttatcaagtaattcccagtgctcaaatgtgttttgtagagtgacatactttgctgagcaaaaatggggtgtttgag

SEQ ID NO: 112918 - DNA, 1853 bp, Homo sapiens
atctgtggaatttggtatcctggtgggggttagggaggggattggaaccaatcctctgcagataccaagacaactgtatatactttgtaaagcttgtataagatgatactcataaagcatttaacagataatgtctcaataagtgttttaattgttatatcattacaactatcaccattataatctcaacagggaaagcctttcataatcacagctgattaaaatacctttttagtattcaggcatcccctgcttaacacttaatatcctaggaaatcagatgtcctacttgaaaattctaaccaggaacccattcccccaaatccccaaccaatttcctaaaagctaactaaatgcagtgaaatatctttaaagtaataaattataatttggggatgtaaaatgcttaaacagtggtttcctgatgacctaacaaatctagccttaaggaaccattgctaggttgatacactcagaggacttttcgaaatgtctacacatgatcagacctttctaccagttgtgtttggaatgtaacaggagacttccctccatacattcttttgtttaaaatgttatgttaaatttgaggaatgtaagtataaatttttcccatataaacatcagcaggaaaatgttgaatttagagacatatattgcctgagttatgggtgttaaaaccaagaggaattctatcagaaaatgttaaccacggagactctgtaagtgtgcccgatttttatttcctggtttatttactagatgaagtggatgtaactaacaggaaaacacctgattagtgctgcagactctgtgttcttatttaattctcatacaactttggaagttaaaagaccttaaattaattttgcaaagctgtacaactccttcatttctgagttgaaattcagttctactgcagtagctaatagctgtccaggaacagctattagaaaactggaaaagcatcaaggaaagcctactgaagtgtgttttcctttcgatccagtgtcttcttttctagtaaatgtcctgtctatccccccttcccctataggaagttttcttctctttcttcagatgctattatatgagatacaatttataaattcttttttttctcatctgacagtagcttttttctatacaatcagttacctttcactgtgtttttcacccatcctttttaaaatatttctgatatcaggatttgctgcaaaagaattaacgaaaagtatcaagaagtttgctagagctttctttctactcttgcttctctcatggaatcaagtggaaaattgggctttcttattttatttcattcactgagtaactgtactcacaagaatgtctacttcagtaaggtagttgaaccaagcatatcctgacagcctcatggaagcaatgaatcttttaatttatattagagaggaaaacgaattaatgaggaagaaaatcataagtagatggttaggcattctagagaattatatttaaaattagctactaggtcacttctgcatcagttgttctacgtaaaagtgatagggtatcccctcaaatgttaagtcacattctggccatcctttttcataggttgcactcaaattactttcaggttagttgtgtttcctttttttttttttttttttttgtgagacacggtctagctctgtcgtctggggtggagtgtagtggcacaaggctggagtgtagtggcgcaatcacacggcacattgccacctctgccacctggacgcaagccatcctcccacttcagcctcctgggtagctaggactacaggcacacgccaccacacccagctaatttttggtttagtttgttttgtttt

SEQ ID NO: 112919 - DNA, 1072 bp, Homo sapiens
aagagtaaatgattgaaatcttttaaaacttttagttacattgtttacaatttggggtaaatgtctagataagtcatgtaaattttttcacctaaactcataattttgcttctagagtcctaacgagtagtgaaatggagattaatcttgaaaatcccattaccttacatcactagaagcactttgtccacctgcttcctggacctagaagagtaaacctgtggttgtccagttctaggtggtagctttaagatactgcaggcgaagacatatatttgtgaccagcagattacaaacaagcaagaaagtgtaatcccattctgctatatttttaatggacaggattggatatatctttctaatcatagaagacgtctggaagaaaatggtttctgcagagggaaattaatgtattgaaggtgggaacaagattttggtttttacatacacatttctgtactgtttgttgttgctattgttttaccatgagtttgtattactcaataaaataacaaaaatggtgagatcaggaaggacaccttttcttgctatgtagattatttttgcctcatccttggttccttagtttccatttccttacagtattttccagttactcgtttttaacaatctgtggggtctgtccatagtttttcctttttcttgtcctgattaatagcctcccaatttattttctcatcgcctgcatacaactcagaccctcctattgaacgtgaaaccttctacctattcacccctctacacagatcacgcatcattttcttgtcttaactgtttcagttgttccgtgatttttgttctatgcctttgaggatttattgtttacaaagaactaaagtatttttagtttatttgtttaagctaccctcaaaagataataataggcaaaagaaacaccgtaagaacataccaaaattccactgaaagctaactagggaatgttggcttccaatcttagctagaaaatgatcaaaattcgatactggttgattttttaaaatatgaattgtgagtcatattcaaaaagagccacagcttgcagttgtagtcc

SEQ ID NO: 112920 - DNA, 2297 bp, Homo sapiens
ttcgtgattttaacaagaatcattttggtggagtgagagggacagatttgagtcagctgagaaaagtgtgacaaatgaggaaccagagacagagcttaaacaattctttagctatgagtgtggaagaaagagattgggcaatagctaagacaggataatgtgttgaacgagggtttttagtaggcaggagatatctgatggaaaagagcaaatagagaacttgaagatactgcattgggggatgattgcagtgcaatgttatgtcgtggcagaatgaggtgggattgggagagattgctcttagataagaagaattgctggtctgatgtaaagttaggcaaaatattttaaaacatactattaaagctaactgtcaattcttagcatcacaatgaaatcatgaaaaccccgcaggtgcttcgcagttcctacagggaatcttccttgttacaacaacaacaaagcaaaagaagacaccaaaccgaccaacagcaaggagtaatattgaatattcaaaaataaaatctattccttgacttcaaatcattaaagtagaactgcctatttaagaacttttatttgcacagtcctattaattttaatgcctaaagcagtgttaatcgcatgacccacgtgaaaagattttaaaaattgctttgttagaaaatgtaatagacttgtcgttaaagttttcaaactcttttttaaagatttgtaatatttggctagagttccatttattttctttaaaaaaattatgtacacacacacacgcacacacacacacacacacagtcactcctatcccgcaccctcagagaaagtttgagattatacagccacatctgtcagagctgtgctaacctatgtcatccatctgttctggttatattttccttccctttcctctctttttcttccattctccccagcctttaaaagaaaaaaagttgagagtaaaaacaaatcacctctttttatattgaaatttaaggtggaagaaaagtggttataaaagcatctatcatcatagcactgacttgccaagttaagtatttaggttggaaatcatgcctttccaactgcttaaaaacaggaagtatctctgctaagtgataaatagctccctgttgctggaaaggaaggcctcttttatttctttctacatttttgagcaataataaatgagttctgcattttcatacatgggtgtatgtgtgtgtgtgtgtgtgtgtataatgcagaaatccatttgcagtgtttatgtatacatatatacctcagtatatgtaaatatatgtgaaaatactttccaagactttaagcatagaatctcttctcataagccagcccaggcacatcttactcaacaattcaagcaaaacctttggatctgtcagaaacagcttataggtctgcattaggtgattaattgccaggagaatctggttctatattttgttacatataattattttcttttctaaaggtgttcttttattaagctcccaccataaaagaggggaaaataagcacacgtcttacatgcctgatgtttagcacttcttacaaaagaaagaggaaaactttaacataatccactgataaaagcatatttgtcttggcttcagacagttttctcctcatttttaccaaaactttaataatattttaacttgcttagaaattagtcttgggatagcagtatggaataatggaatatactttggttatacaatctgacggtataaaattaaaccttagttcacattctatccttaatgcttactaccactctgaccttttacaattacttaacgtcttcaagcttttatttccctttttgtaaattgactataagaatacatatctccttttgagtgttactgtgaggattgcactaattaccatagtaaagcacttattacagttctgaaaatatagtaggaacccaataacattaccattttaaacattattagtttgcttattctaagctctgccacttaatcatgtatgactcaatatcaatattacctccatgggcctcagtcttctcagtaaatacaggagtttagaaatggaagaattttttgtgagactaatgtcctgtgattctctaattatcttcatatcaaatgaagaaaaagtattttcattttagatacaaattattcttatccccataactgacaaagcaaggaatatggcttctacaatgtaatttctgctttacttttgactgagtattcataagacttcttttggtgttgattatggtctctagagcgagactg

SEQ ID NO: 112921 - DNA, 1051 bp, Homo sapiens
atatacaggaatgttctgggcctctgtaagagctgatccctctatcaggtttctgtgcagacaagcatgtttcttctatctattaggaaagggttatgaattgagcatttcagaggctatggtaagaagcagggagagaagggggcaagtagagaattgctgaatatcaattctttttaaatattgagatttagaaataaaaatcaagaatctgtattttgacttgacttttcaatctattattctaacctcgtagctcattgttccatttattcaaagaacattaacatctgccatatattaggaattcagagattgctaacattgcctatgttcaaggatctcataatcaagtactgaggataattatacaagaagagtaatcactataatagcatttaatacttactgaagcatacatgccatatgccaaacactgagctaagcacattatatcaatatagatataaaaacacctgctgatttgtccaaacacacagctaataagtttttgagctagaattttcctccagctaagctgattcttttgccctcacttttaaccttgtatgccaaattacaagtttaaaattcatttatgtacttggaagagtcatagaagtttcaataaaagagaagacttttaagctgagacttgaacaagaagtggagcttccctgatagacaaagagataaaatgtcattctgagcagagggagaaatatgtgcgaaaacagggaggcagaaagcagcgtggtgagttttactaactgggtgtttaggtgctcctaagcaagtccaagttcaagtatagcatttcaagtttctatgattttagtgtaactcctatcttatctacagctccttttcttttctcacagggtgagaaatgctatacttgaacttggacttttttctttgatgtgcaattaaatgattagaaaataggaagttaaggtatttgcagttaaaatgatcacattagccatgatgtagataaagcaaggaaaaagaaggaaagaataagactgcaggcagaaaaacaactagc

SEQ ID NO: 112922 - DNA, 1063 bp, Homo sapiens
cccaccactggtacttttaatggcagggatgagaagaggttactttaaaaaattattttcttttcacttggttatttattttgcccaatcagcattgttctatgaaagcttagaccagctcagtgtttgaaatagctccttctggtcaaagttactccatttttccttcgtggagagggtatacagagaattgaaacacttttgtaagcctcaggaggctctcaagaggaagtctgtcaccagctggaaggggaatacagccgttagggagcagcctctgaggggagactgaagcaggttgcgtcttttagccatctctgccacctgccactcattgtccctgtggctatggccctcattgtcctggcttcttgactgtagctgtcagttaatgaaaaaacatgtgccatttaaaagcagaagggaatttctctcaggaggaagtaagtctttttggttatcactattgttttcttttgctctgatttttgttttttaagttatttgtagcaattccacctcatttattcatttatcttttatcaaattatcctggttacttttggaagagttttatctgtaacagaaaatcaactgtcacaaatatatttacaaaaaaaagcaataactgggctcattaccccatatgccctatgcttgggaacacaggtgatgagtaagatgcataatttcttctgtgtatcagaatttgctgacataggccaaagactgatatctgtaaaattggggttgaatttttatttgaatttggatattatcctcctttcagtgaatcccttgggatcaccaatttgtgagggagtcaggcccttcttggccagtttgtaaatctcctcccttacatcttcagaggccagcttcagccaagtggggacactgcagtgacagggaggagccgattgggacaggcccttcctgggagcaggcatgcaactcatgatgtggcagtcaggagcaaaaaaaacaccttcttttctttaaaatgtaaaaatttgcttactatagtggtttttttattgcaatcttatgaatgtagctctag

SEQ ID NO: 112923 - DNA, 1001 bp, Homo sapiens
tatgattccccttgagactccagcattaggtgctatatggctgtacaaattggtttgggattgctttgcttacagtcatctcacctcagaaccccacttagcagtttctatgattctcagggaaagtgcttcagcagaagtagacctttaggaattagagacaagttacaaccaaaggagggacattcacctgcagaagcttataaaagcacatgagatacaggcatcgtagcctactcagattgacatctacttgcagattctggtcatcagtgacttcattgagcactgagagcagtttcattgaaggagcagtaagggcaaaaactagatcgtagagaactgaagtcaaaataatagttgagatttattgtggatatctcctttcaagaattttgaatgaaaaagagaggagagagattagattggtaactagagagatagtggtgggggcagggtatattcatagaatggaagagacttgaacatgtttataggttgaagagggagagtcagcagagagaatagagtgaaaatatccaagagaaaaatgagaaaggggataactaatgaaggaagatcacagaggactgtggtcatggacacaaagaaaggttttgccttcagctgaaggagactttattctcttatattattcagaaagaagtaagaatgattgtaaatatagacaatttcttaggtagagggctagaaaggtgaaaagggtggttaaactcagtcatcgctgatcctcaacttaaaagtctgttccactaatctttattttgtattactgaatgcatatataatgagctacgttaacattgggttttactgtacattatgcgtagtataatatatagaaagtctgatccctctttttaaataatatatagaaatccaaactttatcagtgtaaacatactgagtttgaggtgtctatagatcagcttaatggagatgtcatacagattagttttcatttttaaatttctccctat

SEQ ID NO: 112924 - DNA, 2050 bp, Homo sapiens
tgtattacattgagtaatttagtgaacctatctgagactctgtaaaatggcaatagtaatacttcattactatgaagtaatactttcataggcattatgaagattggaaataatatatagggtacttagtaaataatagctattggtgttattctaccactactttttttaaattaataaactgtgtactaccaccattttaattaataaagttcggttcctttacaaataaacattagttttctatccctgctgtaacaaattgccatacacatagtagcttaaaacaacaaatttattatcttatagttctggaagccagaaatctgacaaaggtcttattgaactaagattaagatgtcagcagggctgtaatcctttatggagcctcttgggaacaatccatttctttgcctttttcagctttctgaggccccctgcattccttggttcatggccttttcctccatcttcaaagctagcagcctagcatcttcaagtatccttctgtttctgacctatgcctccctgttccacatttaaaggacgcttctgattacgtttgacctatccagataatccaggataatctccctattttagggtcaggtgattagcaattttaattccatgtgtaaccctaattctcccttgacatgtaacataacatattcacggttccagggattagaaggtggatatcttgggggtggggcattattctgtctaccacaataatcaaaaaaagcatttgttgcatagtattgtatttgccttaataatcatgagaaactggcaaataaagatcagctggtaccataaattttcagatattaccatttttttgttttcatttttgttcttttttttaatgttattttagtatcttggttaaaagtactatcattttggaaattcacatttttggccactatagctgtattgtgttttttatttaaattgatatagttgaaactctaaagatacaactgcaagaatatatgtgggcaaatttttgaactattttgtggataaagggaaaaagggtaggaatcggatgtttttcatcagtttttaggagtaattacaaagctaacaggaaaatatgtctcccttctaagataaaaggaacctgaatatttgtccctaatattagaaagcaaatggctcgcaaaaattctcaaagatagtgtgaatcatattcttttataacactggataaagggggaaaaaagtgacatttggggtattaaacctgagatgaacatcctaatccagagagtagctgatctttagacctacaggctgccagtgaggtgttgtcagatgttggagtttaggcatagacaaatgcactgggaagagaacagtgccactggctagtcacttcacttctgggcctcagttttctcatacctattttgtggattatgtgggttgctaattaagacacccatctacctttgatgttctttaaagtagaagaaagaaatttaaacaaatgaatgacactaaaaacagaacagaaaccaccaagatgtccttcaacaggtgaatggatgaataaactttgggaagtccagacaatggaagattatccagtgctaaaaagaaaatgagctataaggccatgacagtgcatggaagaaccttaaatatatatgactaaatggaagtagccaatccaaaaaggctacatactctgtaattccaaatatatgatattctggaaaaaacaaaactatggagactaaaaaagatcagtggttgtcagggattaggggaagggagggatgaataggcagagcacagaggatttttagggcagtgtaactactgtattcactacagtgctgggtacatctcactatatacttgacaatgtaacaatgtaggttcatcacttataacaaatgtaccactctgatgtgagttattgagtatagtgggcaggctgtgtgtatgtgagggcaaggagtatctgggaactctgtactttatgcccagttttactgtgaacctcaaactaccctaaaaattaagtctattt

SEQ ID NO: 112925 - DNA, 1764 bp, Homo sapiens
tccataaagttgtattggaacacagccacactcattcatttacgtattgcccatggctgcttccacactgcaagggcagatttgagtagttccaggaggaactgtgttctccgcaagaccaaaacacttgctgtctggccctttacagcataagtttgcgcacccctgatgtaaataattgtttcaccatcttcccacctctgcaccgacacacatattcttcctatcatctctttctccttccttcccttcttctcttcctcttcacacacacatacctcattttgaatttggcaattatgatcacttacagtaaaggtaagcggaaatacattttaattttcctttgtcatttctctcctccctgtctgctttccctttcctctactgcctttatatagaatgtctgagggctgtgcccttttcccaaaatattttgttttaaggtgggggttagatcttggtacattttttgacttccatggaaagttttgtgttagtatgtggtcccatttttaacctatttgcagacacccccgattatctaaaatcactttcacatggggctgaggttaagctttatttcttttggcatgtccctaccacagcagacacttcctctttgccttgaaaggacaaaacgatgttcagctgtctgggcttaggcccagtatttgatttatacattatttaatttcctcctgaaaattggaagcaggactttcaggaatagaagtcagtatttttcatttgttttagaatacttctaggtgtaatataatcatcagtggtagatgtcagcatgattagggggtgacttaaggtaaagcaaataaaatgtgaatacaaaggaaaattatttgacaatggagaagttccgaagtttttgaataatcattattgtatatgttattaggttttgggggtactacattttggggcacctgtcttcactttacccattgaaggaaagatgtctattatgttatagttgcaattgttgggggattagaagtttgaggaaaatgtaatgtaacccttccagtaattttacagaggatttttggattctctgtcagctgctactgcatttgtcttcacaattaagttcatacgaatgccaggatgtgaatgccaaaatagtttgagattttaacagcagtgaactcaggaaattaaaaattaactctggaaatactatttcatgttttacaaccacttttggatagtgtgttcctttttaaaccttccttagatcattgttactcttgggttacaacctgtctcctttttaccaccaaagttcttaaaagtctagcacacctactgcctctacttcctcactcataattcgcttctcaaaccctggcagtatgggctttccctccctctgcacactgctaagctgacctcactatttccttctctccaattataataaccagctctaagtcctcagctttcctgacctttttgctccatctgtcagaattcgtaccctcttcctaaagccctctttcagtttttatgtgggactgtcctaatttcctctacttcttcctgtcttttatagacccatctccctagtatggagctgggcttaagtgtcccccaggttctgtttcttggaccatttttctccctacattcttaggctttcccttctcattttttctcattacctgagacacttcaggagaactcagagggctgcaaagagcacagtttgaaaatcaccccggtcctgtcagactacttttgagt

SEQ ID NO: 112926 - DNA, 1035 bp, Homo sapiens
attaaatggtatggggcaaagaaaaaggggcatatttccagtgtgttgaagccaacatgcctgggagtatagtgtatcactgaaacactatactctgaaacactgagttagtagggcaggcagttttcaaatcaagatgacacatctaatgttgaacactgtgggttgtaagtacccaacctgagctaaagatgaatatttcacagttatttgcataggagtgatacttaaaagacatgagagtaaattcattctttgagagattataggtaaagactaaaaaccaggggccaaggataatacatcatatgtctatggcatataagtatatgatcttaggagaattagaagctagtcctagcacattatcatgtacatgaaaagttgatgtaagagaaccatactggtttgcagcacctgtataaatacaaccatcctaattttcctattatcacttcctcaagcccatgattgctgcttctgacactttagaagcagtgtctgagctgatcttagtaccatgaccagccccattagcactgctacctcctttaccattacaacagagtatcagcagcagtggtgatcaccagaagactgagtgtgagtcagctccagtagccaagcttaggagaaaaggcaggtcagttcgatagcatgaagccacttggagatgtggaaaggtagagctgtgactagagctggcagaggcataagccttggaaggctggttggggcaaggtgaaaaatgggaaggacagaagcaggtaaagaagccagaaaaggcaaaattttaccaggttctttcctctttactggaatttgaattttgtcctacttgcctgtcttgagactttgactgacataaataaatcttaagacgaaaagggaacaaaagactgaaaacagctcaaatatcttttacttgaaactgggttaaataaactatgctcctataaaaggaatgagaaatagctctctatatagccgtgaagttgtttctagcataaattgttaagtgaaaaagacaaagca

SEQ ID NO: 112927 - DNA, 2469 bp, Homo sapiens
ccagctggtccgctgaggcccagccacactgctttctttaagttcagttcgacccaataatatcattacaataaattcctccttttggattcaaattggctttccatccctagcagttcagccctaatatacagcagatgtcacaactgatttcacatatttggagaaataggagtagctgagacagaatttagtctaccttgctcagagacattcacagatagtgtgaaaaccactcatgagtcccctttgcttaaagttaccctggtcatgtttattacagcatgtaaaggtacatagccttaaagtcttttcaggacttgggatttttcttaaagaaaacaaatcaagagtgttcattaaaagattgatataaaaaattaataattctgaagttaacccaaaacttaatgtaatcttccattggaacatttgttgatgtgtgtggggggtttaaattccacaaatattattaaaatgagcaatcagcagcaagatgttttaaaatattttgtttcagcatgtaaaatctcgttttattacagaattattttgttaaaggcacagctatgccaggttgctgccagagtgataggatcataacagcccagttaattttaaaagactcacaagtggtaggccttggaactactgatggcaacatgtacatcacattttagtataatgcttaaacttacaccacatcttgtgaatttatatgcatctgccaatgtgtgtgtgtgtgtgtgtgtgtgtgtgtgtgtgtctgtgcacgcatgcatgtagatacacatatatttatttcaaagagaagagagttggtgggaagtaggacagacttgtgaagtaattaagaatttctactggctctcacattcttcagtgtaacttaaaatgtgtacaaaagatatcttgaatacactgtgtcaaaactggtctggtttcatttccagttagttgccagcatgctaaaatggagatgcttgctaccaaggtgtagcttgtctaaagtttagtgattagatctccaaatgaaaaagtacagcctaaagaggaaattcttggcacttgtttcaattatctcctctttacaacattatagggtgctttcatgtgtatgtattatcattcatagtagagagtacattgactaagattgcaaaatagtttccattgtatcataatccccttgtgtccagttgactcacatctctgaaaaatttctgctcagttacaaatgtctgctggtctctttccaatgatactttgtttgtttgtttgatggttggaaatctgaagaaagttcacttagttaaaatggtgatgtaaagtatatgagtacagtcctaaaatttactaaatgtacatactcaaatttactcaactttaggtcttcagattttaaaaactagatgaataatctatcctttaaaaattcaccattaattcttcaagtataccaactgctgcatttctaataccaaaacaaccttatcaagtgataatttaattacaccttttaaatgaaattttaaaacatgatttattcatgaaaaacaagtagtttcatccacccttctttttctacaactctttgcatatctgtggcctgctatttattacagcctttctcataatttttagtgtaggcttaacaagcatatagttttaaatctttctttaggagactttctggcttttctcattgctgaattcgacacaaaccttattctcttattagcattcttgcaagggagtttaggtaataatagttaagaaagaatgtttaagtttgatagtacattaaataatagacaatgatcagaagaggaaaaaaatgcatgggtattttggttaaggttttcaaaacctaaatcatctttattctccaccttggcctgaacaaagaataactataatgaaaatttggcctatgtggcttttacacgtatgtgttatttccttccgttacctcacatatataattttttgttgttaaaatgcaacagctggatctcgctattggctttcagatcagtaaaatcagagattgccctttctttgcttcctttttagtggacctgcaggaaatagagttcagagtgtacctcactccttacaagacaacagcccatataattttgcagataaggaaacaactccttcagtttctaaatacccagtatatagtgttgttatcaaacatcaacacctgtatgcatttaaattcactcacagtttaaatgaaattacacatagttaatacatgccacttgtaaagtctaatcttatcttgggaacttggattttgcattccttaactagtgtgcttaaattttcagttgtattatcctatgttttttttgttttttttttttttagtagatgaaaataagacacaggtgtttaggtttctcttcatgtcgataaagatctaaacaagcatttagttatacttaggagcagctg

SEQ ID NO: 112928 - DNA, 1050 bp, Homo sapiens
tataagaggtttcatttttttccacagtgaagtaagacattgttcttattcttcatggcattcagaattctgcacaattgcctcttttgcccttttgcatttaaaagtgaggtaattagatttcccaaggttcaatggtcaagagccttctcatcccgcggagttgcttccccacactgctcacaagtggagctgtctcgcgtaatccagttattgctatattgttgttataaaggaactgctttttcagagagctagcatagcatgaaactttatactcacatgtccctttgctttcattgcttttttccccacatttgaaactaattactattttattcagtgtctgtgaggatttctaaacatttttgttaaaaatcttttcctacgtcctaggaattcatttcaaatatgcctaaatccttcacattgtgagatcctgcctttgttgttttatgtttttgtcagatattcgatcgtcagatctattattactgctgaacaaatggaaagaaaatttgtgacatgttggcaccaaataaattagtgtcatagccactgaaacaaaggcatgtcttcgtctagctctgacagtgagatcttgggcccactctgctatttttttgtcttattttctcattttcacaaacagataatgttttacctttgcaaaaagctgtatatatatatatattctaaagcttggatatcaatttttttttcttttttttttctgagatggggcttcactcttgttgcccaagccagagtgcaatgtcacgatcttggctcactgcaacctctgcctcccgggttcaagtgattctcctgcctcagcctcccaagtagctgggattacagacatgcaccaccacacccggctaattttttgtatttttagtagaaacggggtttcaccctgttggccaggctggtcaggtatccattttttagtcaaaactgaataagatgaaatactcagatttatagagctggccaaaacgtttttgtttttacagcctaatagcaaaagcaatcttgctggtagtt

SEQ ID NO: 112929 - DNA, 1002 bp, Homo sapiens
caaggtcaggagatcgagaccatcctggctaatatggtgaaaccccatctctactaaaaatacaaaaaactagccaggcgtggtggcacgcgcccgtagtcccagctactcaggaggcttaggcagaagaatcgcttgaacccaggaggcggaggttgcagggagccgagattacgccactgcactccagcctggtgacagaacgagactctgtctcaaaaaaaaaaaaaaaaaaaaaaaaaaaaaaagagagagaaaatctatagaagcaaatgtgaaggaaagtaagtgattctgcaaagaggaatgcccaggggaactgaccctaaggacagccttctaggccctaatgatataacatttcccactacctacatttatttactgtgctgtattaggctccctgaggttccagtgattacaggagtacaaccatttcttcttctgccagtttgattactgtgtgttgagagtgaaagcctgtctgacaattggttcccttcctcggatgtgccagcggggcaaaccgcccatctcgccatgtgaatcaaaacccagaaacgttgagaggttccaggcagccttttggttacctctttttttctcaaccctgctctttttccaacccccgccctggccaccatggtacacatgctcatctggccactctgttggatgtgtttccatcagactttacacatacccctattagcaagatcactgcactgtgcaaaaacagggagatatcagtcatatagcaaatgaaatagtacagtaattaatatttgtccactcacatagtaggtgctcaataaatgttcccaaccattatgtgccaggctctctattctctgagggagtctcagctatgaggggtgggggaggtatgcaggagagagaaagagagctccgtcacctggcaggaaatgtagtgctctttgcctcttccagtgattcttcagacttcttagccttgcaaccattgcttcaaattcttgtcca

SEQ ID NO: 112930 - DNA, 1115 bp, Homo sapiens
agggggagctccaagaagttaacatgtaagacatagtttagagacattagtttaggaaatataggaaatggacttctttctgcgttgttccttaaaccatgttttttgcctcaggttggtagtggagaatggacatttctttttcttttcattcttgaattgggtcgactctgtagactttagaaggaatttgtgtgaaaaatactctagttcaccactgaaagcagaaactttcatctttggcagtttgtgaagaacacataaattagaaataacttactattagtatggaaacacaactgcttatttttatctggatattagtgtgctgattttgttacaagaagaacgttgaatcagaattggcagtgcgtttgaaaatcaaggtctgtcatgtaaatacagatttttaaatcagaggaaatacagataattaaaactgccaggatttccctacactgcgttaaaggcctcacacttatttgtgcataaaacttactttgttttgtgagtgagcccttcagcttaaaaaaaatcctctcaggatttcaaatatgagtactgttatatatcattcactggactatacattgagtcttgtgtgtgtgtgtgtttgtagctccaaaacaccaagaatcgttgtgtacctgatacatttatttttgcatctcatagatgaataataaggtagttttaaaattctgatttatatagaaaattacctattattttgcgatttcattttaagagtctcaattttttaatgccttaatttttttcatcattaatctaatgcatataacagcacacaacaaaaaggctgtagcaccaaagccattctcaatttcttaaaaggtagacattttcctttatggaagccacctatgaactgataactgagctttctttagatgagagttattctcctgcttatactcagtattccctgcgaaggcatgctccattttaattattagattcacaaacaggaaggcattactttctcctgattctgcttcttaaaagttggaaaaacttataatgttcatggcatggggtctcttgtttatagtcttcctctatgatgtggtccccagcctctcctagaattggac

SEQ ID NO: 112931 - DNA, 1082 bp, Homo sapiens
tctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatgaaactgtctctcgatttcttcatttattagcctgtactattatgatgatttttgcttatttgctttgactttttcttcttacacacccattttacttctttccctatagatgttgaatctagacataggtgagcccaaattatgaactggataattaggttggtgcaaaagtaattgcagttttgggtcatttttaatggcaaaaacacagttacttttgcaccaacctagtatttcctggaaagtgcattaatcaaaattttgtaatccaaattatcttttaacaaatgctcaagtgagttattttgtacagtaaaaattttttgtaatactctctccctactttgactattttgtaagcatgaggttttgtgtatattatagtttcttgaaatggggcatatctacagtagaagctttttt

SEQ ID NO: 112932 - DNA, 2011 bp, Homo sapiens
atttataatgatagttcataattaaaaaaataaaaaaagccttggagtccgtgcgcggtggctcacacctgtaattccagcactttgggaggccgaggtgggtgaatcacctgagggtcaggagttcgagaccagcctgaccaagacggtgaaactccatctctactaaaaatacaaaaattagccaggcacggtggcaggcgccggtaatctcagctacttgggaggctgaggcaggagaatcgcttcaactcaggaggtggaggttgcagtgagccaggatcacgccattacactccagcctgggtgacaagagcgaaactccatctcagaaaaaaataaaaaataaaaaagccttggctacagttcaagttggttgagagacctggttaagtaattggagaaaaaaatagtttcattcttttactatacagtgtaataaatattagattaaaattataaaaattccagaggaaaaatgtatgtgtttaattttgagatggggatgaactttcttttcttttcttttccttttttgagattgggtcttgtcttgctctgttgcccaggctgaagtgcagtggcacagtcatgactcactgcagcctcagtctcccaggctcaggcaatcttcttgtctcagcctcctgagtagctggcaccacaggtgtgcaccaccacctccacctaatttttaaaaattatttgaagagctagggtctccctatgttgcccaggctatcttgaacttctgggctcaaaccatcctcccgccgtggcctcccaaagcgttgggattacaaacataagccatcttgcccagcaaaggatgaactttttaagcatgaaagcaatgtagtaaatgcaatggaataaattataatggaaattttgtttaaaaagcataagtaaaatgatgaaataagaaaaatatttgcaaaaaacatactgtcacaatgttagttataaaaagaatataaagggacattataaatcagtaagaaaaccatgactatgaaaccaatacaatatttcagtctcaatagtaatcaaaaagattcagattaaagcaaaaattatgcctttaaaatatatagatatatgatagctatacattatatgtatctaaatataaaatatctaataggcattattagtaagaaatgaggcaatatacatagataatacttttggaaagcaattgcacttttggtagcaagacactaaaaatgtttatatactttaactcagtaatttctcctcccaggggaatgatcagagatggactggaaagtgtatgggaagcaactaggatgcacaattacagaaacagtataacccccttgaaaaatgagtgtatttatttatttatatatgtgcacatatgcatggtaaaagcactgaaaaagtggttattatatagataattgggattttaagttttgtatttttcaaattttacatattcagcatgtattgcttttataattggaaaaacaattgaacattatatttaaaagttaaaaatatggctgggcatggtggctcatgcctgtaatcccagcgctttggaaagctgaggcggactgatcacatgaggtcaggagtttcagaccagcctggccaacatagtaaaaccccgtctcaactaaaaatgccaaaattagctgggtgtggtggcatgtgcctgtaatcccagctactcaggacgctgaggcaggagaatcgcttgaacccaggaagcagaggttgcagtgagccgagattgcgccactgcactccagcctgtgcagcagagcaaaactccgtcttaaaaaaaagtgaaaggaatattcttttccctttccttgtaatttaagggctgtgattaagtgctatgatctctctttttctgtttttttcaccttatctcccaagacatgttttacattttctcataaagtcctataacgcttcagttaagaaaaagaaatgataatcatataattatgaatttttgctttaactgcat

SEQ ID NO: 112933 - DNA, 3318 bp, Homo sapiens
atttcaggacagttctttacttcaggagttttagcttctctagggtagatttgatttttattttttccatagtcacacattcaagaatcttaacaaacaatttgtgtatagatggaacttcccttcatatatgtctaatatattaaaattgaaatctacacagcagatatgtttttcttggacttctttgaataactgtatcatgcacgcttctagaatttatttactcctctaagaattctttgttttgggaataaacctgtgttggtctggcttactttgggaatgttgttaatggacatacatgtctcagttgtgcgaacgaaggcacaaaattttggagctggaaggctcatgacttttcagaattatgcagtgggtttacggacagtctcctttttggtggatgatgtggaaatcttcaagagggattggtggatattgaagcagcttgtgacagatttcctcttccaggtgcctccaaatgttagtttggtatcagatgatttggtcagctcctttaatttttaatttttatttttttgagaaagggttttggtctgttgcccaggctggagttcagtggcacaatcatggctcgctgcagccttgacctgccaagatcaagcgatcctccctcctcagcctcctgagtagctgggaccacaggtgtacaccccaatgcctggctaatttttaatttttttttttgtagagacagggtctcacttctttggctaggttggtcttggactcctgggctcaagaaattctccagccttggcctcccaaaatgttgggattacaagtgtgagccactgcacctggccagctactttaatatgaaatgaaaaattggaagataaaatgttatcattattctattattattcaggagacagatgggacaatttgcaagtagaaatggggatgacaatgattagggactaagtttttaaaaataatgagaatttatatatctatcaaaatcaacatgtccagatcttcatgtcacttcccccatcaactccatccttggttttcttcttatgacaaaataaagaatgaacccttaaaaataacaaacaacagaagacagaagacatttctcatgaatttttgacgcatgtttgttgctattattgtgctctatttcctatagttgcttgtttaagcgtttaaaaaaaattcattgaaatttatcatttttctcttaaaccaactcaaaatttcgtgtgtgtgtgtgtgtgtgtgtgtgtatgtgaaaaatgtccctaggatcagctctatttgcattggtatttccagtggaaatgtcaagtgtgacctttttcttgtttgggtgtctaatcctattttaaagccctgtcacgcccctgccaagggtcagtgcccttgtgaatagaacttcagcacctgctacccctttcttctcctcttcttcccctctgagtagaactggaggatgttccggatggcaaacaaaacaatactatgcttcaatgactgcagtgctagaaaataattccagacttgacaatttggcagagtaagttttgaaaccatgagaaaataaacacaaaaaaagcaaacctgaaaagaggaaaagaataaacgtgcaggaacattgcatttcattgctgcaaatatcaagactaacacccccttgaacttttaagctgatgagataggggctctgaaaaaagaccagctctagcaaatacaggctgctaaaatcagtgtcattgacatttcacctttggaaaaaattattaacataaaaaattgtgggaaatataatggaggaaattcagattattatagtaactgggtttggtttctccatttcctaaagtagaattttgaataatgatgcttagcagagctgaattaagcagtaaatgaatgtagacaatttgaatagcaaagggattgtatgctcatgcttattatcatttaaagataatgttctataaaagtcagctctgtttgccagtgcttcggttgaattataatttcccatcacagaaattattagggaattaaataattttgtgttggaacatagccatatttaaatgtgtagtttctcactgaagttcgttatcaacagttttatctgacaatatctcaccacaaaattcctaagggaacaatcttttctggccgcattaatgttctcactgtttttcctaaaatcatgctaattcccactttttcatatgaaataaagccttagtgatgttttctcatattgaaatccaagtgtattttctcttttactttgtaccatgctccgcaatctggtttggtacacagcgcttccatacacgtatctctgcttttccctcatcaccttatattctgatcctgcaatagtttcttgtgtgccaccacaagagtaaccattctaagagatcatatgacactcttcctcaaatacctccaaacccgaaattaaatataaatgtataattgattatgataaggcataatcaaactagattgaatgaaaatatgtagagatagggagtgccatgacccagaaagcttcagaaagcaatggaagtgagagtgacctagaattgggatgaggtggggcttgaaacaagccttgaagaaatgggagtatttggtgagaagtgacaatggagcatgtgtcctcttttagggaacagtgaccaaagacataaaagcattttcgagtatggctaatacagcagtttggctagcatggcatgtcataggagatgaatctaaaaagtaggttaggatttgcttgtggctggccatgattatccgtttacacatctttgtcctctggattttgggaagccatgaaagatgtttgggcagggtagtgatattatcatctaggaagactcactcactggaaatgtacaggacagactggctgcggatagaaggccggaggcagataaactggttagaagacagggatagaatgcccgaggcagagaaactggttagaagacagttgctgtaatctaggtgtgtgtattaaggtcctgattagggtgaaggcaacgagaaaagtggagataccgggaagaaattacttagagaattaggaaattaaacaggtatgagggaagcattaaaaacttactctagaatttcaggtttgaagactaggagaaaaagagcagccaggagaagaatctgaggttttgtgagtatgtgatgggtttttacatatggtgtttgaaatagctgcagttcatttccttgaaaacgtcacgtatgcagtttgggatgcaggattggagttccagcgacagtcctggctagaaatgt

SEQ ID NO: 112934 - DNA, 1014 bp, Homo sapiens
gctgcaaacagaatctgagtgagtggacgaccctcaaaggcaaaaatttcatttgtaagtgattttgtcttttgggtgagatacgatggaaggacagaacatcatgttgaatctcagtttgcttttttggttctcttatgctcccctactttcttatgcgtacctcactgtgtggtgatggtccatttccttgccaatctgatctcccccaaataactgtgagctcctcaaaacctaagtcactcatctctgaatcagaataccttatatgttcctggcacataataagcaatcaatattgcctgctaaataaattagggagggagtgtgtgtttgggggttagctctggagaggaggcgagccccgccttcctgcaaggcaggagaagagagggttgtagagatataattttaaaaactcgaatcaaaggaagaggctattcaggcaagatgatttctatttctttaataaagtagtatccaagcagattttctgagtaggagagatagcagggcctgaagaaagctgttgaatgtcttctatgagcagggtactgaataggcactttgcatacacttccttgaaacccacaatgaagcactaggaagttgttaggattattcccattttgctgataagaaaaccgaggctgaaatagctatacacttatttataagcccatgttaaaattcaagtctcttgactacaaaacctacttccttccgtatgccccattattagagtagttgtaggaagtgtgtagaggatttgagagatgaagacaaatatttagcagcagcaagggtcaagtgaaggtgagtgagcttcatcttgcttaaacccgaggtagtatgttctacaactctgagaagaatagagcaagcaaaaacagtggaaatccaggctttgtgcctgatacgatagaagaagattaagtgaggagggtataaccaaggacaattgcattgatggggatattcattaattatttcgggttgctaaatctagtctct

SEQ ID NO: 112935 - DNA, 1025 bp, Homo sapiens
tgattatgccactgcactccaacctgggtgacagcagtaagaccctgtctccaaaaagaaaaaaagaaaaaaaaaaagagagagaatttataacgcccataaaattaaatcctgttggccagattattgcccaacaaaaagtatattttaaagaccctttaacatctcttgttttgtattggtaagtttgtacccttctagaggaatagtataggacagatccttgtaatgatacaaatataccagtcagtaagcccacatgtgcacatatgttgctatacttccagtaggtagatgtacacgtgcataattatctcattctacattgttaattcatacatttatcatttttatttgctcatgtacttataatctcaaagtagaatcaatatactacatctacatgctaaagttttgtaatgagcattgtgaagtttaacatgtatttaaaatttttgctttaaaatttctaaaaacacaaaatgtttcacaaattgagctaggtaatagatggataaaataaacattgagttgcctgacaagtaggaattccccacctcaagtttctgaattttatactagaattattttaaacatatgtggttataagcttatcagatttccaaaaatgaaccttctataaaaatcacactgggcccctcagctgtgatttcttccattatttatagacaaattgaaaacaaatgtttttttcaaaaaaatacaatgaactgaaaacagctgtcaggatgtactttttctctagaattcatctgtaatacagaagtgtagtaaaccagcacttaagtctccggaaatcgtgccatatttagtggttgttttagcattaattcagagatataagtattgatgcttgctgcaacaagacctgaatatctcatttaactcagtgaagattatgattcaagcaagtgacatggggccaaatgcaaatattacattttggagtgtcttagttgcaaatatattttacaaaggacagactttttgaaaattcatttgaa

SEQ ID NO: 112936 - DNA, 1723 bp, Homo sapiens
aaatgtggtaatctttctggacttttacaacacaaaaaattggaatgcgttttatcacaccaaagcaagctggaaagggtaatttggatttcacttgtggcatgctccatagtcattttctgtaaacgaagatccaatttttagggtgggggcaaatatacaaggtccaatgatttgaaaagatgttttattatttttttctccatgccttccatcttttcagcccaatgggaatttcttcccttgaacagttctaaagaatcacagcattagagataggaattattaggttatttaagctatctttctgctgatgaggagctattcctgtagtacaatttataatgcttttctgagtgtggctttgaacaatgtgacttttatcagatgaaccgtggtggagatggagccctctgtttgtgtttagaacaggtctagcctagggaggaacgaggaagacctctcaaaggctcacctccgcacagcaggcctgatcggctggctggaactcagaagggcaaaaggggagtgaggctccactttgatgtggttcgcttgcagccccgttgctgtactgtggtgtgcatatgttgggggcagggcaagggtaataaataccagggacacttttgcaatgcgtgcctgtcagctgagtgctggacaaacatttttaccactggctatttccctgaggcttctgacagtttgtgcaacttgtgtaagacattcctgaaagagaggagcatttgttcaacttatataacttctttttacatcataagactaaagcagtccttccgggctcatgtcctgttgaatgtgatccaactgaaacttctttcctctgcatactcagaaacctgactacctgtgtaaattcctcctgatagcatagctttctgtttgccctcagtccttctctggccctctcagacacccaggttcataatgacattccttcttcctcttgtaattctattgaattgttaacaaaaaaaaaaaaaaaaggagtaatagctgtgatcgatttctacaatgtgttcttaaattgtgtgtgtgtgtgtgtaaaatgtgtatatttttgcacttgatcttagccaaaaggctgagaaatgaccaaaggtctgtatttttgaattactatataggagcataggaactgctgtgtgattctggaattgtaacagaggagtagctaatggagttttgagggatattatgatgtgcatatagctggggaaactgggtgctcaggagtatgaaccttcattcactcacttcctgctcccagtaggagattaagaaggcatgtgcaacttcttatatttggtatagcttttgtttcctgccaatctttttttttctttttgacaaaaatgctgattggttttgccttgatttatttgtatttagaggttttcaaaatgagttggtttaaggcattacgattgaatacaagttaatcgataatcacgattgtacaccagttcttcctaatacattttatcctgtggccctgtaaaatttccaatcgaccaaagcaagcttggttggtaagggaatgacttacacaggatctttttcatttaggggtttgcaacttacagtgcaccttcacataggtcttctcatttgacttgcgcaatagcccatgagtaaacagcacaagtgttattagattcagctgacagaagaggccaccacaagggctcagagaggtgaa

SEQ ID NO: 112937 - DNA, 2054 bp, Homo sapiens
tgtttataacaccctggtgttcttgacatgctgcttggagaagcctacttctgatatccatgatgggaaggccactcagctcttaacttggggtaatctttctttttaaaaaattgttgtggccgggcacggtggctcacgcctgtaatcccagcactttgggaggccgagacaggcagattacctggggtcaggagttcaagaccagcttggccaacatgatgaaactctgtctctactaaaaatacaaaaattagccgggcgtggttgtgcatgcctgtagtcccagctacttgggagactgaggcaggagaattgcttgaacttgggagatggaggttgcagtgagccgagatcatgccactacactccagcctgggagacagagcaagactccgtcttaaaaaaaaattgttgctactgctgcacctttggcattatctgtgagcaatcttagtgaatttggcagagattaggaccagcgtgcattgggaaaaaccagaagtggaaaatttgagtaaaaatcttcaggaaagtacaataaaatgttcctgaaagttaaaattaatcacttgaatatgtgtggcctatatttttaagtttaaagttgagtttcaaggtgtggccccttgtaacattcatgagactggctataaaaaattgccattatttttgaaactttctatttcaaatgatgttggtttttaaatgttccaaagtaaagaatgtgatatatcagacagagctacaactggctcttacaagtctaagcttttccacctataaatgggagtaaaaacatacctggtaagaggtatcattttaagttattggagatgctccaaaacctatcatcttaaaattaaaatgcatgattttcaaaagtatagaatgtttacaaacttatatcttgaagaatagttgactgaaaatcacttggcttatgtgaaaataaaaagccacggccaggcgtggtggctcatgccagtaatcccagctactttggcaggctgaggccgggaaatcacttgaggtcaggagtttgagattagcctgaccaacttgatgaaaccccctctctactaaaaatacaaaaattagccaggtatggtggcctgtagtctcagctacttgggaggctgaggcaggagaattgcttgaacctagaaggtggaggttgcagtgagccaaggttaagccactgcacttcagcctgggcgacggagtgagactccatttcaaaaaaaaccaaaaaggatttctctatgtccactggtttctttttgtaccaaaggaaaggtaatctgaaatcactcaaatgaattgtcccagagatagagactattcaggtgagtgtggtcagatgcagggacagggtaaactcacacttcctaaacgagtggacaaatcagggcttgctcaggaatacagaagccactctatgtattccagatataaagagtttaattgagaattaggaattcatgcaacctttgaatagctgggagggagggctgcactggtgcacaggtcataaaactacccctgaagatcaggggaacagccccaaaggtcagagtggttgacactgaagcctacagctccaaacacttggagtaattttcaaaagcttgtctgcaagctgctgcacctcttgagaacctctgagaagttctcgctgtctcagtctgctgtgcaaccttgcctgtgcatttgtgtacaaatgcctccagagaataggcttcacactccacatctaccccaagtcttctcccgtgaagtgactctgcaagacgattgtgtagaagtttccacacttaggagggggtgttggtggtgccaagttagcagcagactatccagcaacgaggcctgcttctctaaactctcacagaaaaatgaaatgtgatataatcactgaacaaaaatagaccccaacatgacttcattccttcactcattcattcatttaacaaagtatcctttgaatagctgggctatgtggtatgtactgggaaaactattgtgtagagatagattcatccctgcttatt

SEQ ID NO: 112938 - DNA, 1218 bp, Homo sapiens
cacaggaagtcaagctacaagagggtctagaaatgctgaggaacttgctgggcatggtggctcacacctgtaatcccagcactttgggaggctaaagtgggtggatcacctgaggtcaggcattcaagaccagcctggccaacatggtaaaactccatctctactaaaaatacaaaaattagctgggcatggtggcatgtgcctgtagtcccagctacttgggaggctgaggcaggagaattgcttgaactcgggaagcagaggttgcagcaagcagagatcgtgcggctgcgctccagcctgggtaacagagtgagactccgtctcaaaaaaaaaaaaaaaaaaaacacagaaaagaaaagagaaatgctgaggaacacaactcattgttcacttttacaggagctgtcaaacctctggccctattctccatttaatgaaacttagcagatagtataggcaggtcacaggtgggagtcagagaggccattttagctgtgagtgatttcttcttaaagatgaggaatttcaaaggaagagtggagctatggaagaggtacttgtaattatgatataaaaatagaaagcagatgtgtcagacattacagcaaaaaaggaaaagaagtccgtatttacaaaacaaagaactaatggcatttcttttcaatctcctaaggtatgacaatggtgcagccaagaataacaaagaacaggaactagaaaaaatgaattgcagtttctcttaattttcattcatatctaaatcctctgttcttgtatattcaaataaaaacagcaacaggaacttagctttgggctaaaactggaaacaattcaggttgttatacttttttgaaaacaaaatttaattttttcaggttcaaataaatgcaattcaaagtaatgaaatgataatcatgaatgataagtgaggggggaggacaacatggtaaagagatgagaagatagtaattaatttgggggaaagttcatatctgctatgtacaaaatgttagaattataaactcaagatgtgaaaattaaaagaaacctagaaaccagttgaacttctccctgcaggcagaatttcttctgtatccctaacaaacgattcatcttctatcttccacttgactatttctgggaacaaagagcaagctgccatcttggtcatcaaatgataaataaatgtagtttggtataactctttcttagtaa

SEQ ID NO: 112939 - DNA, 1048 bp, Homo sapiens
ccacagaaatacaaactaccatcagagaatactataaacacttctatgcaaataaactagaaaatccagaagaaatgggtacattcctggacacatacaccctcccaagactaaaccaggaagaagctgtatccctgaatagaccaataacaggctctgaaattgaggcaataattaatagcctaccaaccaaaaaaagtccaggaccagatggattcacagctgaattctaccagaggtacaaggaggagctgttaccattccttctgaaactattccaatcaatagaaaaagagggaatcctccctaactcattttatgaggccagcatcatcctgataccaaagcctggcagagacacaacaaaaaaagagaatattagaccaagatccctgatgaacatcgatgcaaaaatcctcaataaaatactggcaaaccgaatccagcaacacatcaaaaagcttatccaccatgatcaagtgggaaacatctatcttcttaaatgcagctgtaccttaccattgcctgccgaattctccttatgtgttcaacctcagtggaaggagcaatttgaacttccttgcctatcaaactgttttgtaattttctgtttacctttctcccccatgccactgtgagcacctctgaggacaaaaactgggtctttcattttgcatacccagtatacagttggcgctccatgttgtttgttgaatgtgtataaactcatctaaatattactttgttatatcggatagaatatagatcttaaatgactttttttttacttgcctactatttattccaacatcatttaaaaaaatccttctgactggacaaggtggctcatatctgtaatcccagcattttgggaggctgaggtgggagaattgcttgagtccaggaggttgaggctgcagtaagccctgactgtgccagtgcactccagccggggcaacagagtgagactgtatctctcaaaaaaaaaaaaaaaaaaagtcctttctacacccttatgtgaaaaatttactttgtcatatattaaatt

SEQ ID NO: 112940 - DNA, 1074 bp, Homo sapiens
gtacaaacctctgcttaaccgacacctctcacattaatttaatgatttttcacagtgcttccctctcccactctatagcccctaagtacatgcttagtgtcagtattccacattatactccagaagctggatgccatttctagaaggtcacatttcgaaagccaagccatgccacccactctgggaaagcactttctgttcaggctcttctgtggctattagtaaagcctagttgactttacttggctatcatgaagtaggttatactggaggacaggagatgggttgacagaggcaagagcttgtggtgacagaatcagagctactgctaacagatgttgtgtcctatttgaatgccatggaaaaatacattgctcttttgcgggcatatagggtcttctggtgcgtagctatgaaggcaaacctaaagagctagtggtcaggaaaatcaggcccagctctaagcctgtgcttaaccaggacttctagtgtaaaacaactagtgctgagatagtggaatcccattgtaacctgttgtccagagatgagaaaacacccatattattggcttcctctgtcacaatgagagggctcactttacaccactatgtacttggggatatgatttgatttgcaacataactgaatccatgagaaagccaagtgtgggactcatgaatttttactgtatttcttccatgttaaagcaacaaaaattcataagaatcttttctgcatcatcaaaaaaagtcaaaatgtcagccctgtataagcacgttcttcccaacatatacatgtagcctctgaacatctgcaaagcagcattgccattgaagagtttgctggtgttttggaacaagtgaatagcagccagatagcataaagagcaaggaaaactttcagcttgtagactcacagatgggatttctgctgaaatgattaacaactattgtcagatctgcaagtagtgaccacaaaacacctgctctcgtttcacgtgtttaaattcacatttattaaaatgggctgggtgcggaggcgcctgcctatagtcccagctacttggtgggctga

SEQ ID NO: 112941 - DNA, 1052 bp, Homo sapiens
caggcatggtggctcacgcctgtaatcccagcactttgggaggctgaggtgggtggatcacctgaggtcaggagttcgagaccagcctggtcaatatggtgaaaccccgtctctactaaaactacaaaaattagccaggtatggtggcaggcacctgtaatcccagctacttgggaggctgagacagaagaattgcttgaacccaggaggtgggggttgcagtgagctgaagattgtgccattgcacttcagcctgggtgacagagcgagactgactcaaaaaaaaaaaaaaaagaaaatcaagataaaactgaaagcaacttatgtatttcctacttatttaatacttttctatttgtttagtcataggaaaaaggcatatgcagccattaggcatatacatacattaccgtgcacattactttgtgaacctctattatttaccagcagcccaatattatttcacatttgaagctgtctgcctgagacaacggagaatggtatatcagtaacttatgaggtgcctatgtaagatagaaacttagactagatgagtgagtctcaaatgttgggataccacagaatcacctggggagcttgttaaaaatacagatatcttggctcaagagtatctgtattttgaccaagctcacctaggtggctggtgtgtaccaatatttgtaaaatattgagtttggtgacctataaaatctttttaaactctaagattatatgagcctacaaaacagatatatatgtgtcttcaaagacctcatgatatcaaacttaatcaattaaaagaaaacttcttttgaaagtctcttataaaggaaaccaatgttttagccattcttctttgttcctagttgtccctccagtgagtttgtgtcactcttcacagtctgtatttctcctgcttacatgtgattcccacatgttctacagagtctaaaggcatatgaggtaagctttataaaacagctcagtgtgttacggccaaacgtgcctcctttccattgtgtcaaatcaccacctgaaaagggatgaggcag

SEQ ID NO: 112942 - DNA, 1369 bp, Homo sapiens
ccaggctggagtgcagtggcgtgatctcggctcactgcaagctccgcctcccgggttcacgccattctcctgcctcagcctcccaagtagctgggactacaggcgcccgccactaggcccggctaattttttgtatttttagtagagacggggtttcaccgttttagccgggatggtctcgatctcctgacctcgtgatccacccgcctcggcctcccaaagtgctgggattacaggcgtgagccaccgcgcccggcctttattatctcttaacagaagtagggaataatgttgattggctcttggaccaaagctatgctgctttaacctactcagcttaaagctatttcattttgacttgtaatccctgatgagatttaaaaagggcaggtttttcaaggtccatgattttaaagattaaggtttcataatactatgtccttgatgcgcaccagtagaagcagttctacagttttgagcatacacatttagtcaaaccaagaagtatgataatttaaattatggggtttggctgggtgcggtggctcacgcctgtaatcccagcactttgggaggctgaggcaggtggatcacgagctcaggagatcgagaccatcctggctaacacggtgaaaccccgtctctactaaatatacacaaaattagccgggcatggtggcgggcgcctgtatttccagctactcgggaggctgaggcaggagaatggtgtgaacctgggaggcagaggttgcagtgaactgagatcgtgccactgcactccagcctgggcgacagagcgagactccatctaaattaaataaataaaaataaaaaaattatggagtttaacaatgtttagtgatcaaattaactggaaaacaatttaatctctcattcattttgtgttatggggactcaacttctagcaaatcctaatactctcttgtgcactaagaataaagattgttggctgggcacggtggctcatgcctgtaatcccagcactttgggaggccaagatgggcggatcatgaggtcaggagtttgagaccagcctgaccaacatggtgaaaacccatttttactaaaaatacaaaaattagctgggcgtggtggtgcgtgcctgtaatcccaggtactcaggaggctgagacaggagaattacttgaacccgggaggcagaggttgcagtgagccgagatcatgccactgcactccagcctgggcaacagagcgagactctgtctcaaaaaaaataaaaaataaaagaaataatgaagagtctaaagtaggctgtgtatcctaggaggaaaaaccatgggctatgctgtcttagtacattccattccattccgttttatttcattaa

SEQ ID NO: 112943 - DNA, 1035 bp, Homo sapiens
aacagataaatatcaaagcagaacttcaccttgttgaaatgggtcttgatcttctctgaaatcctttcttgaatgattcactgaagaaagtgtcttcaatgatacattcatcctctgatttacatagagtagtgactttccttacatgcactcaggtagaatcaaggttttcccagtaccctttggcaggtctgacggcacaggcatcttcagctcaacttgccacatatggttgttgaactccctcatgatgactaaagaaccaaacttgcctggtttttccaggcaaggcaacattttgatgttttttaatagtgtgaacacctgccaataggattttatgagtatcatggggagacgcatcctctgacctggcatataatctcacttctctggatgctgggctaattacatcagctccgctgggcatgggtctaaattggaaatgttctagtgtttgaaaaattccagattgataggacttaaccccaggatgctttatgatgtatccctagttaccctagttggcagaaattgaaaaggcctggaaatccctatttactataagtccctcttctcttaactggaaagatgggcattggaagacttgctactaagttttactttgagcacctctcttggcatcatttattactaaaaataatggaaaagacagagtaggtattgggaagcctgttttctagttctaggcctgctactaaccagccttggaccaattatacccacttccacccatgtgagcctcagtttcctcacctataaggaaataaaataagatttggaccagacctgtggttttaaaatcagagtaccctgctgtttaaaaatcttttacatctggagttttgtgtaaggttttagtttacagttcactgataaacactgtcataaagcccctgctctagaggcttgctgaggtcctgttcctcttcagcttgaaagatctgcaattctattaacacagttggtgatagccatgtgccttgggaatcacagttgtttcatttggctaga

SEQ ID NO: 112944 - DNA, 1029 bp, Homo sapiens
ctggggtctcccatacaggtgagaaatgactggaactcagctttggattcatttcttcagtggcagtagatggaaaactatggtctacctggagggaatgagggcctgaaatggagtgaccatgggaacatgggtaggttacagaagggaaagccaatgcagaggagggccgacaggattctccaggtgtgatgggatttgccagctggcgtgagggagtgggaggatacaaaaatcacatctagcttgggaaccatgtgaagaggatgctggtgatgccattgactaaagtaaggacgttggagttttagggaagaaggtaatgaattaggttttggacatgttgagtttgtccaacaaactgcagtttatttgcaccaggactggagcttggggaaatttgtattgtacatttctaagtaaatataaagttgacctttttttaatcttaatgtctcagatgctttattgggcttcataagttgttacttaggggactctgttaatcataatggagtaaggcaataggtttaccttttctcttctctgctggacccaaactccagagaacttctttcccaccattgggcttaaggatcctgagagtcatgacaaagatgatgttccaggaaaatgcctatttcttaaaaggacttttgcccagaatacctatgtgttcttccaccccaatgagctcaaatgtgaacaaagcagaaagctcttcaattgtagtccagaggcatttcttagtagcatcccttatttcctttttgctctgagcctcaacctggctccacttgatctttcctgtctcggacccattgtttgagtgcaacagactaagtgagggctgccccatgtattaaagagggatgtaagtagagagtcatagtcagcatccctaggtccaggagaaaagcttataatggaaatatggaagtgagggtgaaattggatggggcttggggacacatagcaaggttaatagtaatggtggtcaagagactaagaattaaggcaagggctctt

SEQ ID NO: 112945 - DNA, 1057 bp, Homo sapiens
aggccgaggctggtggatcacctgagttcacgagttcgaggccagcctggccaacatggtgaaaccccatctctactaaaaatacaaaaaaattagctgggggtggtggcagccacctgtaatcccagctactcaggaggctgaggcaggagaatcgcttgaacctgggaggcggaagttgcagtgagccgagattgcgccattgcactccagcctggacaacaagagtgaaactccatctcaaaaaaaaattaaaaaatataaaataaaataccactttactcatgtcaaagcattgttcaaaaaccgctattccatatcacttataaagtcgaaattctttaggttggtcttcaagagtctcaatacctgtgctgactctcccacaatttctttaaaccagctctgccttggcagtgtagacctccccttgtcaactaaaaatctatcttcacctttgttcatgcctttctccctccttttttggaatcttactcatcccttaatccttggcttaagtccatctcctctgaaaggatgtttgaatcaccctaatcttcagggatttctttacctacgtgcctgtcttctactaaatatatcattatggatggacgctgtgcctggtcacttagcacttaccatgtgctctcttaaacagccattcatctccgtatgcaaattttcctcctttcttcaactggcagacttcttgaggatggggctcatgacttttccttccttgtatttccacagctcccaacatgttccttggatatagctggcatgcagtgaatatttgttgatggatagatatttatagctgttttcttgaaaactggaagtatatagttatcccatgattaatggatgggttggagccctttagtagaaaccaatttatttgcatacaagcttatctatctagataagaatgctctgcctaagtatggaaaaaacttcaagagcatttcaaatcctcaaaaatgtgtgtgcactcagtgatatgaatccacatttgccataagcaggatgaatgaaaaatgaaactaaatga

SEQ ID NO: 112946 - DNA, 1032 bp, Homo sapiens
tctaactttactttttcttgcttatggattctttgctcacattttataaagccaagaaattttaaattttttaaagcccttgtgaagataaaagatacaagataatatgtgcttgcaattgctttaccaaggtttcaaaagaaataaaaacaaaatgaaacaattaagaagtctctgtcaaaggtctggaaaatacgacttttggatagatttttcaggagacctgttttgcattaaaataccaactaaaacaaaatgatggattgttttggcaccatttagattgagcttatgtgatgagaactgtacataaaagacagccagttattgtcgtagttgacagatttttgggtactgtctagttgttcagtatagtaaagtcccaggggtcagaagcttttccaaaattcttatgccaggaacgacacaaacttttgctgtaacagagactgacattctcttcctactttatagatatctataagttgtggtctttccctggcacatcaaattagttcctgtgactttctgtgtaatacattattgttcctgatgtgacttcatttttacatgcaaaaatgtttgaaatttgccttaaagtattggtcatattttaatggagataggtgcagaggttttcaagtggagcagacagcttaggcaaggagaaaatgaggcagagcgtgtcctaggaaaagcaagatgatgagtttggttggagtctaggttgtatctaggggttctctgagaaataatattggaaaggtgttttggggacctatttggaaggctttgagttcctggtttttaatttttaggcaatgtggatccattttcatctgataaaacacatgttcaagaaatttctaagaaggcccctggagtgacctagaggagaggtgataaggtttgaatagggtagcagtgacaacaggaagcacataatgacagattatcttaattttgccacattatactttatatgcttgtgatacaaggtgacatatgtcactgaaagatcctattaataaa

SEQ ID NO: 112947 - DNA, 1179 bp, Homo sapiens
tcttagatcccaccccagatgttgaatcaggacctgcattttagcaagatcccaagagataccaatgaacattaatgttggaggaatgctgatctcagcattactgatcactattattactgcttctattacgtcactacctctcaaaacctgaggagagctcccacttgttgtaccatgtgctagcgacttaaatacattgccacatgtaactccattttcatgataacattgcaatatagataatatcatccccattatatacatgagggaactgaggcttagactttaagaaatgtatccaaggctgcacagctaataagcagcaatgacaggagtagaacctaagcctgtttccaaggcctgtacacaatcaacctcaaggattcaagtgtggtttatttgagggtgacctcagaagatactgataggagagtgcagatatgaaatagagaagaacgggagcaataacgggtacattgttgagccagtttccattctgggcatctgcagcctaatcccagaagactctgggacatgatttaaaatacatttcagggttattcccctaagcaatgagggaacttgggtatcgatactgtcataggtaaagagctgcttctgggggtactaatatcctggtatttctgggcagctgcacatgtggaaaaagtgggcttaggcagtcagagaaagcctgtaggcaaagaaatgcaggtgctggccattagaaatctggccaggattagggtgagagaatatggctggacatcaacagtgtctactgtactatgctcgccttaccttacagaaatattatttagaaggacatttttctctttatttttatttattggaccaaatattgttatggaattaaaggatctgtatacacaaagtccttcttcttagggatactggcatgttttttagacattaaaataaaatttaaataatgaaaaagataatatcaaatcatcttaccttaacaagtaagaagctttcatttcactgtgttctctaacagtgctcatctatatgcatgcattattatattcttttgtttaaacttaatgtatcattgccactttctatgtggctacctaagcaggtaattatgcatggctgagaaacatcccattatgtggctgtcacaatgcattgaacaagtcctttatt

SEQ ID NO: 112948 - DNA, 1233 bp, Homo sapiens
caggcgtgagtcaccgtgcccagcctgtgagtttttaataaaccagttaaaatttgtttatccaaaggagaagaaatacaaacaatactggacacatgcaagatgtgttttttcttagcggcagctgctaaccatcctggcttcctggcagggagcaggttatcatctatcctgtgactacgagggcacaccctgcgttagccctgaggcaaagagataataatagcatgctagactggcagcctacactctggaagggtttatgaggaggaagtccgcaattacatatttctgggcaaacattaaccaagattgaaacccagatttgaagaaaaatagcaggctggaatcttcagacagattctgtagctgttctgtggattgaaacagtagtcagacacgctgctaactccaaaaggtaaggtaaaagattgagatggcagtatataaaacttggtaagaaaacttttccacacctgcccacagaatgtgttctgtaacacacagagcattgtccacatatgaatgatgagaaattatttacattcatgacaacagaaccgaagccacaacatagggtctattgttcacctcataggggtgaccgaatctatttatccatgtggtttgggagctcaccactgtgcattgaagggcctcctgttggcaacatcaccaagagcatttcagtcactgttactacaatctgaacaatttgggttccacgctgtggttttgtaatttctatttttaaaacttgaaccatggtgtgtccagtcttggttgggcatacttaaaatgaaactgttaagctaaaattagcttgacatcaagacgttgcatgttcattttccttatatttatagctgaccacagtcattatacagaagccatctagtctttactgtgcactctagggaacaggaggggcagtgggagtaaccaaaaaaagaactacaagtttttccaaaggcggttggtcgtaactactgcctgagcagagcggtgcctgcgtcttagtgaggtcagcccaagtgggactgacctcactaagatgaggactttcctttgaacagctgtttactcttcagttcttctgcagttaatcaacagtgatgggaccttttctaaaagttttgcttagggcctcagaatttaacttaaatcaccacgaaggaagtatatacaacaaagcttcctcttagtatttcttcaccaagtaattatctactg

SEQ ID NO: 112949 - DNA, 1086 bp, Homo sapiens
acacagacaaaaggaagtggaggcttaaacaattaactggtgactgcaggacccattgtttaggaatctggataattgagtcctaatttctctgactcccttcactttggtaaattatagaaagaaaaagattttgagactcagtctcatttttggcagttaaggtaagaaatccatctatgcttccgttttactgttttttttttctttttctctcctctcaaaacaattcaacatttccttctctgcttatttcaaatctaaatgtggtacatattttaagacatattttaaccacaaattttattggtgactgcaatcactgaaaggaaggtactctgtgaacacagaaattgttttaatgtttttaatcaataattcctataaacaaattttgtcttgaggaaatagaatatgcagctatttcctttctgcatttacagtgacctctgaaatatattacaaccactcatctgtatctaatcccacatgtgtggtgaacactttaagtaacttattgactagaatccttctggaggtatctgtggaggatgatgatagagatgatgttacagaacagtttgaaaaagacgccaattggcattttgaaggattaccaacatttctaataaagtctctgaagagatttctggctgcttaagaacaataatatgatagagattgattattttgaggtttcgaagttaaatacttgcatgtggtgaatactgaggcttattgtgaaaatgaaaattagacctatgtagaaatccttgtggagaatgagacggtcaggacttttatcaatgctgctctttatacaactgcctctttggagaagaagtcggttcactgtccttgttaaatttcaactgcggctgattctgaatcttgaggaccattatgatgtgaaaaaagaaaaaaacactcactaaaagttaatgatctttccctaatctttcagaaaagctgatactgactggtagatagtagtgctctgtcagaattgtagaatgaatgaatcaagctgatataattcactaaccatctacccaagccaggatctgtgttagagctttagagaca

SEQ ID NO: 112950 - DNA, 1027 bp, Homo sapiens
gaaacatcagggaatggtgctaatggtgaccatatcacaacttgtgttctttggcaactttcttatggtacatttccagttttatctgtccttctacagcatagcctccttggagtcagagtgagttcactaccctgtctgccacgtagtgatcaggacaggtcctcagttaatgttttggtacataaggtgaacagagtactaccccaagtggcttttccccaagtgttggagaggaacttaggtttctgctcccaggatatatataatttttgtatccaggaaagtctttagtagaatatatataatgtaactcaaaatcaaggtaaggtcttgcaaaggaccttatcatctcctgctgtctttttgcttgagcccatatggaaatatcaactgtgaacctggaggtattaagagagcctactctttaaatgcttcatttttcctcttctaaagaaccatagtcaaaggccaggatcgatttctgatttgttttaagcaacaatatggctcaggaagaggtgagcacattgtttcagaacttgggcttgatcagcctctgaaatatgcttgaaatcaatgtatctggatctgcaggaagggctggaaaaaaagaaagtttttggtgttaagtgatttttagttgaaaatcacctactgaatagtctgaagtcatatatcaacatcttacttgctttttcttttctaattatgtaagacatttatattgtttttatagaaaagtcagcaaatacagatgaatgaaaagaaaaaaaaaagcaccgtaaaaggagaaattacctataagaaaaacatcttaattcctgtcttggattaatgtcttttaaacgaaatatcatctactctttcactgttgtagtgaatgtttcttacagcactgatcaattaacatactgtgttatagtttctgtcactacattgtaaatttacagacagtaaatttacatcataagcttggcctgatgttttcaaagaaattcctttttattaaacaaattttaaacaa

SEQ ID NO: 112951 - DNA, 1033 bp, Homo sapiens
tgaggagaccccagatttggtaaatagatgatcagaccaattttatggggaaggactggagttttgccttaaatgggatctttcatagaccagaacctccaatttggcaacatacattgataaaaataaatgaataatttcttaatctccatttccctttggtctatgtcttaatattagttaattgccagcaagcaaatgattaaaagatgctgtgagggtttaaattcacttgtgagaggcacaagaggcaggctcagggcctgaagcgacaggatagatttttttttttttttctgaagaatacataattgattctttttttttggctttcttccttcaaacctacccattcacaggataatcataatcacagcagtttacatttgcataatgccttaccatttgctttcacagattttattcccacttgatcagagggtgtctgcattgtgctgagtacctaatcttgaaataaataatttactatatgaggatttaaacaggtcttttagataaaaagtgcattacatatttatgagcactgatttcaagaatcgctttgaaagaactattgatgttgctttatattagagatctggaacttaatctcatttgattcatccttgattttatttttctgaggttccaaatcatgtttgtaaatccctgagggtctttttcctccctgtgagaggaaaaatgtttaggcacatgtcaggaatttaaaaaccttctgccactattctcagtatattgggaaaaccaattttctgaaattaaaatggcagtccattttgcaaggcaataataatgatgatgatgttggtaataaaacttaggggttctaattcagtacagcaggagagagaagatttcaatctattaaaacaaagtcctttgatgtctgctgtgaagagggatctcataaatggttattatttacttttaaaatgcattattgcttgagcatctgtgatttacttttttatttttgttgtttataaaggttattgcctttaaaccagttctt

SEQ ID NO: 112952 - DNA, 1023 bp, Homo sapiens
aagactagaataaacattgtttcctgattgctacagttcaaaatcactaaaagattttgcttgcttaaataaaaaatgaaattgcgaggggaaagctttttttccctctctttaagaagggagagagaaaaaaaaaaaccatgaaagcagggggagctttgcaaggctactgatgcctgagtagaatcactaactggttccctcgctctgtgctaggccgtctgtattcactgtatcacaagcttgaaaccagacctcatttgacggagccaaaaaatggtccttttgttgctgtttttttttccctagtgtcatctctcatggttgcctgggcaaccagtgtgtatcctttcagcataggttactgggccccaggaaggaagtgctccagcgctggcctgctatttttatagaaccgttacataatacaatctattaaagcttcctcttggtgttttattgcacaaaggggaaattaagtttgatgactcctaaatgttggatggaggatgtcaggtgactctaggattgtttggctcaggtcacatagcaacagtattcccatatgcaattccagaagaacccatatacaatcatgcccttggcaatgttcgcctgcctggggatcattagaggaaactgagctctctgctgctcaggggtgtaagttttgtccgactacacaatgctccctctctggtaggatggcagcagacaatgaaacactattcacagttaagggcaaagagaattttaaaggtgtcgcacatatgcttttaataggtggggtgattactggcaaagagaattggattgaaagacagaggaccagggtctctctcaagtcggccactgcagcattgcatgaatgttgtggtcagttttgcttctgggtaactctcaagtggtccagggcagggaggcattgggacgggatggggcgggggcggggggtgtaataggtaaatggcttttaagtggagacctaagacctctgtaacacaacttcaggtattctccact

SEQ ID NO: 112953 - DNA, 1021 bp, Homo sapiens
gtctttctccagggatgggttagctgcccttccaggggctcccattctaccatgggtatctcctatcctatcctgtcctgtcctgtcctactttatgctatgttctctaataaactataagctacttgaggttaggaactagttcttattcttcatgataactgtagccctgaccatagtgctctgcacatggtagatattcaagaaatagttgtataaatgaatggcatttaagcttaagccaaatgctaaattagcatcatacctgggaaattaagaggggttaattttttaggggttaatacttgaatgttttttagaaagtccattaaggagctatgataagagagaagcagaggaacaattcggacagtgttattattttaatttgaccatatatttggaatggaaaatggattgtaatgattcagagcaaagaattcctttcttggaaatgaaaggctggaaaatgaagcatggagacatacttcttattgaaaacacagcaggggagtgtccttccccctaaaatcattcagactgtcagattaaacatatattatttcttaaaaaaatattcccagaggaaatccagcatctatctccccctactggtgtcatattaagagtgatgtctgactgttttcccttgaaatgaggaatgttctaattaagatgaacattttaatttgttatttggacaaaaaaaacttatataaaacttaagcattctacaatggacatttgtgttgtaatgagctttagcaatatttgagatatacattgtttcatcacacataaagaatggttaaatattctggctagttcatctgccattaacagatttatatgacaatggattgtaactgattgatacaatgaaagttttatttactacagaaaatttcaaacatatacaaaatataaagaataatataattctttacatatacatacatataatgggaacttccatgtcccattatctagctccaacaaacaagtcataactaatcttgtt

SEQ ID NO: 112954 - DNA, 1035 bp, Homo sapiens
gacttcacccaatgctccctttccttttgttgatattgctttgcatctgtttgtagctctaaatcatattcatgaatataaccatatgctgggtcctttgggtccacctagcaaatcatcaaaccgaaagatgctcttggggaccttagatagaaatatcatttactgtgatagtaggaaacataaaaaactggaaacaagtatgataaaagatatacaatatcattacatctaaaactttaaaatattattgagaacaattaaagaagacctaagtaaatactgtgttcatggattggaagattcaatactgctaatatctcaattctttctaaattaattgataaagtcaatggaataaaaataataattccagcagatttttaaaggaagttaaatttgataagctgattctaaaatttacgtgaaaagacaaagggctaagaataaccaggacaaacttgaagcagaataaagctacctaatgtcaagatttattttaaagatatagtaagtaattgagagaatatgacattggcataagagtggacaaactgaccattggaacaagataggaagtccagagacacacctacacatatatgttcaaatggcttatgatagaagtatagaggggaaaggattatctgtttagtaaatagtgctgcatttatcagatagccacatggcaaaaaacatatcatgtacacaaaagtcaattccagatggactgtagatctaaatgtgaaagacaaaattataaaacatttagaataaacatagatgaacatctttctgacttcggagtaggcaaacttgttaaaataggaatcaaataccctcacatgcaagaaaatagtgatacaatagagtaaataaaagcaggaccttctgtttctcaaaagactgaattatagagtggaaaaagtacttgcagtacacatatctaacaaaggacttatctccataatatgttagcaaatttcacaattattaagaaaaatcaacaacagcccaataggagagtgggcaaaa

SEQ ID NO: 112955 - DNA, 1069 bp, Homo sapiens
tgccaagtatggagggtttagagcaagtgcatgacaataccaaagcagagttcttttagaataatcaaatgctgctaactgggtgtgtgattctgagggagacagcctattttcatgtctgatagagttcctttgaatggagaatatggaagatcctgtactttattaggtggccctctctactttaattatcctgatgcctgtcctctgagtctttctcattctcctctcttgtcttaatcctgatttaaaaggaggataagaaacataagcagatgaataaaaatagcagcccaggaagctttgcattgattcattctacaaatagttgttaaataaatacatgtgccagacactattcctgatcttttaaaacttgtgttcttgtgtgtgtgtgtgtgtgtgtatgtgtatgtgtgtgtgatgcacataaataaactatttgatcatcaataacttttcacagtagtatcttctcacactagtgaacatttttggggtagttttggtacaggcatttaggttgatttttttttccttacaaagttcctggtaagtttggaggctgggagtttgattatagaaggtattattagtgcctgtctcttaattgatcagaggttttgctatactaaaatgaccgttcttaaaaaagtgtttccgaagatctctcaagctttataaaccttcatttttgtacatgttgtaactgtttgctgaaaaattcattctgtaggtggctgaaacctccagggggctatgcactgggtgagagaagtgaaataggatgtggtaggagagtaaatggcaaaacaagggagaggaaaaaacatcctagttttcttctgcctggaaataaacatgcaggaagctttaatatcagtagcagctgtagattttttttaagttaaaagttttggagatagttggaaaaacaaaaacaaaaacaaaccacatctggaaacatttcaagcaaaggcaatgtaaaaaatgtgttggatgatatattaggagaagagctggttgcaagtaacactaaaatttaaaatgagatcacttatttctctct

SEQ ID NO: 112956 - DNA, 1020 bp, Homo sapiens
ccctaaaaatgttaataatgttgatttttattgttttaccctttgttttccattttatgcaaccaagattttcccttgcaccttagaatgctttctttaaaatgtccttgctctcttaattttctgagttgctactttctcattttccttgctgattataaaacaactgaaggataagaaacacatgtttttctataactgtttttaattaaatgtttggtaaactgaaatgattgtaattactcttttgttatcttcaagaatctactcaagcttcctcagtttctcaaatcattcttgggcaacaaatgaacaagaaagaggacgtcttattatctggtgtctggcttgctgatttaataacctaggagacagtgtttgaagaacacaaactctaaagtccttcacttaaaaaaaaaaaaaaactttcccaaattgcttaccatttggaaaaattgccttaccttcttcagtcatctctgatgttgtcatcctcagagtaagaagtacgcattcataaggaaccataacgtccttcaggaaatccagtacaccctacaattttacctaaaactttgatgttgttttttctgagcattttaccttctagggaaatggatctcatgctgtttatcagtttctgaaagttgttattaatctcccctcatcccaaaattgaagaactttgcttaaatcttagaatcagaactttggctccagtaataaagacttttcaatatctttatctgccattgagtcttacctaacgaaataaagcctccaaagtgggaatttgaaatgttttagaatctttttttttccttttgacatagtgattggtgggatgctacaggcagttagtggttagggtccagaaatgccagacatcttgcagtgagagggatagtctgtacaaggaagaattctcacatgttctgactaacactggatattattacaggtgaaaacattggaatcttgtgaacctcaacctgtgttttacatatgtatacatgaagt

SEQ ID NO: 112957 - DNA, 1800 bp, Homo sapiens
aacagtgaagacgatcgcacatcatgcatagttcgacaagccttagaaagagaggattccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggc

SEQ ID NO: 112958 - DNA, 1003 bp, Homo sapiens
tccccagagtttgttttgttttccactctgcaacacattttagctttgtcataaggaaatcacgctttttatcactgactcaaaacaatcagaaagggaatattgaaatatagttttcttcaattctgaatgcctttgttaattatgctgaattacacacacccacacacccacctactcttgattgttcaaaatgctgtaattggaaatacaaactatttgggaccaatgttgtacttaaagtaaggaattgaaacttgtataatattttttgttctaataccttattttattcttaaagaatttataattaatactctaatgtttgaataataaatcttaacatcatagccacttaacattcaaaatgctcatgtgtatgtgttttacaggtgtgttctactccctcttctgggaatgaagcctccccagcaaagcctatacctgcttgttgattctgttgatgaagggtgtaacattactgaaggtgaacaaacgtctaccagcttatctgggactgttgcagcacttttagctggtcaccatgagttctttccaccatggctattgcttctctgttctgcccgaaagcagagtaaggctgttactaaaatgtttactggtaagcataattacttactgccatccttaaatgcttttcattaatgaactagtttcttagaggaaaaagtatgcagttgaacatctgcgtgttgcatttgctccttctatcagctattctcaattgtgcgttttgaaatttatataaaaaagccttagcatgtttttaagatcatttaaacatactttttttcaagattcttttcctaagtgctttagtaacaggagtatctcatgccatatttgctgctatacatcttggggctgcatttgttatgttgttgtatcatgatcaatttaaacctttttctgatgtttgagattacagtctatgtaatatataaaagcacactgtcagagtttctttttttttctttctctt

SEQ ID NO: 112959 - DNA, 1133 bp, Homo sapiens
agagcattggtctgttcagaagaacctcagaataccaactggaaagaagacaactcattaacagtgacttgctcaatattgcacatatggaggacatagttagtctcctgagttctgagtattctgactccctggtagtaccaagctatgtcttttgcgtttcaaagaaacgttaacaagtaataattttgcgttattttcatttttcatacagtaaaatttactgtttgtagagtacaggtttataattttgatagatgcatggagtcatggatccacctagttgtgatatagagcagttccatcaccccaacaattcctacttgctgtcctttttagtaaactccttcccccactccaacctatggcaaccactgatgtaaattttattcctacaatagttttactttttccatgtgtcatgtaaatgcaatagtatgtgcagccttttggaactgggctctttaacttagaaaattgatttaggattcacccatgctgttgtgtggatcaatagtagttgtttttccttttttgttttttctcttatgactgagtgatactctgttgtatggatatgccacagttagtttatcccttcactagtagaagatcctgtacactgtttctaatttgggggattataaataaagctgctgtaaacatttatgtcatttatgtacagattttcatgtggccatacattttcagttcattttggtaaatacttagaagtgggattgctaggacatgtagtaggtgtatctttaacttttttagaaacctgtcagacttttctgaagtggttgtaccgttggaaatggctatgccattgctctgcaccagcacttggtgttgtcagggtttttacttatttgcacaattctaataggtgtctagtggtatcacactgtggttttaatttgaacttctctaatgactgatgatgttgagcacgtttttatgtttatttgatgcccttctctcttcctctctaaagtgtctattttaatcttctgcccatttaaaaacaatttgttttcttagtgttttgagagtgatttatgtattcttaatatgagccttagtcagaaatttgctttacgaatattttctcccagtcttcagctttt

SEQ ID NO: 112960 - DNA, 1073 bp, Homo sapiens
agattgggttttttctttagttttccacatgtattgtctcatctctgttcttgaaacatccacaatcacataaactccagttataaccatggagttatgtgactcattaaaatttaggaaaagtgttgctgagctgtggaatcaggcgtttctccctcagttcaacaactaatacatagactgctgatcaagaataaggaaccaaataaagtcatgcacgttctgttgacagaggaactctgtggctgttgaattttactgtaactagttactctgtcttcagagtcaacttaatatacaagttatgtcataatggatggaaagacctgtgttgatgtatccagactctagcaaatgaagataaaaaacccgttatgactaatccttgggaagagaaagtctgcaaaatggctcaaaccagtttactgcaagggaagcagttttactgtagggagtgggttttccacaagcttcagcattgcctccaggagaaaagtaactgctgcaatagtgctgtcaatgcaccatcacttgtaatgaattctgggaataatgctagtggtgtctctggaaagggagctgcctggggtgtgttgttggtaggagggcctggcagtggcaagacggccctatgtactgaactcttatggccaagttcacctgcaagtttgcagagaggtttacatcgccaagctttggcctttcatttctgcaaagcccaggactctgatactttgtgtgttggagggtttattagaggtctagtagcccagatctgccgcagtggactactccaaggatatgaggacaagctaagggatccagcagtccaaagcctcttacagcctggggagtgcgagagaaacccagccgaagcatttaaaaggtaacaataaaaatgtcatggtgttcagatttctatgctgaaattaaattaatttttagttgtagttttttgttttaactttgtgggttacttttactggtgctgtacatttggccttaatctgaagttatgagtatacctgtttactttgaatatcaaaggaagtaaaatttaggttttggtattg

SEQ ID NO: 112961 - DNA, 1084 bp, Homo sapiens
cattaaacattagtttttgaactacatgaatataatgtttaatttaaatgaacgtcatattaacacatatcctcttcttgttatccattgctgatagccaacaattcattaaatgaagattcaaacagtaaacattttacttattactctaagattttatttaatttttattttatttatatttttatcatatctcatggttttgtggtttgggactacactgggtgcttctgtctcatgaggttgactggtggcacttcacagtatttacatggtgactgaatgatctggaggggccaagatgactttgcatgcctgctgccttggcagggttggttggaaggttcaggatcatcttggccccctctgtcctcaagtagtctcagaacttcctgatgtggttctttagcaaagtagttggactttttagttggtggttctcaactccaagagccacaagtgaaagctcccagaactctcaaaggtcagactcagatgtgccatagcagcacttctataatactctgttggtcaaagcagtggtgaccagctcagattcactgtgaggagaaacatgcatcactcgttgattggagaaatgtcaaagaattttgaccatttttattccactactagctctaataagaatatttgtgtattcttcatttagtaaatgtattttactttgcttaaatcctcttaaaattgagaacacaaatatgataacttgttcagagaggatgtgaaagaaatttgagttgcaacattttatcaacctagattgtccccttcttccatatctattctaaactacaagaaatgaagatttccaaaggttctagagaaaaactcacacacataaatattttatacccctcctccactttctataggctggtattaggtaaattagagttggttagatggctatgaaagtaatggagcagaagataaaatttgagacattaagaattatcagctatgggtaccagatatacggatatggtaatgagctgattcatgtcttattttgttgtttgttaccaattttcttttaacaaaatcattttggaaaactggtttt

SEQ ID NO: 112962 - DNA, 1923 bp, Homo sapiens
attttcatgtacaatttccaaatggcatgcttgtgtggatataattgcataatcaactgctaatgcaaattatcattcagtgaaattgtttaaagtgagcagtaaccacacagtggttgatttaatttttttcaactcatagattctataaggggaccatctcttttttcattggttttcctttctattgctatgcctttttgattccttctcccccaactcctattcaaagctctacaaaaaaagcatcctatatgaaataatgttgaggatcacaataaattagaaatagtaaggataatttgaaataataaagaagtttcaccctttcccatcttcctgctccccagccccaaccctcacccccatgccaggatgacatacctttcttttatatattgggctgctattaagattatcttttctctctttcatagtgatcttgagcctgaatggctggacagtgtgcagaaaaatggagagctgttttatttggaattgagtgaggatgaagaagaaagcctccttcctgagacaccaactgtgaaccatgtcaggttcagtgaaaatgagattatcattgaagatgactacaaagaaagaaaaaagtatgaacccaaactcaagcagtttaccaaaattttaagaaggaaaagacttttacccaagcgctgcaataaaaaaaatagcaatgacaatggaccagtatccattctaaagcatcagtccaatcagaagacaggagtcattgtccaacagcgatacaaagatgtgaatgtttatgtaaaccccaaaaagctaactgttatcaaagccaaagagcagctcaagcttctggaagtgctggttggaattattcatcagaccaagtggagctggagaagaaccggaaagcagggtgatggagagaggcttgtggttcatggcctgctgccagggggatctgctatgaagagcggtcaggtactcattggtaagtgttgctggtacacatccatccctgtttacagagatcttgattaatgatgacaccttgcgggaaatgtgataaaaacaattatatacagtctccacagataaagaactgattaatgacatttggtacagtagagaaatggttacacatggtgcactacaaggcacagtgttcttaaaatgaccagttcagtgtgttgagtatgtgtgtgccttgttcaggccaagaaatagcttacctaattttcaagttttgaattatataattttatttcatcttggttatatttgctgacaagaaaaaaaacgttgatcatagagtgataatttaggtttgaatggctatatccagtaacaggatacaaaaatatataatttatgaataaaaatacttttaaattgtatgtttgcacttgagtacactaagttcttggagtggttttcaactgtttcatttggcatattttgcaacagtggtgttatatataaatttccttttaagggcgtgtgtcataaaatatatctgtcataaaatagcccaccaattttcaagaaaaataaacccacaaattattctgaatatatattaagatgaacattttgtgttgctgataaattttaagctgttagatacaatgtttgagttagtagcaatctaattacttaaagataaatgagtaaaatttgaggatatattattactaaaatttaaaagtaataacagttctaaaagctgacagtcttttaagtttatctagcataagaggtttaaatgaagaacatttacagataaatttacaaatatttccaactttaaatctgaatttcatttgtttgttcactgatttgacagtttgtttttttagcatctgctaagtgccaggaatacaaagattactttactgatccaattatttcttgaaaggagctatgttttagtggaagaga

SEQ ID NO: 112963 - DNA, 1049 bp, Homo sapiens
tataaagcattttgtgaattatcttgtatgtctagtattttccatgatttaaaataaaatatgctcttttaaagtttgaattcagattagtttgtggtatacacagtgtttctaatttgacaaataagattttataatatcgtgacacttttttcttattatctatattataatttagttctgtattctcactttgtaagtttaattgctgtcttggcttggatttaatgatttcaccaaaaatgttgaatattgtcttttaaaaaataatgtaaaagtaattaaatttaaagactcttaatagttacttgtggtacctgtgtagctatgtaaccacaggggacgagaataactgtatagtattaacaaactataataaaatattagtattataaattattattaaagagattaaagtttaaaactgttttaaatgatttgtaatgtaaattaatcagtatcctacttagtatattatttgttattatgactaatttcggcagtctctaacttattttcaagtgtagtcttttacatgctagttaatgtgttaaaattccaagcatagttctccccttgtgtttgaacaaaactcccactgaagctgaaaggattcattttttgttcttttcttaacacaaagtttgaacttgccctgacaaagataatggttggaaaattgggtggtttgatcatttgtttcatttaacagcaggaaattctttatcattatccaatgtctgaagcatctcagaaacttaaaagtgtgagagggatttttctcacactctgtgacatgctggaaaacgtaactgggacacaagttactaggtaataatttttatttagctttaattctgtttttttcaagttcttttatttcaccctgacaaaatgctaaaacaagtatctggtatacaaatatacttgtatctacaatgtatgtattatatacattatagtctataatgtatgtatatacacgtatatatctatacattatagataacgagctctgcagaatgtctgcagatttttgcttcatctaa

SEQ ID NO: 112964 - DNA, 1028 bp, Homo sapiens
tatatcttacatattaaaggtaatatctgtggtatttctttaatatttcattacacatttaggaaaatgaccatattagtattatgaaagagaaaaacacacaaagtaatatttcaaaatgtgaaagtctccctttatctctccacaggtaacctcccttttgtatatttaatataatttttaaattagagtttactattttttagagtgtttggtggatgcagtggtgtgctgtccagttacaccttagctcagggtattcctttccaacacttgagaatggtggctgctaatgcctcacagctcccctagccttgtcactcccctagccgtgtcctacacggaaacttgttgactcagctaaggttacattcctccctgggaggagcccatttctaatgactaataaataagtgagtacaaaggcttggccccttgcctaaattgaagacaactctgaaaggccagccaagcttcagagtacacagtggtatcggctgagacttgttgccgctgcagcacagttcatcttctccctctgctcaatcctgctcagtcactacacccctacagctgtttttcccaagagtacttcctaataagtttcctcccggcatatctcactctcagagtttgggtcccaaggaacttgtcccataacactctctttagaaaataggtataatttcaaacgttcattgagtagggaattctgaggtaaaagaaactgagtgaggagagaatgtttagcaacttaaactgtctgtaattattataatatgaaatgttatatattcacttcttgtgcacttatgtggtgacacgcaggtctgcctgtgccttggcaggtatttaattatgacatcatgtgtgggatcaactggtgtaataaactcaattgcctacttttatttgaacaactagacacgtactaatagaattcacacacacacacacacacacacacacacacacagtacagagctaccacattcttaatcactgaaacactttacagtaagttcaaa

SEQ ID NO: 112965 - DNA, 1489 bp, Homo sapiens
atgcctgatgatctgaggtagaacagtttcatcttgaaaccatccctcccccagaaattggtctccaatgccagaaaggttggggactgctgggttaaggtacagctatagacacaagactaatgcaaattttttggcatttggttggttgattgcttgcttgcttttctatccaggatgaagtttcattgaatgttgttatctgttgaataaataataatgctgtgtacaattacaatatcagattatttaaatggcaggaaaagataggtgttgatttcttgaaaaggataaaacttacagaggtttacttgtgacgttatacagccaaaaaacctctctgaaaatggttgtaatgtatatagcaatacatgtgttagggatgccaaatttgtgaagaacttgggtttaaaagtggaagaacattggacaaggaataaggaatcctggactgagcctcacctcctatttccttagctatgaagcaagtgggctgaattacatcatctctccaggttcattcagcagtaaaattctgtgtcttgtaggatttttttttgagtcctcagaaattgttattctgtaaaaatactgtgtttgaccctatattcctgtatgctttgggttcttatgctcctatttccctttttaacattaactgataaatgttataaaggaatatttcatttacttatttgataatatttagtaatataaattagttttccccatcttatttaaacattgaggtacctactctgcaccagacactattctaggaacgtgggatacaacagtggacaaaacaaagtcccttccttcacgaagcctattttctaattagaaattagtatgctgagaagaattagaaaatagtatgctgagaagaatcagtgtcaagcaaaataataaaacatggtaaggattagaggtgggagtgactattttgaaaggtctctctgatcatgtcaagtgatacttgaacagagacctgaatgaagtgagggagcaagccatgtggctctctggggacagagcttccagcaaggggaacagcaaatgcaaagctgcagagcattaccgcctgaggtctgcctcctgtcaggtcagctgcggcattaggttctcataggagtgcaaaccctactgtgaactgtccatgcaagggatctaggttgcccacttcttatgagactctaatgcctgatgatctgaggtggaacagtttcatcctgaaaccatcccctaggggctgggagagtactggagcaaactgagtgagaagaaagtggaagaagagatcacaaaggtagcagggccagcttatgcatggccggatagactatgataaggactttgggctttgttctgaaagagatgatacattcttgaacagttctgcccaaataagggacatgatccgtaatttttttaaaggatcactcaggctactgtgggtagaacaggaaacagaatagcaagggtggag

SEQ ID NO: 112966 - DNA, 1022 bp, Homo sapiens
ttatatagggaaactttaaaataaatttttgatttgcataacctatttttaaaataatatatggttatatttctccttttaaattcattttcttataaggagaagcaaaataatagcacaataatataaaagtaccatggaacaaactttttgtttttctggtttagggcctgtatatcattgggatcaagaactcgagccattggaaatgcagcaaagagccaggtaaattgttaatgtggatgttttgacttacaggaagaattaactgaatattggtaactaagttccttaagttatattgttaagagtgaataagagagtgaggaaaataggacaggtactacatctttgttttgttttgttttgtttttttaagatataatttgctttgggttgtaaaatatttcttgaattttattttttaaaaatattttttagttgtgaagttagggtgtgctactatgtgacatcaatttttccccaaatggtccctcaggtgaccatccagagaataatgagggatattctgtctagaacatacatttcaatgatagttaagtaacatctttgtaaaataaggtaggaaaaatgaaagaactaatttccagagtaactcaacgtggctaccactaatttacatagaatttgttgaagtatttatatttttaggcttttgaaatctttatgattagaacgttgacttttaacattccatgttataaactgattttccttggactttcattacctccctgaactaaaagcccttaacaattatttcttgcattttatatatatctgggtcttatatctcatattctggctgaccttctaagtgtgtcacagataatcagagtctctaaaagcagcctttaaagtcatttctcctaaggagttaaagagagcaacatagtaattcagcatccctatagttttcatgtcataattgaagatcaaggtctgtttggctttaaaggtcactaggattatagcaactggatctcagtaatattctgtaa

SEQ ID NO: 112967 - DNA, 1016 bp, Homo sapiens
cgagactccatctcaaaaaaaaaaaacaaaaaaaaaaacagattttttaactttattaaagagttatgtgacctgaatttactgtggggatactatagatgaaggaatcttaggagaactttatcgtatttaattacacaacgttttcatctttttatgtgtgctcctcatgaattatttgtgtgcattatttttaatggcattagattttttgtctaattacaattggaagtctgccctagattttttgtttgtttgtttttgttttgttttgttttgtttttgtagcccagaggtcctttatttttttttttttttaacacctatgccatgaattcatagggaataggttccagcagctcaggctccttcccattggttctcacaaagtgtgctgctctgggtggagcaggctggcgctttagttgaacccaggtacctttctctttggcttctttctttttctgatcattttccttcacacgtttcaggaagctatctcggctcttagagtgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccgttcccttgatgtctacaatatcacctttcttatagattcgcatatacgtggccaaaggaataactccatgttttctaaaaggcctagagaacatatatcgggtgcctctcctctttccctttgtgttcgtcattttggcgaattactggaagatggcggttccagccgaaaggcgattttcttttattctattttaagacagtttctccctttttttaaggttgctttttgtttttattaataattactatgcatctttcttccaaattgatcagaattcaaccactagactttaaactacttcatttaaggactgtggctttttctttcaatctttccatgt

SEQ ID NO: 112968 - DNA, 1332 bp, Homo sapiens
ggccaggcatggggtgccgtggcttatgcctgtaatcccagcactttggtggggagcgggtggctcacgcctgtaatcccagcactttgggaggccaaggcggacggataacaaggtcaggagttcaagaccagcctggccaatatggtaaaaccccgtctctactaaaaaatacaaaaaaaaaaattagccaggcgtggtggcgtgtacctgtagtcccagctactcgggaagctgaggcaggagaatcacaaaaaaaaaaaaaaaaaaaaggttacagagacttcttaaacataatgatgtaatagttacaaatagattggaaaagatatactaaaaatctatcaaaagagaagtgacaatcagataaaattgattttgctttggaattaccttaaaattgattttaaggtaaaataataaagggagtgtgggaataaagagtaagcttttaacaatgataaatggagcaattcaggattataacagctctgaaacagcctcaaaatatatgaagcaattcacaatgagaagctgaaacccataagaatagtaataggccatgtgcggtgtctcatgtctgtaatcccagcactttgggaggctgaagcaggcacatcatttgagcccagcagtttgagaccagcctgggcaacatggtgaaaccctgtcacaaaaaaatctaaaaattagccgggcatggtgaatacatatataaaagaatggagcaaaatttaaaagctggatctaatgaaattatataataaattgtcactggactattaggtaaaacttttccaaatacacatggaataacatattcacaaaaattcattatagtagaccacaaagcaaaacttaatactgaagaccgtaatagtttttcagacaagagaaatcaccttataagacaagattagaaatcacctatgaaatagagatggtgactgtagttaacagtgtatacatttgctttacaatgtatttcaaagtaactagaagagagaactggtcatgtacccaacacaaatgataaatactcgaggtgatggataccgtaagtatcctgactttatcattacacgttctacgcatgtaacaaaataccacatctaccccactaatatgtacaaatatcagtttttagatgtttttaattttaaaaaattatgtagataatccaagacatgccaaatgtccatatgcttggattgaaagtattaacttctagaaatgtcaaatcatgttgaaaattagaaaatacttcaaatgacagtgaatattgttactttagcaactgtaccccttaaactccaactgctttttaatata

SEQ ID NO: 112969 - DNA, 1059 bp, Homo sapiens
tgaggaaccagatcactagggtgcaccatcaccctgagcttccagtccagcctggaagcgcaggtatccccgcacggagtcaacatgccttccaccctagacacctgctgcatcgaggtgtaatacccgcttgaattttgtcaaattccccactcgatccattttatcttctttttccagccccttcccatcttcctttctactgtgagtcatcacacataatctttaattttaacttttaaggattttaaagttggaaatctgcttggtaaaggatcatttgctggtgtctacagagctgagtccattcacactggtttggaagttgcaatcaaaatggtaagaataaactaatcaacttctctcctgtactttgcaagtaactagagaggtatcagagatgtcagaaactccttgtctactagcctttcctttgattatagtgtaaggaacactttacataggcagaagacaatagtgccaagtccagccgttgaacttaaaaatattttaggaaagccttgaccttgcttaagtaagttttatcttcattaatgttcagtagacctcgtatgtggtgtaattatccatacttggagtaatgagtagaaatcaactaacaaataatttgtttatagttcactgtgtataattttgtatttccctgtaacatacaaaatattattcttgattgttagaagtcagcctaataggagtaacataaacataagcaaattaagaattatttgtcagccgggtgggtggctcacacctgtaatctcaacgctttgggaggctgaggcaggtggatcacctgagctcaggagtttgaaaacaactgtgcaacatggtgaaacctcctctctaccaaaaatacaaaaattagctgctgctgggcacggtggctcacgcctgtaatcccagcactttgggaggccgaggcgggtggatcacctgaggtcggtagttcaagaccagcctgaccaacatggagaaaccccatctctactaaaaataccaaattagccgggtgtggtgctgcacacctgtaatcccagc

SEQ ID NO: 112970 - DNA, 1103 bp, Homo sapiens
aaaaaaaatcatttatctaaaccacttagaaaaagaactggaggttttgctctaaaatttgcctgaattgggatttttttttcttaatagttaggctagttgtgctattagattatttaaattgagataggatattagaattaattggtcaaacttttaccaagcaccctctctgccgagcactctgctaggtgcatggggaaaacagataacagtaggttgaccacaaagacgtataaaaggacttcagtctattttaaagtatactttattttcaaagttcacttttaagcagtttatatttgaaagtctgtcaacatttaaacctgttatttttagatagataagaaagccatgtacaaagcaggaatggtacagagagtccaaaatgaggtgaaaatacattgccaattgaaacatccttctatcttggaggtaagatataaattttgtagaagtgaccaaggacactgaatttttgtatattttaatttattatgccctttcacatttcagctttataactattttgaagatagcaattatgtgtatctggtattagaaatgtgccataatggagaaatgaacaggtatctaaagaatagagtgaaacccttctcagaaaatgaaggtaggtgtgtggttttttttgtttgttttgtttgggtggataaaagttttgcattttaaagtgtagttttgaggaatatgctattttataatatatagtaaaactgtttgaattattactttaagctagaaaaggagatttcctacatcccaagctgctaattcttaaaacaattcaattattacggtagtaaagtaagaaatttgttatccttctgtccttaaaaccacattttaaattaaattattggtagcagtttactgtgtatcttttcaaatgtagtaacctttttaggatgtcattggtgactataaagtagttctaaatcaagcataaatagccattgaaactgtttattatagaaaacatgaaacatacaggtagtgtgctataatgagtcccctgaacttaacactcagcttccaaaactagtgactcatggtcatattatttcatctttactgtttttact

SEQ ID NO: 112971 - DNA, 1429 bp, Homo sapiens
aaccctgtctctactaaaaacacaaaaaattagccaggcacggtggcgggcgcctgtagtcccagctactcgggaggctgaggcaggagaatggcatgaacccgggaggcggagcttgctgtgagccgagatcgcgccactgcactccagcctgagggacacagcaagactccgtctcaaaaaaaaaaaaaaaaaaaaaggttaatatgatctctttagaggggtgtgttggtaccactctgataattgctggtaattgaagtggctggtaaatctaagctccaagccactgttctactacagtgctctagaatatttacctgggtttcataatgtatactaaatactagatactgaatcttccagagtttctaaattgtaaattctcttttttaaaatcctaacagctcgacacttcatgcaccagatcatcacagggatgttgtatcttcattctcatggtatactacaccgggacctcacactttctaacctcctactgactcgtaatatgaacatcaagattgctgattttgggctggcaactcaactgaaaatgccacatgaaaagcactatacattatgtggaactcctaactacatttcaccagaaattgccactcgaagtgcacatggccttgaatctgatgtttggtccctgggctgtatgttttatacattacttatcgggagaccacccttcgacactgacacagtcaagaacacattaaataaagtagtattggcagattatgaaatgccatcttttttgtcaatagaggccaaggaccttattcaccagttacttcgtagaaatccagcagatcgtttaagtctgtcttcagtattggaccatccttttatgtcccgaaattcttcaacaaaaagtaaagatttaggaactgtggaagactcaattgatagtgggcatgccacaatttctactgcaattacagcttcttccagtaccagtataagtggtagtttatttgacaaaagaagacttttgattggtcagccactcccaaataaaatgactgtatttccaaagaataaaagttcaactgatttttcttcttcaggagatggaaacagtttttatactcagtggggaaatcaagaaaccagtaatagtggaaggggaagagtaattcaagatgcagaagaaaggccacattctcgataccttcgtagagcttattcctctgatagatctggcacttctaatagtcagtctcaagcaaaaacatatacaatggaacgatgtcactcagcagaaatgctttcagtgtccaaaagatcaggaggaggtgaaaatgaagagaggtactcacccacagacaacaatgccaacatttttaacttctttaaagaaaagacatccagtagttctggatcttttgaaagacctgataacaatcaagcactg

SEQ ID NO: 112972 - DNA, 2368 bp, Homo sapiens
gaaaattatgagctcttattgttttgttttttgtaactagaattcttttgttcaaaaaatgctattacaatcagagtgacgttattttgtgtcgacttgtgtttttagttatttactaaattgcttcattctatgtatattgtagctcatttaagaaaaactactgaatatgacagcatcagcccaaaccgggacttccagggccatccagatttgcagaaggacacatcaaaaaatgcctggactgatacaaaagtcaaaaagaactctgatgcttctgataatgcacattctgtaaaacagcaaaataccatgaaatatatgactgcacttcacagtaaacctgagataatccaacaagaatgtgtttttggctcagatcctctttctgaacagagcaagactaggggtatggagccaccatggggttatcagaatcgtacattaagaagcattacatctccgttggttgctcacaggttaaaaccaatcagacagaaaaccaaaaaggctgtggtatgtctgttatcttcttaagttactaaataacattttacttgagaatacaattcttgagaacatattttttagtcctctgtaatgtccttttactttggggtgtatacatgatcaactttattaaagagaaaagagactgggtgtttatggaaaaacagctcttatttccctctatcttcttaattatagtgacatgatactggtaagttttgaattttaaattattaatttaaagtagatttgaatgaaaaacattttaaaataatactggctatatgctggttaaagattattttgttcacaattccaatcagtgagctaatattatcctttgcttctatttttattgtttgtaaatttaatcccatctcaaattttaaaaaactggaaaatataacttttatttttttagcttctggaactaaagaaaaggcatatacacatttaagtttagagtttaaaaattattgtatgtgaattgagaatggtgtgtgtttttttaattctatctttatcctgttgtttgttcccattttacttcccatttcatccttgcctttgtttggcttgctattatcttttcaaagtccttattctccactctaccttctgtttgctttctgctcattgattatcacttcacacttcattatacattcttaactttgcaccatatggttcacagttgtgctcaaatatacctctgatctggactgttgtagtgaagcagctttgattttgacttcaatatttgtttctgccatggttaagtactcctaagtattatgtatgtcagagctgttctagtaaacaaaagaattattactgattttgggttttttttttttttaggtgagcatacttgattcagaggaggtgtgtgtggagcttgtaaaggagtatgcatctcaagaatatgtgaaagaagttcttcagatatctagtgatggaaatacggtaatgtgtagttactttattaccttgcaacttcaaattatcgtttaagcacgtttagcattctaattcattttacaatgatgtaagtttttttaaaatcagtttgccagtatgatagtgtctctggaattcaaaaattgaaatagcatattaaacatatttaaataaattggtgcagtgttaaaaataattatatctagtaagaaaatctaaacttttggtttaagttaaaaagcaaaaaaattacttttacagaatatttaacatttttctataaaataatatttaatgttacatttaaacactttgtatacgttttagcaagatatagtactggaacttaatggcatgtaattagaattttaaaaaaatcttttggcagatcactatttattatccaaatggtggtagaggttttcctcttgctgatagaccaccctcacctactgacaacatcagtaggtacagctttgacaatttaccaggtatgtgaatttaccagggaataaattttgatagtagatttatatgtatatacgtataaactctatatatagatataataaattataaatagcttcagtcaaactttaggtcatatcatattcttgtactttgtttctggtgagagttgtatgcctttaatgcaatgtttattattaatattctgtgttataatggtactatattctatttaaaaactaactctagaacattagtcatatgtctcacaaatgtaatttgtatacttgtttagaatgtggctatagttatgttaaaaaaaattcaacattgtgcttgcttcagagcacatatactaaagttggaatgttacagagaacatggcccctgtgactcacaaatttgtgaagcattctgcatttaaaaaata

SEQ ID NO: 112973 - DNA, 1086 bp, Homo sapiens
aggataagagaacagttttctgattttttttttttaggggtaaaaatacacaaaacagaagatttcattcaggtgattgaaaagacagggaagtcttacactttaaaaagtgaaagtgaagttaatagcttgaaagaggagataaaaatgtatatggaccatgctaatgaggtacatacctaattgtaggtttttcataccaattaataatgattgcaaatgacataggtgaaacaatgacagaagcactcttcttttgaaatagggtcatcgtatttgtttagcactggaatccataatttcagaagaggaaaggaaaactaggagtgctccctttttcccaataatcataggaaggtaaatgtctgaaaattttaaacatatggctaaaatgttttaaaagtttgatgtttatattataaacattctttagttttctgtaaattgaaagcttcaagggaatatatttggacttttccccttcagaaaacctggtagtactagttcacctaaggccttatcacctcctccttctgtggattcaaattacccaacgagagagagagcatctttcaacagaatggtcatgcatagtgctgcttctccaacacaggcaccaatccttaatccctctgtaagtaaatatatgtcacttctgtactttaaacctttcaatgattgcctgatgcccttcttgtaaaatagtttattgtggctttactatcatctacgtacttttccagcctcatcctgagccactttatcccatactatttatgtttgagcgtcaaaggccttctttcagttctttaaacaagtcaaagggccttttcacatgctgttcacttgacctggaactcttttccccaaccacttaactttatatgtgtaagtcttatttttcaagtctctgtttaaatgttacctcaatgagccctaatctcagccctctggggaaagctaagtgtattaacatatacatatgtagtttttttttttgtttttttgagacggagtcacccaggctggagtgcagtggcacgatctcggctcactgcaagctccacctcctgggttcacgccatt

SEQ ID NO: 112974 - DNA, 1450 bp, Homo sapiens
cctgcctcggcctcccaaagtgctgggattacaggcgtgagccaccacgcctggctagttgttttatttttactagtaaaatatcattaactgcctaaatgctcatgatagactcatgattaaatttattatatatttaatgaacatggcgatgaagattatatagcagtgtagaaaaatgcaacattaaagaaataggtgtgtatatttgtgtgtactcacccacatacacaaaaagaacatgccatgggataaaaagatgaaagaaatccaccaaaatgaaaacagcaattgtgcaggagggtggggggttcttttctgtatttttctaatttccaataatgtggttatattttcgttaaaaaatgtttgtttttaaaaaaattaagctaatgaaaaatctcataattgtctgcttttgctgaatgtggcttataaaaatgctgaggaataatatcttcctgtcctttattctttgtagatggttacaaatgaaggacttggtcttacaactacagcttctggaacagacatctcttctaatagtctaaaagattgtcttcctaaatcagcacaacttttgaaatctgtttttgtgaaaaatgttggttgggctacacaggtgagaagtttctagtacagtgcattttctcagtatgaatttcttttcattttcacactgataagacaattaccaaaaaatacaaattattgtaatgatatctttttacaaggaagtttttgtaccttttaacattggttatatcattaaaaattttaacttcttaaatttgtattcagttggaagactccagacattgctgataagaggttgcctgctaggcttgggtgacctacttttgccatttgtttttaaagtagaggtcatgataattactaattgtgaagagtagagtgtgatatctgggacgttttaaattttggaaattatttgtaatcaatattagtagagtaactttcttttttttttttttttttttttttttttgagacaaagtctcacactgcaagctccgcctcctgggttgacaccattctcctgcctcagcctcccgagtagctgggactacaggcgcccactgccaagccgggctaattttttctatttttagtagagacggggtttcaccatgttagccaggatggtctcaatcccctgaccttgtgatctgcctgcctcagcctcccaaagtgctgagattacaggcgtgagccactgcccccggccagtagagtaactttcatctggcaaaagaagaaaaggatttttccattaaaagtcatgtgaaagccaggtgtgatgtcacgtgcctatagtcccagttactcaagaatctgaggtgggagggtcatttgagtccaggagtttgaggccagcctgggcaacaaagcaagaccccatcttttttaaaaagtgaagtcaatattg

SEQ ID NO: 112975 - DNA, 1044 bp, Homo sapiens
cttgtgggggaaaaaaaccaacaaccaaaaaacttagaaatcctaatggaaattaatgggaaacaggattcactttctaataattttaatattgtaataccttagctattaaaggaataatctgaaaaagacatgaatattctcagtgctctgccatcgtagccccaaatttgtagtcacttagagagttttttttttaactgtggaaaacctgttaaatatgttaaatattaatacagaaccacaaaccctctactgtatagtaattttgtgtgctactactgctgtttttttttttttctgtgcctgttcttacccatgcttattatttttctagttaactagtggagctgtgtgggttcagtttaatgatgggtcccagttggttgtgcaggcaggagtgtcttctatcagttatacctcaccaaatggtcaaacaactaggtaagttcttaaaatactggtcgagattcagccctttgctataatttctctttctctatatgttgaaatggatgatttaataaagatacttctttcattttgacaatgatcgtgtgattctttaaactgttaattattcttagcaattcatgtagtcattaatgcatattttatgattatctgtattaactcagggcaattggtataaataatccactctaagaggttgggttccttgtagccttactgttccatagtgtaactcgatggcctttttcagaagtaagggactcctaattctaggttcaaataatataccaaacctatttacttaaaagaacagaaaaaagaaatctttaagatataacctgcttatttttcccaaatgaaaggctatatccccaatctaatgtaacgtgattaatgtttgaaagacttttttgaatgtgtatattcattctatatgaaaatatgtgtcaggcaccaagccaaaaataaagaatctggcaatatgaaaaacaaggagttatttgctttcctcatttaaatcagaacttactaaaagtagggtactgacgatgccaatgcaggcgttctctt

SEQ ID NO: 112976 - DNA, 1563 bp, Homo sapiens
tgcccaggctcgagttagtggtgcgacttggctcactgcaacttctgcctcctgggttcaagcagttctcctgcctcagcctcctgagtagctgagattacaggcatacgccaccacacctggctaattttgtatttttagtagagacagggtttcaacatattggccaggctggtctcaaacacctgacctcgtaatccaccccccttggcctcccaaagtgctgggattacaggcattaaccaccgcgcctgtccggggccttttaaatttaatgaggaatccagatttttggcttgcttttgaaattacgaagccagttcaagtttatctaattttccttctgttacttaaatgtgtttagaaaatggtctgttttaaaagaaaagaaactgtatgcttcacttgatttaggtatctaataaataattgttataatttttctgaggtgcctcttgttattgaagaattactgaaaaatataatgtgctttttgggactctcatgagaaccaagtaattcagttacgattttgtctttttttcttttgcttcacttaggtatggagaaaatgaaaaattaccagactacatcaaacagaaattacagtgtctgtcttccatccttttgatgttttctaatccgactcctaattttcattgattaaaactcctttcagacatataagtttaataaataacttttttgttgactttcaagtaaagtgattttttttaatttaacataaagtcttcagaaagcctttctatgaaagaattttaacctataatgtaaaggatgtattctgagagaacaaagcagaatgaaacttgagtcacttactaaatatagtggatataaaatagaacacctgactttgctcttagaccataacccccgaacttactatgttcatatatttgtattgaacaatcttttaaaagcaaaaatgtaaatgatgtgtagtttatttgtgcttttattgttttccctgcgtctcagacatgttgagaatcatggacaaaacctgctggaattttggaatttttgaagatgtaaataatgtgtatttatgttataagtaacatatgtaaacatgtatatttgttttatatttatttttgtaacaccagtgtctgatgaaacatttttgcaaatgcattttataaaaaaataaatatagtgataagttacattatcttttgattcatttaattaaatacttatttttaaataacttaccagtaaactcactttttaaattttgttgcctgttgaggagccaattaaattttaaatattaattttgcaaatgttaaatacattgtttctctattatctgaaaatcttggtatattttaatgaatttttttaaattatacattaagttctgggttacatgtgcagaacatgcagttttgttacataggtatacatgtgccatggtagtttgctgcacccatcaaccggtcacctacattaggtatttctcgtaatgttatccctcccctaacctcccatcccccacaggccccagtgtgtgatgttcccctccctaggtcc

SEQ ID NO: 112977 - DNA, 1120 bp, Homo sapiens
aagtagaaattaaattacaaataagtcttcaatggtcaaaaatggtgcccagaatttcttctcaaaataagttaatctattcttaaacagatgcaggtaagtagtttatccttgtcaaaacaaaaaattaacagatttcactttatgtaagagataaggtttatatgaacaagaagagtttatttttaaatgtaaagctgaacaagatagaatggagatgctttgtgaagttataaatcccttcaaaatatgaaaatcatcctttcaagtttaaatttgttttcaaaaacatattttctcttcttaaatatgtactactcttaacaatatatcataccttaaaatctcctgttgtcattttctctttatacgcaacttggcctactcaagaagacatcaacatggtgattttttttcctcaaactttatctccttgctcttttcccaatcccatgttacttcctttcgccttcttttgtgccaagatgagcaaggtataatcctccaaagaagaaaatgctccaaagaaaatgctctcaataaaaaggaaagtaagagtcatttgtgtaaggttaagtttatctaaattttaatcaatattataaacctttgaaagctgggaaacttttttctgttatattcttgctggaaacaggttattatgctaagacaaaagctccagtcagtgggcttatgttgcccaaatatttctgctagtaggactcactggtatagttaaattaccctacaattagtgattaattgaaactgcaactttctgggatattttcctcactatgaaaaatcaagtggttaagactgtggactttaaggatagactgttacttagacaagtaacttttctgtgcctccattctttcatctgtaaaacgggaatcataatagtattttcactccataagactgctgtaagaattaaattgtatgttacacattacctggaatgtggaaagcactccacaaattttgctcttatcattttcatcattaccattattcttgttatttttgtcatgcacactatgcaaaccaagggtagagtttactctttaagattagacgtggcccaaaaaatgtaagacagagaaagcagctgcag

SEQ ID NO: 112978 - DNA, 1441 bp, Homo sapiens
ctcaaatattagcattatccatactcatttattaatgtaggggttacttagtgaaaccctgaactaaaataaggcagaggtgtagtattagaagaaagactcatagaaggcaaggtaggatgttaggcacgctaaatggaaaatatgtgttataatttttatttcataagtgaacttgataatagaaaatgcatttttttataaataaaaagtaggtgtctgaataaaaatacctctacttgggtagaggtatttaaaattctataattttgttctgctatggctaattcttacagaaccctctttctggttccactgtatattattttaatgacacttctgcagtgggtattaagaatacagcttcacatttattcatcattgtccattcactcattagttcatgcaaccacaaaaaggtattataagaataatatttcatttctgaggtaaggaaattatcatctagtatgtttttatataacctactattcacaatgacatgtagaattctctctgttattcaacatatgttcttgttcttcaaaatctgcaatatctgtagtctgattcttggagactggctcaccgcaattgtctagcagagctttagaccaggaagtgccacacagcaagtagtttccatcacagtcttagctagtttattcctgaatcctcccatatcttacagaaagagcaatgagtcttttgtaaaccactcccaggagggtgatggtgagcactattattccacacaccaggctgaatgcccatcgtggtccccagtgagcatacacttggctgatgaacataggcccaagaatccgggctccacttccagatgctgttaaccagcccatgtatacaccctgttgggggtgaaatggaggacaagcagattgatattggggtttagttatttaaaagcaaagaaatggtattaccaaactacagcaaacttacaagaatcatttctgcatcttttacttttaaattaaacataaaatgcctcctataaatatagcatttaatattaagtcagattaaaaaaaataaaaggagtgtaaagggaaaaacttactgtctgctgaagccctgggaataataaaattgattaaaataccttttaaagctaacatttattttgtacctgctacatgccagtcactgaggtaggtgctttaaatacatcatttgtaatgttcacaagtttcgatgacaggtgttatgcctgtttaacaaaggtagaagctgaaactcagaaagtttaagtaacttgttcaagaggtttgaagccatatttggctgactccactgtgccactttacactctaccacaatgccactcctacaacttctgtatccaaaactataacccacataacctacccaagaatgaactttatagaagttgtgggatttttaaaaattttaaatgctg

SEQ ID NO: 112979 - DNA, 1052 bp, Homo sapiens
agcatttaaaatttttaaaaatcccacaacttctataaagttcattcttgggtaggttatgtgggttatagttttggatacagaagttgtaggagtggcattgtggtagagtgtaaagtggcacagtggagtcagccaaatatggcttcaaacctcttgaacaagttacttaaactttctgagtttcagcttctacctttgttaaacaggcataacacctgtcatcgaaacttgtgaacattacaaatgatgtatttaaagcacctacctcagtgactggcatgtagcaggtacaaaataaatgttagctttaaaaggtattttaatcaattttattattcccagggcttcagcagacagtaagtttttccctttacactccttttattttttttaatctgacttaatattaaatgctatatttataggaggcattttatgtttaatttaaaagtaaaagatgcagaaatgattcttgtaagtttgctgtagtttggtaataccatttctttgcttttaaataactaaaccccaatatcaatctgcttgtcctccatttcacccccaacagggtgtatacatgggctggttaacagcatctggaagtggagcccggattcttgggcctatgttcatcagccaagtgtatgctcactggggaccacgatgggcattcagcctggtgtgtggaataatagtgctcaccatcaccctcctgggagtggtttacaaaagactcattgctctttctgtaagatatgggaggattcaggaataaactagctaagactgtgatggaaactacttgctgtgtggcacttcctggtctaaagctctgctagacaattgcggtgagccagtctccaagaatcagactacagatattgcagattttgaagaacaagaacatatgttgaataacagagagaattctacatgtcattgtgaatagtaggttatataaaaacatactagatgataatttccttacctcagaaatgaaatattattcttataatacctttttgtggttgcatgaactaatgagtgaa

SEQ ID NO: 112980 - DNA, 1046 bp, Homo sapiens
ttaaaaattatttctgtcatataaattatcttattgttggccatgcacagtggctcacacgtgtaatcccaacactttgggaggccaaggcgggcggactggttgagctcaggagttcaagcccagactgggtagcatgatgaaacctcatctctacaaaaaatataaaaattagctgggcgtggtagtacatctgtagccccagcttcttgggaggctgaggtaggaggatcacctgagcctggggaggtcaaggctgcagtgagctgtgatcatgacactgcactctagtctgggtgacagagtgagaccctgtctcaaaaaataaaaataaacaaattctcttattattaaactactttgaagcctaaaaatttttttaaatgtttatttataaattttgctacaatgtaatttctacattactttaatgtcataagaaaaattagatgtataggtaatgtaatttttctcctatttccctatagcaagtacagatgaagctcaggttccccaaggaaatattgaccaggttgctgttgtggccatcaatgttctgttttttgtgactctatttatctttgccctttttgaaacgtaagttttattccatcttcatctgaatcagattatgttttaacctttatttcttaatgcaatgttaattaggcatatagatgttattgaaaatcttatgtaaggcaaatttttcttaccatgatgtaaaaaatgtatatacattttgttgcttgtaacttgaatgtagttaattatttgtccataatcttaactaccttatcttattttcttataaaagaatctgtttcactactctttccctctttcatctgagttttatgataaatacagttataaaactttagtgccatgatttaattatccttaagctctataatttcctacatatatgtatatatatatatgattcaatctggtaattttaactcaatttaatacctgaccttgaagaaaaacctagtatattacaaaatctctgccttgtgcaggctttattgacctttatc

SEQ ID NO: 112981 - DNA, 1043 bp, Homo sapiens
actgatttttagttaagtttcttcctggagatttaagatagaactgacaggacctgatgatcaactgatgttaagctacctaacaaacttacatattcatgtcaccccctcttccccttctagtaataacagcatcaaaaaatacatatgttctagtctttacaatgttacctgatagcccaaattaattttatgggaaaagcgttaaattattccacaaaaatatcatttacacactttaggaattcagactattactagtttcctttttattagggaagaggtaatgatggaatatgaatgtggcttctgagtaggtgaccatacatctacctttgcctgggactatctgggtatgatcctatttttccttacgtagcagtctcttcactacaaaagtgttctggcttgcacaataaagcatatggtcacattacttataagcctcttttaaggaactattatctcattattcttgtaaagattaaaccatagaataccaaagagactctttagaaaatgcttaactacgtaagagttactactactgtagctataagggaaaaatagattgaaatgtacaaaccttttggagatatggccatatggacatcatcactacagaaaaccctgtgaagaagcaaactaggttatttatacttataataatttaatcattattacagatacaattttctgaaccgtggcatggattttaaaatattctgaacctaaaatctatgcatacaaatgcctaatttatgaggcaatgagattttaattatcagaagaaaaataaagactaaaagaacatacaattacagtccctcatcataataacaaatacaaaaaagcagaggatctacttctccatactcatgtgcttttactgtaaatggaaataaccaaaagctttgttaagtttttatagcagaaatgaatggaggaaaggctattttgttagacaggaagtgctaggcttctatcctgtgttgtttggaggagataattgactgaagggaagagcaggaataaggaaaatg

SEQ ID NO: 112982 - DNA, 1041 bp, Homo sapiens
gacggggtcttgctctgtgggctagtctggagtgcagtggtgcgattttggctcactgccacctctgcctcccaggttcaagcgattctcctgcctcagcttctggagtagctgggattaacagacgtgggccaccagacacggctaatttttgtatttttggtaaagacagggtttcaccaggtggccaggctgatctggaactcctgacctcaagtgatccacccacctcagcctcccaaagtgctggtgtagaagcaaacagtcccaaatgtctcaataggctctgaggcccgttgctatactttttaagtacttacgtctgctttttagtttttctgacagactgttttcctcgcagactgttctgcatcatgtttttgaaatctggcagcaacagttgttttattgttgttgctgtcaccatactctttccaccagctttaatttggggcttcttgtttgttatagctttgataaccctggatctatgcttaatgtaactgtgtgtcattacaacctggtagttctgactgagagctaaatgtctttcctactagttaagtgcataagcttgagtgcgtggacttcatgacatttggttttctcagaactcagaaattctttttttttttttttttttttgagacggagtctcgctctgtcacccaggctggagtgcagtggcgcaatctcggctcactgcaagctccgcctcccgggttcacgccattcttctgcctcagcctcccgagtagagtagctgggactacaggcgcccgtcaccacgccgggctaattttttttgtatttttagtagagacggggtttcaccgtgttagccaggatggtctcgatctcctgacctcgtgatccgcccgcctcggcctcccaaagtgctgggattacaggtgtgagccaccgtgcccggcctcagaattctttttgcttcgtcctggtttttagctattttccagataattgcaggatccctgagttatgtttaaatgtggtcttctggtacattctgtcaccttgtac

SEQ ID NO: 112983 - DNA, 1050 bp, Homo sapiens
gtctcaaaaaaaataaaaaaaataaaaaaatacaaaaattagccaggtgtggtggcacatgcctgtaatcccagctactcgggagagtgaagcaggagaattgcttgaacccgggaggcagaggttgcagtgagctgagattgcgccactgcactcgcctgggtgacagagcgagactccgtctcaagggggaaaaaaaaaaaaagaaagaaaatgaattttcaggattggtgcctttaattttgagtcttgtatgtattaattactttctgaacaatctattgtttctcacatttttctgaaaaaagtgttcagtttgggaaaaaacaacagcctaatcgcttcagtgatcaaaattaaattttaatatggcttatgaactggatttgctaatttttaattactgttaatcagtctcaattataatgtgcttagtaggtgatataaaagattaattttttcctttttgtcttctttcccataatagactctttgaattcagaaagatgattggaaatcgggaaagatgccagaatctggtttcaagcgattatccagtacacattgataaggtattcaaatgagagaaacacagttataggaattgtggtttgacataaatatgtctaagaatagattacatattggagtataacaacaataaacactaaaatatgagtgccgtatggatttttcatttcatatttaaagaatactatttgtgggccaggtgtggtggctcacgcctgtaatcccagcactttgggaggcggaggcgggtggatcacctgaggttgggagttcagaccagcctgaccaacatggagaaaccccgtctctgcttaaaaaaaatacaaaattagccgggcatggtggcacatgcctgtaatcccagctactcgggaggctgaggcaggagaatcacttgaaccccggaggcggaggttgcagtgagccaagatcacgcctttgcattccagcctaggcaacaagagtgaaactccgtctcaaaaataaataaataaataaataatactatttgtgcgttaa

SEQ ID NO: 112984 - DNA, 1039 bp, Homo sapiens
ctgaggcatgagaatcacttgaaccgggaggcagaggttgcagtgagcagagatcatgccactgcagtccagcctgggcgacagagcgagaccctgtctcaaaagaaaaaaaaaagttacatggattcaaacacccattctggggagggtaactgcctatttcatagctatttagagaggatgtcaagttgcaagccacagataaatttggaaataacttacagtaaaggcattgtttgtcccccctttttgttagttacttagagtttttctttcatatttaattttagacaagccatctatgatgcatttgaccgcttcctccataaatacgctaactagttggattattatatgtaaccagtgtggccatgatgtttcttacaaaagggagcttcatcctgtgatcatgtgaaggacaagcagacagcactaatatatctaatcgctatcaatttggtctggaattcattgttacacatcagttaactataaacttcgaatacatttgaataatttcaagataatatttgaagtaaataatgttaaagtgtttttactattgtttattggaatcccatatattcagtgtttagtctgttgttactgtttatgaaaaactaaatttttaatcatgaataatttattaaattaaataaatttattcatagaaacttttctgggttttagtaaaattgctaaatcaaaccaagattttaatatatcagcatttactttgtacccttataacatttcactcttgacttgatttgagaaacatgtttattttttgaatgttcttgtgttcaactaattttctgctgtggaaataaatacttatgatatataaaatcagtgttaactttgaattctaaaatatcctgatagcttcatagataagtgcttttctttttcttttttttttcttttaacatgtacctctacttgaatgtaagtgcttttaataatcaaagtgagtggcagggtgcggtggctcacgcctgtaatcccagcactgggatgctgaagcgggcagatt

SEQ ID NO: 112985 - DNA, 1060 bp, Homo sapiens
gaagacctgttgcattaactgacggagtgcagtggcatgatcttggctcactgcgacctccgcctctcaggttcaagcggttctcctgcctccacctgagtagctgagattacaggtgcccgccaccatgcctggctaatttttgtatttttaatagacacgaggtttcaccatgttggccaagctggtctcgaattcctgacctcaagtgatatgcctgccttggcctcccaaagtgctgggattataggtttgagccaccacacccgacctgacattttatttttatttttttaattacatttttctatatgcttattctttggattgctaaccatctaactacccaaatacttaacagccttggcttttaatttcaaaatttaatagacacatatgcaattgatttgtcccatataaactttattttacagaaaatatttaaagttttatgtaatagctattaactctcttaaatggggtttatatggctcgatttggtgctttctttttatgttaaacttctctagctgtcagctaaaatgttaaaaaagtcgaaaatattttagggtattgtgtgaagttttacagtaggtatttttgagttttgtttgaaatctgtgttgtctgtgaattatttttaaatagggattcttagtctactaacgatatttgaattataatgtgcctttgcagtctttttaaaggagatttcatttgtcacctctatgcctctatcatcttaattttttacaaatatttaaaaattattaatgtgaagttattgatggtagacaaagtagtaacttctttcaaactactttggcataacaagccaacactgtacagctctttgagctataagcaattttacatgttcagatgagaacctttagttttaaccaaaagtataacatctactaaagttcttccacaaaatactttttaaaataaaacttgtcaactgaattacgattttcttatattatgtatatagtgaggttatatgattgaatgctttttgaacaatggttttagtaaaacaaatactttattattg

SEQ ID NO: 112986 - DNA, 1223 bp, Homo sapiens
ggtctgtggttgctctgcgttgggcactggcagggtgcgggcaggggcgacttgcgggacttgccggcgcgtggcggcggtagcgggcaccaggcccgggtaacggcaggcctcccctccctgtcagtcggaggtaatttgttccaaggtgtcattcactctgcctatttacagacatgggcatctgggaagggagcggcaggaagaggtgggacctcaggttctccttgcctgatgggggcacggaggtggtagcttggcggcgcatccctgctggcgcggttgcgattgtgttttgtccccagtgttagtgacttgggaaagtagctaactttagatactgcagtgcttcgtatgggaaagttttggtagacttttttttttttttttttacataaaaggattgaagcaagtcagagcaaggggatttattcgtaagtggaagcgcgattgtagtcttttgtgaaataagatgaaaaaaggttttcaaaacactgctgagcagtcatattaaaaatgagactttaaatgtggtttttaaagtgctttatggggggaggggggagggatagcattaggagatatacctaatgttaaatgacgagttgatgggtgcagcacaccaacatggctgcacatgtatacatgtgtaacctgcacgttgtgcacatgtaccctaaaactttaagtataattaaaaaaaataaagtgctttaagttataagtgtgctggaaaataattgaaataggatagttgacatgcgagcgtggattgcacgttaggtaaatggttttctaacattgtcagctctccttccctttagaggagataagattatgccactatatttgaatgctgaccaatgctgtatggccgtcggtgctttattttgattgtagtaactgcaacttaagaaagtaaaaatgggccggcgcggtggctcacgcctgtaatcccagcactttgggaggccgaggcgggcggatcacctgaggtgaggagttcgagaccaggctggccaatatggcgaaaccccgtctctactagaaatacgatcattagccaggcgtggtggcgggcgcctgtaatctcacctacttgagaggctgaggcagggagaatcgcttgaacccgggaggtggaggttgcagtgagccgagatcgcgccactgcactccagcctggtcggcagagtgagacccactctcaaaaaaaaaaaaaa

SEQ ID NO: 112987 - DNA, 1016 bp, Homo sapiens
gggttcttagaattatgctgattcacattaggtcataggaataaatatgtaaatcacctctttccatgaattcccaaatttctgaccttaataatttcctagtgataagaaagcctagtttctttaagtcaatggagagtagtatgtcaccaaaaatttgaagtggaaatagagataagaagcatagactgtgcttatatgtatctatgagtagagaaaagtagtgaaactgtatatcattttaatctcaaatttgaagaccttaaaattttaacaacataactctttatgatttctgagggatttgtatggtaaaatattctaacataattggtcttcttcatcaaagagattaaaatttctattttttttcctatctggaggttgaattttctaataggggttgaactgagcagaagtctacctttatgcaccagaaaacattgattatgggaatggtaagattacttctgaaacataggttttgcagttttatggatattgttagtattttactattaactcttaaatgaaaggatttcattcatcagaattgaaaggtcaggtacctgacaatgttgggtttttttctttttttaaattttaataatcttcacaagggcactgtaatgtagtgtttttctttcttttcttttttttttccccttgactcttagcaccactcaatgaaaattttaaaaagtgccacacataaaatatataatccttttttcaggaaacctttttaattacccagaactgtgatcctcccaaggtacaaaaaaaaaatcataccagagatgaaatgtatatggtgatttatctttggagagttcagttgatattttttttgttgttgttgagacggagcctcactctgtcgctcaggctggagtacagtggcgcagtctcggctcactgcaacttccgcctcctggattcaagcaattctcttgcctcagcctcccgagtagctgagattacaggtgtgtgccaccacgcttggcttatttttg

SEQ ID NO: 112988 - DNA, 1191 bp, Homo sapiens
tctagcgcaatggcgcgatcttggctcactgcaacctccctgcctcccaggttcaaacgattctcctgcctcagcctcccgagtagctgggaatacagcaatccacaaccagataattggttctgtttataattatgaaatcataggcaaatactttcatatctctaggcctttgttttaatcagtaaaatgaatcagtgcaatgtaatggatgattaagactattccaactctaaaagagtctttaatgtaatcctttctttattcaactttgtgtttttctttagtcttaaatttactgggccaaaataatactcacttgattttcttttacagtttggctgttaaactagcaattgagcataaaagcttgatattacttacttgtaacactgttttatgacatttaatttaaaaatgatagaaagttttttatataaattaccaatttcttccttcaggaatcagtgtctgtccctgaagggtcattaaatcagctatgttcttcagaagaaccagaacaagaagaacttgattttttgtttgatgaagagattgaacaaataggacgaaaaaacacatttactgattggtctgataatgattcagattatgaaattgatgaccaagacttaaacaagattttgattgtaactcagacaccaccttatgtgaaaaaacatcctggaggagatcgaacaggcacccacatgtctcgggcaaaaatcacatctgaacttgctaaagttatcaatgatggcttatactattatgaacaggatctatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctgaggaatcgttttattttatgaaagtaacagcgtgatgaatactgtaattacaaaagaaaattagtactcactgacttatacccttgtttttttttttttttgttttgtttttttttgtttttgttttaggtgacaatactgagaacgccctttctcgtatgaaagaataaaaacaagttactgtggacaggcttaatttatat

SEQ ID NO: 112989 - DNA, 1057 bp, Homo sapiens
attttgcttattatgttttcccagaatcaccatgatcgattacttctgctcatcataaacatctagttcctaagcaggatatgagaatctgccttcctgtgacctctcctgggctcagtgacactccagtcgccgccccaccccacatcaatgccacttccaagtttgacttgcatcttacaaaccatatttctgtttactttttttctgccctgggacatttttaataacttttagataacaacttcaacaaaaatttacctcccaccaagagaagttgtctttattgtgagaagttgtctttattcccaagaaggggaataacttactctttaagtcagttttattacaggtaaatttgtaccagctttttcctctacttgtgttaagacctgtctccaatagacattccaattgaggattgtggaaatagcaaattacattggtgtctgcccaccactgaaggcaaaaagctggtttatctaggccacaggcagagcccgcaggggaggcaggtaacttctcggaccaccagattatcttgatcttcagccagctttattgttgttctacattttaataaacactacatgtttattttattttattttatatgtgttatgttatgttatgttattttttttgaggcagagtctccctgtttctcccaggctggagcacagtggtgagatctcggctcactgcaacctccgcctcccaggttcaaacgactctcgtgcctcagcctcgcgagtagctgggactacagacatgcaccaccatgtccgcctaacttttctatttttgtagagatggggttttgccaggttgcccaggatgatcttgaactcctgacctcaattgatcctctctcctcagcctcccagagtgctgggattacaggcgtgagcactgcgcgcctggcctgttttattattttgaagattacagtataggtttctaggaagcctggatggaggttctcatattctaggtaatatttagctatttaataaaaatttattttcaaaaccttaaagtttgtggattacataca

SEQ ID NO: 112990 - DNA, 2174 bp, Homo sapiens
tatctttcccctttcttatgccctcataacatcagtttttaccacttgtgtgatgctgtcccagctgtttatctgacccctgggtcccttggaacagctgttctggtttagctgggtactgagatgggtcctggacttactcatttttaaaaaagatctccaagtgattctgatgcagtatccaactaagaatcactggtacagaacaccctcttgcaaagaattcccaagccttataagttccctaatcctgttttcttttgttcaggctttacatgtgtataaagaccagccatggtgaagcaattttagaatatttagataatattctaataatcatattttatatgattctaaaacagacaaatgccttttctctgtataatggaatagtgaaacaaatttgatcaccactgattttcttttgatgtatctttcagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggc

SEQ ID NO: 112991 - DNA, 1028 bp, Homo sapiens
attatttttatttttttgatgccactattaacagcaaccagtaaacattatttcccctcaagcagactggcttctaaacctaaccacttaagtttcttcttctccctcattacctcacagtcttcattttgaatattaagtttggggatatctgaagtaattgaaattgagggttttaagatctaagtgaaaagctttacttgggtcaaaaggcagatttccaacaaatttcttttcttattccatctagtatctgtacatgttttgaaattaagggtatatacaaatgtgaattatgaggggtttttttctttgttgtgtttttttttttttttttttactttttcctttgagacattctaaaatattgttaggtgatctaaataatttattttcttttttccagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaaggtatttttattttgttggattctttggaaaattaaatatttgttcaaagaaaatatatactattttacatgctttaagagcctaaggatgtcatccgttttcattgccatcattatttgataatatttttaaagatagctaaagctgggtgaagtggcacatgcctgtggtcctagctgctgatgggaatcccttgagctcaggagttcaaggactaacctgggcaacatagtgagacttgtccaaaaaaagaaattgcaaaaaatagctaaataaaaatatgattgttacatgtgataattattttgaaaatcaatatttaaaaaaatgacttgttacaaattctaagcctcaaaaattgtgatacttacagtcagcttcttcattaaggtttagttttttaaaaatacaggcttatatttaaaactgagttgattactgatttcaatactataatttattccaa

SEQ ID NO: 112992 - DNA, 1071 bp, Homo sapiens
gagtcggcttgtagtttctctttacttttattaatctttttcttccttttggttgtagttgagatctttttgtctttggggttttgctattttactaggatttgtccaggtatggatttgattttatttaccatgtaccaaactctactcaagtctgtggatatattgtccttttttttttttttttttttttcccagaaaatttgctgttacttattgcctcttccattatctctgttccttcctctggaactgttaatagatatacattaggttttcattctattcttaatgtctcttaatctttccttttgtaccatttcttaataattttaagcaaatttactttagttctttaatctgcttctgtatctgttatatgtgcccactcctccatgatggtttgtttcttcatgtagtttatattttttattgtgaacttattatcttcagtagttactttttttaattttggagtatttcctgtaaaattccatgagccctaagttgtgaaagaggtaaagtgctttgggtatgttgcaaaatagggcctcacgtaagttaaaacaatgattttttaaattaagtaatacatgctcaaaatagaaaattcaaaaggatatacagtgaaaaataagtctacttcccacaactagtcccagccaccatgttcccttccatagcagcaaagcaccagtctacgtattgttctagagctattttgggtgcaagtacaagcatgtggatatcttcctttccccccacactaattatagtatactatgcatacccttcacaatattttaatatcacaagagcctttgacatcagtatagagagccatcttattcttttgaatacatgcataatattctattttatgaataagtcataatttaacagtccactgttaacatttgttttcagtctcctgttattgcatgatgctgcaataaatatgtacatgtcattttacacatgtgtgtaaaattatgattataaagtaaattcctggaaataaaattaccgaggcttggggtatggatatttttaatttggattcttgtttct

SEQ ID NO: 112993 - DNA, 1025 bp, Homo sapiens
tcaggagttcgaaaccagcctggccaatataacaaaacctcgtctctactaaaaatacaagaaaatcagctagacgtggtggcgggtgcctgtaatcccagctactcgggaggcggaggcagggagagttgctggaacccgggaggtgggggttgcagtgagccgagattgcgccattgcactccagcctgggcgacagagagagactcggtataaaaaaaaattaaaaattaagagtcataggtggtagattgcttttttatggtatgtgcactgagggaggctcttgagattacaatggagaagtcagttttagattagtttctgccagttcctaggttctgttgaacagcctaagagtgatatacagttagtattctacagttgatcaacaacataacagatatttgaatattttattattgaaaggaaccttaaagaaagccagatcattttatgggcttagaatatgttgatattgcatattaatagaaaatgtaataagtagtacttttcaaaaaatcttaaagccaaatttctggctataaaacagatacaagttcagttttgcttttaatttttattttcatcctcataaattaagcagttttgtagcagaataattcagaagcagtaattgttagtttctatgcctagccaatatctaccctaatttcacaataatggttttaggattaaattttgtgagatttttccataatgctaaacatgtgtttatttttagtcatacatttttaaagttcaggctcttaattaaatattgacagtgtaatttggtggagtatacacattttggcaaacagttggcattaactgtatttgccaatattaaatttagtaacagatcaggcacttggccagcaggtgaggaaagtttggtcatgtaaaaaactgaatacaggaggagaaagaaaaccagattcgttaagcacccacaatatcagatccattaatttttttatctccataattcctcagtgaagttggtaagtattcctgctcta

SEQ ID NO: 112994 - DNA, 1412 bp, Homo sapiens
tgtattactccgtaaggccacgtttaggggcatgtaaagtcccaaccctccagtctctgaagtccagacgtataagcaacacctcggactctctttaaaccagttttagttcggagttgctttccatgattaacaaggtatgtgggatgagaacagaccagaatgcagagcttattaaagactggtaaggatattcaccttgagttttgggggtggagctcctatacccagcaggcgtgtctctggtttcttttttctttttttttctcttttcaagtacacgttgataatgacttgtgttttcacttagcagaactaaggagaaaaaacttagaagagttgtagatttatacccccatgtgccagttatgcaagttaaagatttttagaactttgttttgagagaactttgttttcagggaactttgtgtagggtagttgatttagacgccctttttttacagtgtggttgtagcatacattttggattatgttaataaaccccagactcatggaacctgttggtatatcatacagttgagcaacattgtgcatcctggttgtgcactgattaatactaagctttaaaaaaaagtggtgactacaataagaataaataattaaattagagacctaaagtgacctgttattggagagagtacctccaagccttaaagtcatagggttggcagtctggaagtaagctggttttctccttaatttaatctgtaggtgtataagatttattgacacttaaaaatatatacttctgatttcagtgcttgatagctggaagatattttagaagtgctttggtttgtagtttgttcattggaatagggataagaaataggagatttttggtgttgaattatgtaatttatttcttagttgtttgtacttctgtgtatatatacacatttaatccaaccaagtaaatacatagcttacagagtttttgcttctggttacataaatgtgaacacaaggtgtctgcctacttatatcaactgaaatggttaatacatttttgtttacttaagcacacgtgggacaagagaacagggccaaagtacagtatttaaacaggccaagcgaagtaaattttttttaaatcaaggatttagacagcattttatacctagttcaagcttttcccccattggtattaaaatgtgttaagtgattagaaatcctgtacaggtttaaatttttaatatagaccttacccagctaaaagatcagcttttgtaccctgtctgaactgccactgaagaaaacaaagtattagtacaaagaatcgtattagtcctcacacattatgccttggcagtatctgaaaatagctaagagagacagtcatagaaacagtttggcagcctccagtggcaaacgtttgttctgtgatagaa

SEQ ID NO: 112995 - DNA, 1032 bp, Homo sapiens
aacaatggttgacctgtcttaggtaccaaagtccctttaatttgtgatgatagataaaacttttcttaaagtgttcctttgagaatgtatcttgaaagtattaataattacctggaaggtaactgtggctgtagcaagtgctgggacttggagttgtatgttatcgttccagtatcagttctgacacttacttagctgtaagatttaggaaagtcacctaatctcatagacctcatttgtgaaatatgataataatacataacacacagggttgttatggggattacatgagattattacaatgaaagtgttactctaagagctataaaattggaaggtattacaactaaaggagcaggtaactgtggggttgcccacttaaccattatcagacaggtatttggagtcaaacgccctagagcacagtaaggattaaacattaaactgcagatattcgtcattgagattagcgttattaccatggtttaatatttaattctcactgttctctaggggaccagatggactctgtggagaatgtagacttagacattcctgactacttgcatcccaaactaaagtccatacaagataaaaacacctcatagacagaagagtcactccatgaggcattctaagaatgcactttctgcatggtgactagtttttaagtggccaagtggataggctctcagcaatcttgctcctctgggaagaataaaaacattacactgaaggtcttgtttgtgagttgtgcttttggacctaagtttttctgctataaggggtatattattaacaaaacaaacccaaccaaaaagttggaattcctggaaattcaccaaaattgcctggctgctgcagcccaacaattctttagctcttttcaatcatctttattttggatttacttggaatccttgatctttaacccaattttgagcattacactgtccctatttaacgcaaaaggaatattttggaattttaaaagagccacaaaatatcaaacccaagatcctagttttgggt

SEQ ID NO: 112996 - DNA, 1045 bp, Homo sapiens
tggaaagtccgggaggggcaccaagccagagacctggagcagctcgcagcccagccttatgctggagtaacctgagccctcagagagtccaggaggtgaggctacagtccagcattctatttttaattcacagtgtggagataagagttaaatataaagcagattaagacttcccttaaatctcctctataaaagaaaaactggaattaatctacaggagcactccatggatagctcaataccatcattttttaagaataaaattagaagcagaaaactgtgtccttatccttttgacatccaagaattattgccatgaaagtactacagcccatgaaattactttccaggttacactcattagatttagcattttcattctgtagacctgtggttttaacggaaaagaaaagaaaaaaaaatcccctcccttcatagtacaactgttcccatacactggcccattaatgggatgctaatgaatgcggaagtcattgtaaaatcacaaacgcagaactgagaagcagatttcaaacatcgataggcctagccttgttttggaaatttggatcatgagagcatgggactcaggtagagccctgcagcctgtgttttctgcacactgtagctaaagaggccctcaattacaggctcgatttttaaaaaatttttagtcatattatacaatcaccattatgggttagacattaaacagatgccaacctagctactacaggctttgtcactggaagtgttaaccacataacacggcagcagcagagcaaagagattaagagttcaggctctagagcagttggccagggtatgaacccaagccctaccaattactcactgtgtgaccttgggcaagttgcttaatctctctgtgccggtgtttccacttttgaaaagcggagataataatagtccgtgcctccagttaggattaattgagaaaatgtatgcaaagcactaaatcagttcctggcaccatagtgtgtgctcaacagcagttggtggttgttagtattttgttgttggagac

SEQ ID NO: 112997 - DNA, 1057 bp, Homo sapiens
agctatcagaatctggaagaggcaagaaacagattctccactagagccttcagagggagaagagccctgctaacactttgatgtcagcccagtgacacatcaaacctctggcttctagaccagtgagagaataaatttttgttgttttaagaaccaagtttgtgatatttgttacggaagccataggaaactaattcagatgtagcagtgagggatttgatgactggagtggcagcagctatcttgaaaccatgaggacacaaacctgaggataaaattaaatacaatatcctggagaagacagagtggaaaaatggaaagacctgttgaattagccacatatcactcaaccttttgacttcttatcatgtaagataataaatgtctttattgtttatggctcttctggttggatattctgttacctgcagccacaagcattctaattgatacagccctatccaaaagggtaggagagtcctggctgggaagcagcagtgggtactaaggaagaaatctgacccacttgccaactctgacaagagtgcataaaatgaaaaatgagcagctcccacttgagagaggagcagaacaggtaacttggagagagtcagaagattaagaaaatggttagggaaaagattgtagggataggggcatttgttaattatgcaacaggccttttcaaaggcagtaaaagcttaggaagaggaagataattgggaggtattctgagaaaaggtgtatgtgaatcatgacactgtactgttatgatgaaattatatagagtataggtggagtggggaataaggagagactcgcactttggacaatgaccaaaaaaaaaaaaaaaaaagggaaaatagatacaatgcttgttagatttaaccagccccagggttgccaagaaaacatttctaccaatgccaggaccaaagtagtttttgaactttaatgtttataaggttcatggagtttgttaaaaatcttaaacattcctaggccccaggaccaagatcctgactcagtagatctcagtagggtccagaaatctgca

SEQ ID NO: 112998 - DNA, 1580 bp, Homo sapiens
gtgcagctttagctctcactcaaactcaccttccttaggacagctttccctaactccccatgtgatttcagggtcctctgttatattgtcatggctttatccttgccttcacagcacctatcttagttcgtgattatataattgttgtgtgattgtttgactgtgtctgattgcttaccattggatccccagcatccagcatagttcctgacataccataaatatttttcaataaatgaatgaatggatggacattgtgagaggaagaggaggtggtgcagattaaaattgctgcaaagaatcttcagtggacaatcctcatgacccaaagaaaaatgactgcactactggagttaggggtgccaccaatgagtcagctgagcaacctatttccagggccacttggccagcattggtgccaatgagtgcaaggactgttaatactgactcacaggccaaagacaagctccttgtcctcaaactataagcatcatctcattattcacgttctatcaggttaccattagtcagatttcaactgtcaaaacaatatcctcctccagcagagctatgagcctgataatttattctgatatactttggctgctaccaattttttgtaacttaaaaaatactgggatactatatttgaaagtaaagcacattatttcaacacctgatttactcaatttaacatatggcttatatcttaaatgtgtttttaaaagattatatattctcaaattgatagaattataatttcccccatttaaggtttacataattaaatataggcatgtaatttttgtggaaacagatacaatatgatctagaacactgtaaaatattcctgctcagaaaaaaatagataaaattcaaaaaggtccttccaaatataacacttccattttttcagtaacaactttgagaattcctttctaatatcaacagtttttaaggactttccatttatagtaattgtactttcagtattcagttaaatgagaaaacacataagataaaagcttctataaacccaataatgttctgaaacttatagccattaatcagcatgtacttacatattcttaaaaataagagtacaaatatatttgcaatataaacaatgtttgtagtggaaacacacatttgcttcactatcccaacttccccaccatgctctccggtttgtttctgttatatatttggtggttcggtaactcagaaactgatccaaaatttagagtagaaaatggacttactgaagggggacggtcttaggcaaaatgcaaacatatatacatatatgtgtttgctgggtgtatttattatatatatgtcgcatattacatgtactcttgacaagagaatcatagaacttggagatattccaaagtttatctgggctatttcccataatgcaatagagtagtatctagatcattcataacagaaatagctgaatgatttgggtgcattcagcaatgaaagaatgttattattttatagtggctttaacataggagaaaaagtgttttcccaataattatgattattgccattaaaacctccaaggtttt

SEQ ID NO: 112999 - DNA, 1023 bp, Homo sapiens
ggtactaagtcttccctgacattttgtcagtaaaggtcaaagtcactggaaatggtcactgcacctaacctaagtgtcagtttcctgatctatagagtagaggatttgatgaatttatctctagaattctgtctacttctagtcagattcttcactgacatgaagtcaccactgtgtatctaccttactaaccttttttggttaacatgtgggaaatttaataaattcctgacatttttcaacaacatttataacctttggggatcagttcattttcaccaattcaattttagtcatcttgattgcttttgtcagaggggaaaaataatgtcacataattaaaataataaataacctcccaaataatgtatgtttattaatcttatgacagaacctccagctatattttgttagaactaaatttaaaacagcacataacttgcagctcttgcaagttctcacaatttaaaaattgaagatgtgttacaagcagagttcatgaattatagagctcaatgattatatttgataaagtatcctctgatctacaattacagactgatgagaacatgctgttgattcaaaaagattggaaaatcgcatgtatcacttgcagactgctgggaccagcgtaccgcaggctgctcaggtatagagacgcatcttctaggagtgccaattgccctactctctgggactgaactaactaatacccaacctctgaggtccttaacacctcatgtattcaatctgtggtattcttaacacctcacctctgagacagtcaacattgtgtcaggtgttgaagcctaagcctctgaagccaatgttatgctaagctgtacaggagctgaaactacaacctctggctcaagaacatcccaagcagtggcctgtgcagaaactcctgcaggaacaccccttcatcaggtctagtgagccaagtccttgcagcagtagggccagtaatcactcccattcccattgactttttttttttttaaatcagttaatgcttaaata

SEQ ID NO: 113000 - DNA, 2336 bp, Homo sapiens
gattagtgacaacaacaacaaaagcaacttatttttgagcctgtgaaaggccctcttctagacactttatacaacagctgtatccttattgatagccctgcaaggtaagtatcatttttcccattgtggagaagtactgaatctcgggagggtactgggccaaggtcaccagccaatcagtgacagataggaaattcaaacctaggtttgttgggttctttctactataccaggcaacaccatttgtaaatgtgaactcattctgagcatcaaaggacaattggctttactttgaagaaactcaattccatattggtttcagttattttaacaaattcaacatgcttaattatctcagaatttttacagaatagtaattgttaattccctggtagaattaggcttgcctgcaactatttttaattccttaacatcttctaggtattccacttgacccgatgcttttccttgatgtggtctggagaatgtgatctatagaaacaatgtataagaatatcctggccggtggctcacacctgtaatcccagaactttgggaggccgaggcgggtagatcacgaggtcaagatatcgagaccatcctggccaacattgtgaaaccctgtctctatcaaaaatacaaaaattagctggccatggtggcgcatgcctgtagtcccagcttctcgggaggctgaggcaggagaatcgcttgaacccaggaggcagaggttgcagtgagccgagatcgcaccagcctgggggacagggcaagactctgtctcaaaaaaaaaaaaaatatcctgactttctttataggcacataaataaataaggaaagaatcttttccccaaccctgaggagataggcagtaccactatatagcaggcttgcatgcatgcaaactttgaaagcaatcattgaacaaagcttgggcaaggttatggtgaataagaaagagaacaaagttcatgaagaggtgcgaagaaaacaggaagtaagtgttggtaaattttgcatgtacaatagtatttctgtcatagtgaatgtcttctcaatagattattctcactttcctcctatatatccatttattttgttggacaccaacacccaataaagataatgggaacaaataagaactatagctcttaatatagattctagaaagtgaaaactgctttttatagctctaaaaccaaagcttttggcttcaatatagattgaagatatctctctaccatttactacctgggtttttttattcgcttgtataaccatgttctatttctgttttgtttgaaaagaaaatgaaatagaattacctcctacactcacactgctattgacattaaatttcatcttcttttattatgatcagcaaagttactcataacactggaatttgttttttggttttaaagttatagctgctgctgttgttggaacaattagtattgctttggcactgtgttccacctaaactcatggcatttgtgtactatttacctttcagaaaagctattttccaagaagaaaaagaaaatggaagtacaaatttccaacagcacacattttctctgctctctccttggctctgaaagaggatgcgtgaaacagaatttcaggctgtaattaatgcagctcttcataagataagaggttcttttatctacagaaaaattgctgcactaattcccaacaagaagtgcaatgctccggttaatgctctttctacaagaagaattcaccttttctaccctctacatatttacagacaaatttgaatattttgttatgggaaactgaagatgggtaaacatacaatgataatagtactttatagggctaaatctaaaagccttaaagattaatattatgtttggataaatgctgaataagtttacataaagaattttcaaataacattgacgctacaggcatgtacttgtaagcacagaccttaattgggcacaacttagatccagcactctttgagggggagaataaacaaattgggaaatgcatcctcatttgatacagtgaggaaaaagagctatggttccttgctctgctttaaagtactgtccaaagaaggatgaagccccgctatttcattttgatttaaatatttccttgtagaatgcacattccaatttggaaacaatactttctatatgtatgtttcatgtatgtgcttggaataattggtaatgtgttggcactgtgttccacttaaatgcatggcatttgtatactatttaatgttttgttgttgttgttgtttttgagatggagtctcagtctgttgcccaggctggagtgcaatggtgtga

SEQ ID NO: 113001 - DNA, 2000 bp, Homo sapiens
aaaacattaggagggggtagctttggctttcaaaagactgcaaaacactttcctagtatcttcgtctgggaaaataatggtcttacttcatttctttaggcttctccctgagtctgaatcttatttgagaggtcctggtgactccttgtttccacagcctgcacaggcaacatctgttctggcctaaggatgagaacctcacctccccacccaacacagctcagcctcaggggtgaggggaaggaagcacacatgcagttgctctcatcctgaaaaactcctagtgaggaagaagctttcacactcatggttcacagagagatttcagccagaactagcagtctcactagttgtcagagcctcttgttgattcccaccttcagcaaaaatccttcagggcagcaagcgcagcaggaaacctgtcattaacaaccaccatggtgtcacatcagcgattctcaggagccctcactccactatttaactcagctatttacctcatcagggagagctttgtttgattgtcagaaaatagaacatgtacatttgtctgtcataaacacacacaagctctccagagcataaataaacaaaacgatcatgtacgttggtaaatgtgtttgcattatttaaccaaaccagatgaagcatgtgaataaccctgcatataaagtaccatcaagtaacttgcttgtaatctgtcttgtacaatacagccattgccactcattccactcacccgattcagaccctggaaatgtactatttttagttgggctttgtacaccactatttacaaagagcactgttaaatcctttgaatagcagccaagaagttgggtgagaacctagaagcctgccacacagatcagcatcctaatcaactctgggacagccagtgctaaagatctgcctttctttccttttcttcttcccctttgtctccccgggaatatcaatgtaaaagaggaaaggagacaaagagttgggccttatctgttcttgtcgttcaaatgggttgctttactcactctcctagataacagcccatttgtcaacatctttggcggtttaagccgttctttgtcaaaaccacttttggaaaagatttgaccatttatttacatgggagccaacgtgacggcagcaggtgcgtcatggaaaactcggacgtgggtgctgcaaagccgctgggattcggtcacgtgacagcccgcctgctgcccggccagcgggccaaatggccacacgggaaggagggacagaggagaaaatagtaggcaaagtgttggcgtgaggcaggtggtggatgaggcagtcgcaaagagaaaggattgcaacatcagggaggagatgaaaggcctcatatcattttgcagccaacaagaaacctgaaggaactaagtttggctctatttctacagcttgtgaaaagctgagaatggaagcaatgactgggctaattctggacaaaattttttaaaatgatttttgtcagaggagcccagatctttgcctcaattctttgcttttgtctaaattgctcatttttccaaatttctgtaagtaattttttaggtgatgtgaattgatttgcctttggtataccggacaagattttattttattttattattttatttttgagacggagtttcgctcttgttgcccagactggagtgcagtggtgtgatctcaactcactacaacctctgcctcccgggttcaagcgattctcctgcctcagcctcctgagtagccgggattacaggtgcccgccaccacaccgagctaatttttgtatttttagtagagatggggtttcaccacgttggccaggctggtctcaaactcctgacctcaggtgatccatctgcctcagcctcccaaagtgctgggattacaggtgttagccaccgtgcccagcctggacaagattatttgagacatctctggtggcctaaatcgtgaagggtttgccccctgtttccttttgtcca

SEQ ID NO: 113002 - DNA, 1020 bp, Homo sapiens
ggttgaacttatcaaaaggccacaagtgaacaataaagtcttccttatagagtacagataaatttgagattttcgataatcttgttaaattctctgtagttccttattcttaataccatgcctgagtttcaaaactgctcactgctttcataattgctgctttttgttgcttcttccaaatctgatctccagtaaaacactaggatggcatctctttcttttctctgctcccacttctaccttcctgaattcccttctcaactcccttctcctcatcacctcccaagcctctatacctaacagtagggccaaggacataaacaaggaaaagaaaatgcaaataagagttagatatttaataacagaagaggaagaagcatagtacacacttcaccccttttttctacctaaacaaatctcaagactgccgtttgctaggactgccataacaaagtaccgtagactgggtggcttcatcaacagagaaatattttctccacattctggaggctagaagttagagaccaaggtgtcagcagggttggtttcttctgaagcttctctgctttgcttggagatggctgctttctccctgagtcttcacctgctcttctctctgtagctgcatccgtccaaatctcctgttctcatgagcacatcggtcacaatgggttagaacctattctaataagcccattgtaacttaattatctccttaaacatcctgtttacaaatatagtcactttctgaagtactgggggtgagttgggactttaacatgtgaattttggggagacacaattcagcccataacagccgctttcacatacctttaccaaatagcatttctttgccatccatcctaccctgatgttgattttccctagccttggtgatctctgccattattttagtggctgattaaatttaattggcacttatgcgtactgtcttgagtagtttttagatgaaagttattcctctccccaacaagatccacgagcacagggctagttttt

SEQ ID NO: 113003 - DNA, 1044 bp, Homo sapiens
atatgtcctccgtagctggtgaagccttgtcttcttgtggggtcactgggaaagggttcctaaagaaagcctttgagagtgtgaagaatatcattaatcaccactgagcctccaagagtaagagaaaagtagcacttaaaggcaaaagatgcctcgagataggcattttaattttttgccatgataacaatcgttatcacaatttaatttatatttatttgcatttgcattatttaaattgaaagaaaatatgaccttctttctgaaatagattaaattagtatcagtacagaaatgactacgtaatatttttcttttcttattttatttttggagtagagaagcaacccatctatccattctttcatctggtttttcatacacctatccatctatccatatatctatctgtctgtctgtctccccaaatcattttaagtcccccttatgagctttatgtattctgtaagaccctaaacctgtaaaaacgagcaggaccagatcaacatagtcaccattcattatatatgaatttgatctaaaacatcattcaaattaagtcagggataaggagatcatttaaagataaaacctaaagatatgccttaggaggcatctctgtacttcttcagtgtactaatgctcgctggcattattgctatcactgataaatgtcaaaggggagagtgatatttttggagttgatttttttaccctattacaaaaatagattataaacacacatatgtcacagaaagaacttaagctaatatttctatatagggacaagcattagcatatttttaaagttcacagttacatttctgttgtcagttataatcgtctcttggtttgaactcattattttaagatagctatcaaaaatctattggtataatgtaatctgcttaaatttcacaagtgtgtgaaaattttacagtcaaagagttcctaaaggaagctgtgtaattcaatattttcatataaccatcttcataaaggcacagagctgacttaaaccaacaaaggatagtccctaataac

SEQ ID NO: 113004 - DNA, 1932 bp, Homo sapiens
tgtggacttgtcttattcttcttcttctttttttttttttttttagtgttttcttttcttttctttccagctcttttttttttttttttttttttgaagtggagtttcactcttgtcacccaggctggagtgcaatggcacgatctcggctcactgcaacctccgtcttccgagttcaagagattctcctgcctcagcctctcgagtagctgtgattacaggtgcccacgaccacgcctggttaatttttgtatttttagtagagacagggtttcactgtgttggccaggctggtctcaaactccttacctcaggtgattcatccacctcagccttccaaagtgctgggattacaggcgtgagccactgcacccagatttttcttagtgtttaatgtcataaagtctagaactccctagaatgacaaatgtgctgtggcaaatgatatttcacatcagtcattttgacttattatttccaaatgaagcaggattgtcatgagaaatacatatcactgtacaatgggtataaccatagttgaatacactgcaaatctaaaatcacgtgtttttcaaccactctaacaaaggtaaaggggtagaatcattgggaaagtatcccttatgtaactcacaggtaagttgtatctctactttcaggtcctgacaacatatgcttgatcccagcttattggacagcatgaatagagctgggacctctgttgtctgaaagggagggaagacccaggaaccatgagcaggagaggtgactggtttctggaaggcccaggtgatagggacttccagagtgtgcgggtgggcatgggtgtgcttggtggtgagcagaacatgaaggtggggcacatggcagggctctgtgcttcctttcatgccttggcttcctggaaggtcttaactggcaatagccatcttcaaagagaagtggctgctgcagccctagtgcagtgagacccgagacagagccttcagtccaccagcctgaacgactgatatttaaatgtcctaattagagatttgtttctttatgaggatggtatattttgaaaacattaaactattttatttgtaatccccctcgtctcccattatcatccccagcagcttaatggaccagacaaatgctaccttttaaaaaggagttataacctgagaaaagcctctatcaggtagaaaggggcaggggaaaaaggtccttttgtctcggaaaactatgaaaattaagcagttagcatggatgttctgatctgaccttctgggacaaaatcctggaggaaagagcaatgagatgggttgaggagaaatccaaaagcggagagagtttatactccactcttctaaccaggaaatccatgattcctgtagctcattagcaggcaagctgtatctcccactgtaactgctggaggagaccaccacgcttggtggctccactggaccaagaagcctcatgagcagaataaaaatggtggcacagcacagtctccaactggagaagactaagttggcattcctaagcttccttcagcagcctgaacacccaaagtgcccaggagttcctgccagttctggggctgcagaacgtagataatgaggctggcctgagtttgccatgagagaaggaaagagacttgggcatagggctgcagggcacgccacctaggctagggaagtgactgacactcaggtgtcacaaagtcagtgcctcaggcctgaccaagctaagattgaaacaggttatctggcagtttgcccgcaaatacagctgctaccatttcctcttctacctagatgtatgaagacaaggagtctgttttccttccccttgaatctggctgacactgcaccttgttttgaccaaaagattgtggcagaagtgatgttatgttggtttgaggacatagcctggcagatt

SEQ ID NO: 113005 - DNA, 1004 bp, Homo sapiens
ctgccttccagaattattgtaaagtttacctatgccctttcttataatccccttcttcattttttcccaaatgctatggtccaaacgagtctaaaactctaaaccctgttaaagtcctgaccctaaggcaatgatattaggagatgggacctttgggaaggtgattaggtcatgagggcaaagcccacatgaatgagattaatgctcttattagaataggctcaagggacttctttttttcaccccttccaccatgtgatggctcagccagaagtcaccatctgtagaccagcaaacgggcctttaccaaacaccgagtctgctagtgccttgatcttggacttcccagcctccagaacagtgtgaaatgaatttccgttgtttataagcaacccaatttaatggtattttgttatagcagcctgagcaggctaagacaccacaagataaggagagactaatctgattggtgatatagaaaagtactgaaatagctcagctcctctgggctttctctttagggctgcctgcctacaagccaagctgccccttagctccagcttccatgtggtatcccatatggtctggtgggtcacacagtgagaagcagaatatctacctccattcagctgcctgagtgtgtgcttggcagatccaatgtggctctttctatgggtctcaagaaatcgacttcaggcaaaggagaaaggccttgatttcagccatagacctattctccctttcagcatttttcagcaagaaagcagatatttggatctcaatggactcttgtgactatttctcatttggcacctcagagatctcaacacctcagagatctcaactagtgtgaacaggatttagtatgacctcatctcttctattccttctcactagtgtatagttattgtgggcatattattagaggaggactttaaccatgaagtacccgcagtccaacctccctcattctcccaaggagaatgatgcttggaagatatcga

SEQ ID NO: 113006 - DNA, 1866 bp, Homo sapiens
tataacctgctgatagagaattctatatgaatatggtgacagttttttaatgtttggtgctgggcatggtggctcaatcccagcacattgggaggctgaggtgggaggattgctgaggccaggagtttgagactagcctggacaacataatgagaccccatctctacaacaacaacaaaaataagcggggcatgatggtgtgtgcctgtagtcccagctactcgggagggtgatgcaggaggattttttgagcccaggagtttgagactgcagtgagccatgatggcactactgcagtccagtctgggtgacagagtcagcccctgtcctaccaaaacaaacaaacaaacaaacaaacaaacaaaaagtttggtgatttggtttccacagcagctattatttcatataaaagctacagataatatattaggagtgcttttggttaaagcagaaagactagaaaccagcacacacgtggacctggggctgagaggagaagctatcagatggtaccagcagggaagcccattcccacctctgggtccaggaaagattgcagtggacacacacagaagccctgtctatttcaccaaccccagagggcatcttgaaccactacctaatagtatagctgacgttcacagcaaggactcagagccatcaagaacacgttaaatgatgttcagtatacgctgtttaatgaggctgagaagaatataattcattttattacgatttccatgaaaatggctaaagcttataaaagtttggtgcttatactgtctaagcttcagttcactggaaaactcgatgctttgtgactcctcgctttctgacgatacagattggtgaggtattaatttaggcatattcatttggcattataatgtatgctaagactacaacacaacaattatttccaaagacagaaaagaagcattgttcagcaaatggagagtagaacagtactttgttcaaattaggaaatagacgttgatgtgacttcttcatggtgtttttttttttttaaacatctgtcagcattcagtgacctcctctgcttttagtccacatttgcctagggccagatattatcattaatcattttgcccctctactcagcaactcagcaagtactggattggccttttgtcctctttgttcagcaatttcaggctttatatcagcctccatagagggtccctctttagctagcctacgtcttgaactcctaatcttcctctattcttaccattgtcctccccacatggcataagtactgtcatcccagcttatcacatctaatatttttaattcatgaaaggctagcatattggtttctgtgtagagcacaattagtggttcttcagcccttcataccaccttgtctagtacatcatccaacaggtctagtttagttgtatcccaggttacaggcatccagcaccctgctctctaattcaagggtcatagaactgagtgacagacctgtgtactataatattctcttggtgattttattaagtttcaaaatgtttctatcagttatctaacatagtctaacactctccaaataccagccctgtactatatgggatttttacattggataaaagtatttctagatgcaacatggattattttttaaaaagtactgactttggtgtaagacttaagttctaggcctgtttctgtctcatggtaactacatgatctttgaaattttcttaacctctctgagctttagtatttatctctataaggaactcactgcaagcattatattagggttaatgtcactgcaagggttaactcattgcaagcgttaattcatgtatgtaaagcacccagtttagttcctaacac

SEQ ID NO: 113007 - DNA, 2154 bp, Homo sapiens
ggaactcacgctggcccacaagcactgcgcgcagccccagttcccgcctgcgcctctccctccacacctccctgcaagctgagggagccggctccggcctcggccagcccagaaaggggctcccacagtgcagccgtgggctgaagggctcctcaagtgccgccaaagtgggagcccaggcagaggaggcgcggagagtgagtgagggctgcgagggctgccagcatgctgtcacctctcagtgttataggtgcgcaccaccacacctgactaatttttgtatttttagtagagatggggtttcaccatgttagtcaggctggtctccaactcctgaccgtgtgatctgcccaccttggcctcccaaagtgctgggattacaggcttgagccactgcacctggtcacttttatatttttaaagaaagacacagctacactttaataaattatcctggaaatcatagttttagaacatattctcaggtcatcagtgttctttcttattaacttcagaatctgatccacatcaaggttaatgacttgattaataatgcttatcagagttccctcagaagagtggcaccatggtgggaggtaccgctacaaatatatacagctctgctactgtcagtataatcactataatcactatagtctatcagtatagttcaatcaaggaatttggcacaggcaataaatgtaaggatgtccatcttatgatcaacagaaatttgactttcattgagagaatctactcatagaacagacagaatgttatcagtagcctagtttggatcctagaagtctctaagctcttttaccggggagagaaaaggagaactgcaattttattttgtgatctattctccccagaaaccagactcttcttaagggaagaatgtttcttttttgcaaaccctaagatacctttagcagaaactctttgaaagtcatttgaggctgtcagatacctcttatttattacaacaaacagagatgtctacagccgcatttcctttggtgttattgcaattgtcactgggatatcagtggctgtctgcaatgctatccttgtagattgcatatcagcatctgattggcccttttatgtactatttcaaagtaatatagaaggtgtcctctgtcagctaagagagaccacagtgacttgcacacagtaggcattcagcaaatgttaattaacccgtcactacctcccttcaccacccccagcctcttttagctgtaggaaaatgtagaatcaaatgaccaggctgaaagagcattatacagtgaccagcactatctttgtttccagccaaaatagatttcagaggaactatacataaaacatttgggtggaaacagttagtgggccatttcaaaaatgaagccaaaatttgagaagaaatttaggaactgaggatacagattgtgagatcatttacctcgaagtttgtaatgaagctgtaaaagtgaatgagtttatggagatcacgtaagaaagaaaagggtgaggacagagccctacacttaatcgtggaaggaagaagagagccctgaaaagaaaatagaaaatcagtcaatgaactggaataaaattacttgtattttcttatttacttataatagaaactgtaagaagtgaatttccataaaggttgtgttaacaactacaaaacattcaaggtagataaagactgagaaaatgtaatcgatgattgggaagttgctagttaacctagttactagaatagttgctgccgaaaccagcttgcaagaattaagaaatgaatctagggcaaggaagtggaggggatgagaaaaacaactctttcaagagttctgatggtggtaggaaaaagagcattagttcagcgtctcaaatgagtggtggagccaggagttcccatgtggggcccttgctgagccatgacataagtactatgaatatgaatgtggtagattgcaaaatgagtgcaaaatccttccgtgtgtttatgttcctttgcactgtgactttgtagcccctcccatcaagatatggagtctatttctcccttgaacttagatttggtcacatgactttgctttggctgctgggacattaacaaacgtgacgtagtagaggcttaaaaagtgcttgcataat

SEQ ID NO: 113008 - DNA, 2103 bp, Homo sapiens
acaccactgtactccagcctgggtgacagagtgagactctgtctctaaaagagaaagaaaaagagaaagactaatagtttttgtttgtttgtttgtttgtttgttttaactggagttggagggcttctgccaaaattttctgtttctaactttttttggttttttgtttgtttttataaaatatattttatttttaaaatagacaaagtcttgttctgttgcccatgctggcttgaaattcctgggtgggcgtgatccccctaacttggcctcccagagtactgggattacaggtgtgagcaactgcacgtggcctgtttctgacatttttaaagttagtcttaatactgttttatgctggttttactttaaatatatatatatagaataaaagcaattacttaacaaatgtcagtgacatgcaaatatataattaataaaacttcttatatctcagtggttgatgtcaataaccaaataaccaagaatttgaataatctcttctaggtaactggaagtgaccttcacttacctgtaatttacacattctcaccagctcctctcctactcccttcatcatgaccaccaaggagagctagaggaccttagagaggaggctcagaatagtactgctttgattttggcaacatgcatattgtttcttcagctaactcagcatgcttgagatcattttaacagcatagtgttctcatgtggtttcagtagaaaaagtccctatgtaaaaatagcaccttcttcctcagcatgtctgctccctttaatgaaaataaggctttagcttagactgagccaatgcagctatcaaggcgtgagctaaaatctcatctgcttcaaatgctgttagccaaattcactaacaatggtgcttacagtcattgccaataagaaagacaatgtagtcagagtcatgaacaatacaggataattcatacccaatacacaatatttaaacagcagttttctagaatgaatccccagacaacatggtcaatgagaaaagtcacaattgctttacaagaatatttatggtggccgggcacggtggctcacgcttgtaatcccagcactttgggaggctgaggcgggtggatcacctgaggtcaggagttggtgaccagcctcgccaacatggtgaaacccggtctctactaaaaatacaaaaaattagccaggcgtggtgacagacacctgtaatcccagctactcgggaggctgaggctggagaatcacttgaacctaggaggcggagcttgcagtgagccgagattgcgctactgcactccagcgtgggcaacaagagcaaaactccgtctcaaaaaaaaagaaaagaaaagaaaagaaatatttatagtaatacaaacaaaccaaaaaggaggaaaaaaaaaagaatcaggagcattcacaaattcttatccaacccatttaagacaaaaagagtttaactaatataatttaagccatatggaaacctagtagtaggttgcttcttcttagagtggtgtttcattcattcttactagcctgcattctatcacaccatgttccattttgggattgggaaacttctatgtccattattgatatgaaaataaaacagagataggccaggcgcggtggctcacgcctgtaaccccagcactttgggaggcccaggcaggcatatcacaaggtcaggagatcgagaccatcctggctaacatggtgaaaccccgtctctactaaaaataaacaaaaaattagctgggcacgatagcgggcacctgtagtcccagctactcgggaggctgaggcaggagactggcatgaacccaggaggcggaggttgcagtgagacaagatcgcgccactgcactccagcctgggtgacagagcgagactctgtctcgaaaaaaaaaagaaaacagaaaaaaggaatagttttattttatatatatatacatactacacatatatatatatatatatatattttttttttttttttttgagacggagtctcgctctgtcactcagtctggagtgcaaccacacgatcttggctcactgcaacctctgcctccccggtgcaagcaataatcctgc

SEQ ID NO: 113009 - DNA, 1143 bp, Homo sapiens
ttttcctcaaatccagggcatactaactttggtaacatcctcctgtcttttgtcatattccagagccattcacttctgtgtggctgtaacctctggctttcccaatcaagcagctatggtgctctccttgcccaaatccatgaatctgcactcaagtctgggaagtaactttggccacaaaaggaattccatcttatagatagaagaggagaggtgatgtgagctcctatatattaacatctctatctgttcaagagcttctccaactacttttttctgttaagtaaacctgtctgtgagtaaaataaacaaggagttgattcaaattctgctgtgtgaggagagaatcttccagtttttgaggacaagagaaactaaattttatggtgatttacccgtagcaattgaagatcaccaagagagaagacttttatttttctgtttttggtgtgttttaacttgttttcatttatactgttttgaagatggattgggaggaggagagtgaagaatgaaaagctctatgttagaggaatctatatgtgcagtttccttattaactgtatgtgtcatcctcagagatgctgcatgacctggtgaaagaacacgggctttggagatagatactcatatatttgtacttatgcttgaatcccatctcggttactttctacctgagtataatttatagcatgacagttattatcaggagcacaaaggaagcactgttttctgtaaatgaagataagaactgttttgcaatattattgtgagaactaatgaaataattttgtaaaatgcttaagatagtacctgtcatatatttaatatttatttattatattaaatttattattaaataataataatatttaatcatggcagtctgcaatcatgacaaattctgataataatagcatttaggatgggcatggtggtttatgcctgtaatcccaacaccttgggaggccaaggagggaggactgcttgaggctaggagttcaagaccagcctgggcaacatagcagggccctgttcctacaaacaaacaaacaaacgaataatcaaaaaacgtagccggatgtgctggcgtgtgcctgtagtcctaggctgaggcaggaggatcatttgagtccaggagtt

SEQ ID NO: 113010 - DNA, 1608 bp, Homo sapiens
tcaaacataatttttaataacctcaagttaacttcaaaatcttggactaatattaaatcaagttaattaatggataacctttgcatgcctagataatttctataatagaatacaaaaacattaattactaagcatagtttaaaaagatatatacgtctttgtttcttattttactatattacagggagcatacctttggatcatattaatgaatgtgttcagttttgcttttactgtatttaaaactcaattaccaattactcatctcccacttttctctgtgaaacagaggctagttattgatttacagttatagttaatatgggtaattaagactataccaggagcattagtggcagtagggcaagcagtagtgtaaagaagtacaacaatgtttctaaagtgaagtaatttttttcatttctcaaggaaaaagtgagtagttttggtctaaaggcaaagtgtctgttctagaacatgaaataagatagggaaagacaaaacgtaaatggatagatgtagaaaattgtagaaggtttgcaaaaagtaaaccatatttgtcttgcttgtctgaaaagaagcaataaaatatgttaacatttggcaacatttcctcagctttgatgggcttattcaaaagataattttttaaaaaagaaacttggaatccattattgccaaatattgatttgatgcaaaaatagaatttggctttctctctattaaaatgataaactggtcttatagcgcttaacaaggggtaataaacagttattatcaccttttgaataatccatccgggtagaagagatttatactgcaccagaataattttctgtgctttgtgttgattttatcatgtccattattacgttttaaagaacaaagtcttctcacatctgaaagagctgagattcattaaaattgttttacctacttctatgcttatttaaaaatattatattgatgctttaatgaatagataactacactcttttttctcaggcactcgtgacactatcttaattgtggaccaaatgtcttgttaaatctgtggctttgggcttcttaagattacaccttaaattcagaaaaaatggaattctcaggatgtttttacacttgattaccttggcaactcccagagaacctctgggaaatcacaaagatgtgctctttcaacttaggaaaaagcgagtgatagaaataattaggtttgttgagtggcttgatatttttttaaagagctcaacacattgtaagagtagcttgggaaaagttgtctaatcagaagggatgccccgccttcccttggttaagttttataggtacaatgcaattaacataaatagctcagacagcctacactttacagaaaggtcctaatgattttgcaatgtctttatccataatatgtccttaccctcaagggaaacattgatcaaacccttacaagacactcatgcgtcagacaactttgttcccttccattctgatattgctcgttactgtaataaaggaaccacagccatgccgtcttccaggtcctttctgcttctctcacatgcttgcctgaaggctctgctataagttacaagccatagatca

SEQ ID NO: 113011 - DNA, 1376 bp, Homo sapiens
aatatattgattctgtaaatactgtttaggatgacagctgatgttgcctggatctgtatgccatccaaatttacattcttgacttagagatgtgatttgaaatatttaaaatatatgttaaggctgggcgcggtggctcatgcctgtaatcccagcactttgggaggccgaggcaggcaggtcacctgaggtcaggagtttgagaccatcctgaccaatatggagaaaccctgtctctactaaaaatacaaaattagctgggcgtggtggcacatgcctgtaatcccagctgctagggaggctgaggcaggagaattgcttgaacctgggaggcggagtttgccgtgagccgagagagcgccactgcactccagcctgggcaacaagagcgaaactctgtctcaaaacataaaaaaaaaataaataagtaagtaaataaaaaataataaaatatatgttaatcatgattataaaaaataaaaaggatgttaagaaatgttctatgatattttaagataaagcaaaagagagttgtatgctttcaatttcattgaaagcattgtgtagcaggcctgcttcgagatttttaaaaaaaatttgtagaagagtgtgctttgttttactttgttattaactattgattaaagtccagacattgtgaaggcacatgttaacttgcaggttttcacctgatagagaaatgcaaaacatttctctctggtggaagagataacctcaaagtatactttatgccctatagactattcagttttttctctaacttaaaaaaatctttttgcaatgtgccttttttgatggactatatgagtcccagctcctcaaacatttttaaaaaccagctttattgtctaattattttattaattaatgagttgaataaagttttgacttgtgttcattctgtattactatgaaagtcatgcttttaacttgaaaattgtatttgacaaagacgtgagtttaaaaagcgagatggtcatccaaatggctaataaaattaagaattcagaacattcattcagaacacatgttaattcagaatttggaacacacattgtacctttcactaatcagttgacatctgttgcatttgattaggttctgagcatttcacttttaacattatgttatccaaacagagacctacaagaagagggcaactaaatgggaggtcttaaaaacatgttagatggggctgggcacagtggctcacgcctgtaatcccagcactttgggaggccaaggtgggtggattgcctgagctcaggagttcgagaccagcctgggcaacatggtgaaaccccttctctactaaaatacaaaaaattagccaggcgtggtggcatgcccctgta

SEQ ID NO: 113012 - DNA, 1089 bp, Homo sapiens
tttatctaatgcttactatattttcatcttagattattttacaattgtctaaatggaaaaggtattgcctaataaagggtttacagtttagataataaaataaactacccattcctagtaaacagcactgcataattgggctttggaacatcggatgaccacatcttcagactcctgtgggctggtgttgaaattgggggactagctctttgttgctttgtgctacttacacatctgcctctcaaaaatactcaacaaagatagcttagtgtagatgaggaatatatgtttttacattttcccttaaaaacgctatttccatgcagcaagacaaattcgcatggttctctgttatgtgaggtgtgatgtgtggagacgtattaactagcaccatttaacaattgattttagtgatttttcagcacccctttttgataaatgctcacactgctgcctggtttgtctattccttaatgtagatctccagtgggtaaaagttacagggcagctgtatatatttctgccagtataagcaagacctcattaagaactagagcttccaataataaattgagctccttgcgaagcagagcgttcttcaacatggaatgttacttatggatttttttttttttttagacggagtcttgctctgtcgcccaggctgaagtacagtggcacaatctcggctcaccacaacctccacctcctgggttcaagcaattctcctgcctcagcctctcaagtagctgggattacaggcacccccaccaccgcgcccagctaatttttgtatttttagtagacggggtttcaccatcttggccaggctggtctctaactcctgacctcgtgatccacctgcctcagcctcccaaagtgttgggattacagatatgagtcacagcacctggcctacttatggatattacagaaaagaattctatactgtgaaggaagataaactggaataatatatagaaataattcatataaataaatgtaaagttcagttttctgagattttaacagtttatagaagactagccaaacaatggttttataattaacaagatgttaaaacaacct

SEQ ID NO: 113013 - DNA, 2509 bp, Homo sapiens
tgaaatggtggatgggagttgatgaatagcatctttctgcaaacaagcaaaccatgaatttcgtaagttttaggtcaagctgaaattatataaggccaatcatttttcagcatttcattaactgggtgggatctttggtaattttttgaatctgtgccagttactaagttttttctttttctttttgtttgtttgtttgtttttaggcagagtttcgctcttgttgcccaggctggagtgcaatggggcgatctcggctcacggcaacctctgcctcccgggttcaagcgattctcctgtctcaggctcccgagtagctggaattacaggcatgcgccaccacgtctggctaattttgtatttttagtagagacagggtttctccatgttggtcaggctggtctcgaactcttgacctcaggtgatccactcgtctcggcctcccaaagtgctgggattacaggcgtgagccactgcgcccggccctccagttactaagtttttactctcaactttaaatcccagtctttgatattctgctttgccagtggcttccctttaggctgtgtcaacagtgggtgcagagagactgctaggctgtgggaggaagaagggacttgatccttcctgtctgttttctcgttgcttcttgtttggcttcctgtcttcttgtgcatccggtgagctttgctccagcaacacctcttcctccctgaagcagcagttccttcccatagcagcagctgaatccaccttgtaattttccaacacctgcagaaccagcttcacccctgcctcaccacccactagcacccagctggtgggggcttcttccttacatgcctgagtttcagctttctctaagttttgacgttttaataattccaatatcttgcctggctctttccagccctagaagtgtatggtagccaagtgaatgtccctcatagaacttcaactataaggagtataattagggttgctggatttagcagataaaaataatgaattaaattacagttaaatttgaacaacaaataattttttattgtatgtatatactatgcaatatttgggacaaacttatactacaaatttcttcgttgtttatctgaaacttaaatttaactgagtgtcctacattctatctggtaatcctaattaccagatagtgtaatagtgtcctacattctatctggttacctaattacacttaggtaaccctaagtgtaattgaccaagggccccaactactgctctttgaaacccctccactgcagacctcgctctgaggccacacttcccagggcctgctcccactaactgagaacaccggggtactgaggcagattcctgggagacctggcactcctctgaccaacaactttggcccaatgaatttcctatggctttactgaaactttcttagattttatagcccctttttccttccctaggttatacttgcatctcagtctgtggcagctctcccagcctccctccgtttccttccacacaggtatttcccctaatggaatcctcataggtttaatctgtcttcatgtctacacagggtaagctatgcagggttgctacaaggtgctagcaacttcctatagtcactactctgtgatgctttcatattcctctttaccctctcaattacctagtaaacaacttaataccttgctaacaattctttatattaaatccactgtcttcaaataactgttgtggtttctgtctcttgaccggactctgactgggtacccctgaggctggcaaaaactttaaattgttccaggaaatgtaagacactaagccattccattaaagggatgtgggatgttattttcccttaaattcccttgttattttaccacagagttggcaaaacaggttgagcaagatgactgcctgttataaatgtggcatcagacatttgttatgttgtgttcgatactgagagtcacacttggacacattggcaaaccagaacgcctccgcaggaaggtaatcatgaaaatgacaaatctcgaagcgattcccaacaaggggtgtgcttatttaatctggagaagagaagaaaggctccgggaggatggggtggctgttttcaagtatttgaaggtcagtcatatggaaactggattaaacttattttgcatggctccagatgttagaactgaaaccaatcagcagagccagagtaaggcatgtgggctcataatttggcagccatgcaagcctgtatctcttcaatatttgttaaacatgtctctagcgagagtcagaagaattttttttctgctaataaaatgtatgcagctttttatgctcaaaataaagaatctattacatgtgaaaacataacattaaaattttaactttttttttttttgagacggagtctcgctctgtcacccaggctggagtgcagtggcgcaatcttggctcactgcaacctctgtctcccaggttcaagcaattctcctgcctcagcttccca

SEQ ID NO: 113014 - DNA, 1717 bp, Homo sapiens
aacagtattaagaggtggggcttttaggagatgattaggccatgagggcttcactttcatggataggattaaggcctttatagaacttgaaggaatgggttggtccctttttgcctttccatttcttctgcaacatgaggacacagcattcatcccctccaaagtgcccagcaacaaggcaccatcttagaagaagagattgggccctcatcagacatccaacctgctagtgccttgaccttagatttccagcctccagaactgtgagaaataaatttctattctttataaattacccaatctcaggtattttattatagcagctggaagagactaagacacacacctccttcaaaagctgtagcctaattcctctccctttgaatgaatgtgggctggacttagtgaactgcttctaatgaatagaacatggtagaagtgatgtcatgttatagccaatgctaggttataaaaaggattatttctgcctggctctcactctagtagatcacttgctccggggaaagtcagttgctaggtcatgagagcactcaagtagccctgagagagtctatgtggagaaaatctgagccctgcccccaaatccaagtcacgtgtgtgagccatcttgaaaggggatcaaaccttcagatgactgcagcctcagccaatagcttgattctagtcccatgagagaccccaggcacccacttaagctgctccagaactcctgactcataaaactgtcagagataataaatgtttattgttgttttaagccactaagttttggggaaatttgttatgcaataatagataatgaatacaggcagcaattagcagaggatactgttctattcttgaaaccctctaaatgaaaataacaattaatgtacaatcagataattatttttccccagctatttacattttattctcattcatttgaatcacagaaattccaccaaaaatgctcagaatctctacttttccttgcatctgtacacatttgaaaggttgatatgtattatttgcatgtgaatgcacggatgtgtatgaaataggaacaccaacaaataataataataataaaaagaaaggaagaaaactgaaagtgaggtacaagaggtacaagccccctattctctttaaatattttataccttttatcttttctgaaatacttttttgtcttggagaaaaagcttccaagcatgccgattgctgtggctcaaggtcctagcttactgtaggacctcttgctccttaaatgaatttctggtaagtcctcatcttttgccctctgacaaaagtatcttctatggcacagatctgagtgtatcaccttttcacttaaaaattttcaaaagttacttattgtatactagattgaggtctgtcattcccctgtaacacccaccccaatgcctgccccacatacatagttgtgtacagagctcaaaacaggacatgtctgggagaatgctttataagctgtaaggcatagacaagtatgaggtattcttctccttaacattctgtaatacctcataaagtctcccattttctaggagattagaatctgctggcagcctgggtttagtagtatctttctttttggtgataaggtttactggagtcttttgaattaactgctctttcctacatagcacaaaaccactatattttcctatccctttgccaatcttttttgttt

SEQ ID NO: 113015 - DNA, 1298 bp, Homo sapiens
agtgatctgagctcgcgtgctcctgccctcttgccatgtgatgctctccaccataccatgatacagcaagaaggccctcaccagatgccagcaccatgttctgggaattcgcagcctccaaaaccatatgctaaataaacttcttccttttatatataaagggaatttatatataaattaccaatttgtggtattctgtcatatcaaaagaaaatggactaagacactctgctcctaagaggataccagtttgagggtccttgttaatagtgctgctgtttgcaaattgttattttgttttttagcagacttgtttacttcctgagatttgttctctgaagctgactcctgacttcagctcagatacagagaaattctgataagccaagaatcaaagcaacagacagaagaaaatggttgcctatcttttagatctaaaagacagacaagttgcagatcatttaaaagggaaaggagaagcagcagcaaaacaaactgccacactgattatgatggaaagttaccaaagtaattagggtactgatcttttgttctcccaggcagcattctcaaaagtcttgaggacttttttgttcttcacttggctaaatgtagaaaagtttcttgtttgactgtaataatgtttcagttttctaggtaggaggtgtttttcctgatttctaataagtatcaaattgttgtaattacattatttgcagtttatgctcctcagaacttgttagggcttcttccttcctctgacactgaaacttaactttcaaaaattgttctttcttttgatatccaaggaaaataatttgaatgatgatgctacagtggtttggacttttaggttcctttttctctttggattacaaggttgacacttaaaaaaaaatctatgggccaggcatggtggctcactcctgtaattccagcactttgggaggccgaggtgggcagatcacctgaggtcaggagttcgagaccagcctggccaacatggagaaacccgtctctactaaaaatacaaaaattagccaggcgtggtggcatgtgcctgtaatcccagctactcgggaggttaagacagtagaatcgcttgaacccaggcggcggaggttgtggtgagctgagatcgcaccattgcactccagcgtgggtgacagagtgagactccatctcaaaaaacaaacaaacaaaaaacacaactatgactattgtgggccttcacaactctgagacatctcagagtaagttgacaagcttttgttggccaaagaatgggagttccctag

SEQ ID NO: 113016 - DNA, 1035 bp, Homo sapiens
tttggctcagggacaccaacttcaaaatttcccttgaagtatttaatagaattatggtagttggggggcagggggagtgacttaaaatggagagaaaaggccgggcatggtggctcatgcctataatcccagcactttgggaggtggaggtgggtggatcacttgggcccaggagctcaagacgagcccaggcaacatagcgaaaccctgtctctaccaaaaattgcaaaaaattagctcggcatggtggttcatgcctgtagtctcagctactctggaggctgaagtgggaggatcgcttgagcttaggaggttgaggctgcagtgagctgtgatgttgcctctgcactgcagactgggtgacagaatgagaccctgtctcaaaaaaaagtgtgtgtgtgtatgtgtgtgtgtgtgtgtattggaggtggtgaatgaatgtctcataagtgagaagacagatccctgagggtctggggacaaatgaaagcacactggtttagatcaagatgaagtctgaatttcttcatagtgaaaattgcaaaaaatttatgattaggtccttgaagttactgtttgtctcagctaaacagagccctttttgaggtattaactggtattagagagaataacatcactaaccccaacagatggtgtaaacttataaatcagtcttatctggagagacagaagatcagtatgacttggatcaatgctacctttattcttctagaacaaatgaatgtgtagaggccaagtgggataggatgcctctgggatccctcagtacttgtaagttcttacactcttaatattcagttttcccagtccttgactttgtcctttatgattgtaccaagcaccatagtgcctttgtcaccaagttccatgatttaaaagtagatattctgggttttttgccaatactaggcaatcttggttgcatttctctaagtacattttatttttccttttcaggtccaaaagatactaaattttcccccataattacactagacaatttatctccttgtt

SEQ ID NO: 113017 - DNA, 4181 bp, Homo sapiens
ctagtgatatttctccacaattgactactcttcatcaaacctaagcataaaaatacacaagtttctttgttacgtcttcatttccttatgaatgaagccccccccgtcaggtataagatattaaatacatttgtgtgtttttctgttgttaatgtcttttgttataggggcctcaaccaggaacatagtgatggatgaggaagagatatctcttttaccctataacattgtaggatatgcatatatcagaagcagtaatgtcttcaaataaagaagacaaatgagcaaattcattaattagagtttcattaatagttacatcttaggatagctatttgtttacttaaataatatcctggatcttgattaacatgtgagtatataaagatattatttgagcttttgtttctgctttaaaaatcttttatacattctttgaaaatgataccactcactaatgcttattaatgatagaattaaaagataaaaacaattcaaaaatggctaggagttaaagtctgtgacaatgtggtaaggtaaaaataagatcagactttgaaattaggtagacctaggttatattttgactctaccacttttttccaaagtctttaataatatatttaaattctgagctttggcttcaccacctttaaaatggggagattaataccacctcacacaattgtcaaaattagcacaatgtatttgaaaacatcttggtctctgctgaatacaccagaactcaagaaatgatatgataatgttcccagcttacctgcttaggaaacaagcctgtgctcaatttctgcatgcaaaatactcaaatttaaaatagtaaccacctttggattttctgaaataaacctaaaataaaaggcatccatgagggaaaaattaagactcaatttaccatgggatgcatacttacaaagaaggttataagtctttatttttacttatgtatttatttatttttacattttttgtagagctggggtcttcctttgttacccaggctggtcttgaactcctgggctcaagtgatcctcccacctcagcctcccaaattgctgggattacaggcatagccactgtgcccagccttagtctttagaagtcaacaaaagccaaatactgaactcaaatgtttcctctgaggcttgaaaagttttagaaaatatacaagtcatggtatcatgatatcatgataactatcatgattgctatgtagacatcaattttctaggtttataaaaatgggctaggttcagcagggctcagactgagctggtaagattggcttctgactcaccaagctcttctctctaaaatgactgctatttcatgaatttaaacaagtgccacaagtgctcatttccatgtgtgacatttttgataaacttccaggttttaaactggttgagagagccagattacaagccaaatttgcttagtgtgaacagtgaactaactccaacatagcccctctcagactttcagtgaaattcctcgaatattagccaattactttagtgtgaacacaactagctaatcacttttcaacatatataaaaagtataatgggtagaaaagggagttatttgtaacagaaagatctttggaggaacccaggagtgaatggagccttttagaagctccaagtaacaaaacaattatggtgtaccacctcatatgtaattcaaaataaagactattccaaatcatataaaaagaataaggaactctaacaaaattctgatttttcacatgatgatgactatagaggtctttttaaagaaatggcaaatgttaaatttaagacattttttccctctgtttcccttgctttactgaatgatgcaccaagttgtcaactgccaactccccaagaagccaccagaataatctgttgatcaagtgcggctgagtttgttgaacctcctgcaatgagggagagcatcaccttgacagagttctaggattatcccagaaagggaagacagaagcagaaatacatagggtgtagggtgatctttttttttttttcttttttttgagacagagtctggctctgtcacccaggatggagtgcagtggtgcaatctaggctcattgcaacctccacctcccctcaagccattctcctgcctcagcctcccaagtagctgggattacaggcgtgcaccaccatgccgggctaatttttgtatttttcatagagacagggtttcaccatgttgaccaggctggtctcaaactcctgacctcaggtgatccaccctcctcagcctcccaaagtgctgggattacatatgtgagccaccgcacccagcaggtgtagatctgatggacacagcaatgagagggtcctaaagcaagtcttgataagtgcatagttgtttgataagagaactatttgcccaggtaagtgaatttattgccctgagaagagggccatttgcccacatgagcaactttcaaataaattgattttcaggaatttcctgacacaaacagtgaaattatttattgctctacaagtttatcttcctgggcaagaatttactagagcaaacagtaagtcatgttgctacaggtggtctcatttctctgacctgatagctaagctaatggaaccaattctcattgtctaacatggacttgaacactagcaaaagctcaacattaaataagatattgaattaggaaaaaaagagggggaagtatggggccagtcaacaaaggaatgtgaaaaataatttcaaggaggcttggatagttgcctgccttctccagaacagtgggattaaaggacttcaaagttcaacttctgccccaaactgtccagatacacctaaactcatagaagcagagttctcttccagggagagaaggttcaactgcaacttatgtagacctgatgaacctatttgactggtctaagatgcttagatctaatggtgtgttcctcgagggctgaatctgctcgttcaattttgtatccctagcctaggacacagagacattaagtcctcaattcatgcaactggaaatgaatgagactatactaaaggtaatagattggctctgaatggggaggtaggtagatcatatataggtatagatttgcctggttgataaaaagcccgtgtttaagaagctaagcattaaccacatggggaattttggactaagaaaagaccatgaagatgcttaaaggacacagaaacagatgagataaaggaaagagcagagaagaagaggaggcacctgataatttaaaaatcttgtatttacatagcactttttaatgtatttttatttatgttattttattgatctgtacaacattcttgtaagcaaagtagaacaaggatcattatcaccattttatggacaagaaagttgcggctcagagatggttaagtgtcttgcccaaggtcacaacactaaaattgcagatgggctcttgggcctagatcttctaaagcattttgcaactgttaagatttggaagcagaactaaaactgtgaaaagagtgagagaagtgtttctctttacccctccaaccataaggaccaaggtttgccgagttgtaagttctgtaaatagacaagagtgtgctgtgaactgtaattgaatgggaactgccaatggagttgtcagaccctgtacactgtgcctgggtgccctgaacatagcctctgaaccaccagaagtctacactgccatcatttaagcacagatgactgtttttatgccaaagtcctgcgtggccacgtgtttccacaggcagcaaaattttagtatccctgtctggctgggcttaagtttttggcaagaattccctcttcccttgtgaacatcttggaaagcttttaactgagcacaaagatgtttattttgagaagcaaaagggactaactaaatacgtccaaaaccaatctctacctctcccaccagatgatccttacttttatcatgtaagatattttgctacctccaccatctaataggcagagtacacaggtgatactatcgggactgctctgaagaaaatggtgacttctagccctggagaggtattaagagtctagggtgaaaaagcattgagggaagtagaaacggacagcagtggtggttgtaggaggggaagagtggtactgttatgaaactg

SEQ ID NO: 113018 - DNA, 1944 bp, Homo sapiens
agttaaatatggcagaacaaaagatggaagtaggttgggtccctgacaaactatccacttccaaacttcctttctcttttttaaatatttattttatttttaattgagaaacaataattgcatatacttgtgggctcatgtggaataatcaaatcaggttaattatcatatctatcatgtcagatgtttatcagttctttgtggtgaagacaaaatcctcccttttagatattgtaaaacgtatagtacattattaactatgtaggttgtgcattgcacaagggcattttccctgagaaaggggcacttgtcttctaatatgcacaaaggagctgtctgatgaccaagcaattgcctacagttctacgtctgcccaggcactgtgtagaatagctgtatacttgtttgtgacagtaagactttaacctctactgatcttagttttctcactggtaagttcccaggacctgtgttttcttacctaagctaagaacactggaatagataggtttaggttctccacaaggtctaagaaattctgtcctattttctctttacagagactctgtgaccactcaatctaaaacagtcacccctccagagccattctttattataccattttattatcttcgtatatctggccattatctggatatgttctgttcatttattgtttacttgtttattgtttgtctccctccatcccacaccattctagaatatgagatacatgagagtagcaatcttatttgtcttgaacattgctctcttccccatcacccagaggtcctggtacatagtttccagtaagtattcattgacaaatgaatggatagttttgatagcgatatgaaatattttttaaaatttcacaaatacaaagtactattattagcagtaatttagggtaatttgtaaatgttatgttactctcatcaagacctttgctttcctttatgccacctatcacatttaccatggagacttttaaagtttacaaggtaagaagatgataaaagagaaagaccgaagtgcctgtgtataaatgaagaacctggtggaggtgtcttagctgttatgctatgcctgagttaaaacagcagttatgttattttgcccattcagaaacatcgttttaatacacatctggaaggccatcagttcaggctttttgccacagtagaagaaacctgtcacagaataaccaagagatcactgctttgctctgaatatagaatggaaacacacaggtgatgagtgaaccattctttgtttcgtgtggggaatcctccaggcacattcctcatttcgagaaaggtcagatttttcccactccctgtaacctttctcaagtagtcaggccaatcagaaactcctcttccatcccagctgctgcgtctgtttcactggcctcacagtccaggatccatgctggcttgctacttgtggagcagtcagggtacgaatttgtttttttcctgaatgctaggccctagtggctagggtcatccctttttaaatgacagctttcttttgatttcatataggtaccctgttcaggcttaagaagaacaaaaaataaagaggaagagttagaaaggaaaaaggaaaaccaatgaggggaacgtttggtcatgactgctgctgctgtgaaatattaaaatgccaatgacattatcctgctcataaacagaatagagatgcacaagcagcatttgcagcgtgtgataaatgtccttaaaagtaagaaggtgtaaaaatgaaatgagatagaagacagagcaaaaaggaaaagcataagatgcaaataaacagcagaaaagaagcccttccgatcactcacataacttgttaaataacattttaaaaacagaaatggtcgaatacaacttcatgtcttcagtgtcttgaacctttagttagaaaaagtgcaggccgagc

SEQ ID NO: 113019 - DNA, 1940 bp, Homo sapiens
gggtgacagtttttttatgttactgttgtttggggtcgtggaattttttcttctctgttttcaagcctttaagcaaaaagaaatggccttgaacctaagcactggagctttatacctccttacatacgtgtagctactttctgggtcattgcacttgtaggttccttttttttttcttcccaaagtcattttgatagctcatcatttaaaaacgactgttctcaaaggcttcttccagttgtcttttagatgactgattacaatcagaagaagaaaaaagtaaaataaactttaaaggggaaaaatccaaaccatttacatcagtgccataaaactattttagaaaactagctttctatattttaatgctttccatgtctgaggcatttctccagactttggtgctataattgtaacaccatcttgacacttctacttttaagccacaaagttttgtcttttcctttttcaaagaaaaaaaaaaatgttggagccaagtgaccactatgcatactcatgactcaggtaatggaggcgcagagaaaggtacacactgaacaagcagatctatatcctgtgtttgttgatggcacgtggactggggaaggtggccagggcactgaagaaagcagaatgactgaagtttggacctgttctgacagggcactggggacactgcctgtagggaagccagcagggaagtttcctttgtggaatttagaaaaatgggcccctgcaggcataggaattgaccctttagacctgttagaaaaaaagctcttttttccccccaagttgttgcaaaaggatttcagcctagatgtcagcccttgctctatccctgaatctggtgctctgtgcaggacacaacccgtaagatcacaggctgcaaccatgccttcatggcagccttgtaatttaccagtcctttggctgtcccaccccaaaaggggcatttgtctagttcatgtttgaaccatccagaaatgaccttccctactcagcctcattgtgacaggaattttgaggcataagcagcttgctttttttttcttttgagatggagtttcgctcttgttgcccaggctggaatgcaatggtgtgatcttggctccctgcaaccttcgtctcccgggttcaagtgattctcctgcctcagcctcctaggtagctgggattacaggcatgcaccatgacacctggctaatttttttttttttttttggatttttagtagagacggggtttcaccagttggccaggcttgtctcgaactcctgacctcaagtgatccatccgcctaggcttcccaaagtgctgggattataggcgtgagccaccgtgcctggagcataagctgctttctgtgcacatagtttgggactgttgaagaaggagatagggagagatgaagataaacaggctcatcttaagacctttaaaaaaaaaaaggagtcaaaaaaaaaaagctgcagtaggcagagctgggaaaactatttataacagatagaaaaaaggaaaatcatatttactaaatgcttctcacgtgctagatatagttaaatgctttatttatttatttatttatttatttatttatttatttatttatttttgagacagagtttcagtcttgttgcccaagctggagtgcaatggcatgatctcggctcactgcaacctctgcctcccgagttcaagcgattttcctgcctcagtctcccaagtagctaggattacaggcacgcaccaccagtcttggataattttttgtatttttagtagaaacagggtttcaccatgttggccagactggtctcaaactcctgacctcaggtgattccacccacctcggccttccaaagtgctgggattacaggtgtgagccatcgcgcctggccaggtgctttatttcttataaatattacctcttaatcgtc

SEQ ID NO: 113020 - DNA, 1550 bp, Homo sapiens
gctgtatcttcaagcatccactttcctctggatagagtccaagcacaagaaaattgaggcaagtcacagaaaggccaaaaattcgttcttgaaacactcccaacaattaacatacattgaaatatattgcttaaaagagctggcatttatttttcaatgtgctttttaacagaaatgtaagataaatgctgaatatgcatgtgtgtagatcaataaatttttacaaagtgatcataactgtgtatccaccacccaggtcagaaaacaaaactgcccagcagtgccctctgtacactgaccagttactaccccctcatctccactctaagccttatcgtgtgctctatcaaattcattttgccacttttaaaccttatataaatggaataatgcaatatgatatttttatatctaccttctttgtaaaattttatatctactaacattgtaaaattcatttatgtggctgcaattgcttttattttcattgctaaatagtatttcattgtatgactctcccattatccagtctcctgttgatggacatttcggttgtttcctgtttggggaattataaatagggctgttacaaaattctttttttttttttaactttaatttaattttaatttcttttttagagacaggatctcactctgttgcccaggactgagtgcagcggtgtcatcatagctcactgcagccttaaactcccaggctcaggcattctcccacactacctcccaagtagcatgggattacaggcacaggccacagctcccagcttttcttatgaaattcttgtgctaccttttgttgcacatatgaatgcatttgagtatatgtagatggcacttgttttaataaaacctgagatttatggtgcagggaccatattttctttatctgtgtggtcccaggacctatcagtgcctggtacttagtagatatccaataaatctttgctaaatgaatgaatgaatggatgatttctgaggacaattgtttttcctacagaacttaatgctgcaccattcacattagtatattttggggtgtcattgaaatctttctgtttgtacacatgtcaattttcctttccagaaggttttatcatagaggttttctgtattatgtatctgcaaattgtaactgaaaagattgatgctctgcaggcccctcaaacaacagcatgcatattaagactgccctctgcctactgctgtttacagcttgcctttttgctttttgaactgcctgacacttttgcttaaagagtcatttatcactgatggtgcattccacagttatctgctattctttttccagtataccataactaggctttcttgagttatctctggttataatattagctgtcacaagttggttacataaacttaaaaaagtgaactttaaactaaagtttttgacttttatctttttgcactgtaggcgtgggacaaaaaagagcactttttgaggctatatttacatgaaatgggaactgctatggcatatgctgcaggtgctgatatatagtcaaaaaa

SEQ ID NO: 113021 - DNA, 1077 bp, Homo sapiens
aacctccacctcccaggttcaagagattctcctgcctcagtctcctgaatagctacaactgcacatgtcaccatgcccatctattttgttttttttttttttttgtatttttagtaaagatggggtttcaccatgttggccagactggtctcaaactcctgacctcaggtgatacgccctcgttggcctcccaaagtgctgggattacaggcatgagccaccccaccggccaaattactctttctctattgcaattcccctgtcttgataaatcagctctgtctaggcagaggacaaggtgaacccatcgggcggttacaaaaggccactaacagaataaagtaccatattaaataataactaaaaacaacaacaacaaaaatatacagcagggaattatgccaagtccaaaagcattttaaatgacagcaaattgaggcctaaaatggccacgatggttaaaaaaaaaaaaatgaatgaatcaaatctaatctaatcaatgtctagatttaaccaccgcttatggaggatagaggaacaagtgaaataaccacaaggagacagtctgccctatgcaaaataaaacatcttacaggaaaaaatgagccagtttctttttccctccctccctccctccctccctccctccctccctccctccctcccttccttcttcccttcctccctctctttctctctctctctctctctctttctccctttctttctccctttctctctttctttcttcttttcttttcctttcttttttgaggcagggtctcactctgtcactcaggctggagtgcagtggtgccatcttagctggctacaactcctgcctcctgggcttaagcaattctcctgcctcagcctcctgagtagctgggactacagtcacgcaccaccacacccagctacttttgcattcttagtagagacagagtttggctatgttggccaggctggtctcgaactcctgacctctagtgattcttccgcctcagcctcccaaagtgctgggattacaggtgtgagccaccgtgcccagcagagccagtttctataacaaatttc

SEQ ID NO: 113022 - DNA, 1011 bp, Homo sapiens
gatcaaggactcaaaagaatgcaaccttttgtcttttacctacttatgatctggaagcaccaccccactaagttgtcccgccttactggatggaaccaatgtacatcttacgtatattgattgatgtctcatgtctctttaaaatgtataacagcaagctgtacctcaaccacctcagatgtgtgtcctcatgaccttgtgaggctgtgtcacagatgtgtccttaaccttgacaaaataactttctatactgattgagtcctgtttcagatactttctggtttacattatctaacgttaacaattttcaataatcatcatcaatgatcagtaattgatataagaaataggaaaatggagctcttctccttccggaagcattctgtgatggaaagggccccggataagacttggaaagatttagattctatttgccagtcttgggaaaaaagaattttaatactagtgaggcttacaataattaagatagtcacaatgaatatatgacaagctgatctgaaaaaattagacactaggaaatggaaagaattatcattgatgatcgtcaatccctaggaatttgttttctctgacccagcattcaattttgttcaaaatactgtaaaagtaattgctgatggtaaagaaaattttcaactgcaacagtaatattaacattgtccttacggtgggttttatgagtccttgactgggaagagtggaatggtactttttccaagactgctgcagggttctaatttcaaaagattatggtggatgtgagaaatacaaaaagggagctcttcttctccttccagaagcattctgtgatagatagggcacagcataagacttggaaagatttaggttctcttcccagctctgctgataagaggctgagtgtccattcacggaataagagtgaaaccgcctttccaaaactataactaaggaaattatgacactgaaagatacctgagctaaccaactccatcttgcttctaacctcta

SEQ ID NO: 113023 - DNA, 1051 bp, Homo sapiens
gggataggtgtcttgcagcagggtacatgtcttctaaccggctctcttcctgcttctgctatcttgctggcgcaggctgctggcacaaatagccttgcgccttggaactgggcctaagaagggaggagttactcatgccttcaagctttcaggccctggggagaatctttcaaacaatttccatctttcaacagatccaagtgtttgctgcactggtcagaatcactaatcctagacaatgcttatttactatggtctctactcaggaaagacagactttttactagcacaagttcgtgatcagatgccattaatactgtatgggagaagacagagaggagagatgagctgttttagcactttgtaatttttcatctaatatgcaagtagccattttcctttaacttgctcactttttcttcacttcaaaactcaaacacagtaagaagcttacatctaagttatcaatgttttatttactccttttaaaatgagactgacttctagctcaacattcactatagcataatagtattgaaataaaacaagtaaaaaatgccaatatactagttataatggaatttaatgtatgcaatttaatattaaaaatacagatgctgaacctgatttaaaaggcctgaggagattcaagagaagctgagatttgccccaaacccacccaggataaagctacatgattttgaagagatcacttttgaagagaataaaataccatataaaataagagttaaaaacaaaaacaaaaaaagaagtagaagaaaatcccaaaatccaagaaaagtctttggataagaaacatttgataacccatacttagttttttacttcttgaattactcttcactgaaattcagctacgcttaaggggatggcattggagaatttctttccatatctatcttaaggatctttaatttcagttgagaagctctgatgcttctctaaggcttatttatctttaaaggtccataattgcatgcataatgccacatttcttttcatttgaaaaaatgtgcctgatgagttctac

SEQ ID NO: 113024 - DNA, 1284 bp, Homo sapiens
ctcagcctcccaagtaactgggacaaaaggcccacaccaccagacccagctagtttttgtattttttgtagagacaggattttgcaatgttgcccaggctggtcttgaactcctgggctcaatcgatctgcccgccttggccgcccaaagtgctgggatttcaggtgtaaggcaccactcctggccttcattctattatttttattcaccagggcttgagtttatgaggattcctgataagaattcccagactttccattcgataccattcttagagatcccaatgattttactaaggcaaatatttcaatatatagatttatatacatatatatgtgtgtatacacatacacatgctagttttctatagcagagcattcaactgctttaagattgcagttacttacacttcaggaaaactgatttgtgcaatcttcaatttttcgttttgcgcaggaaaaatcaacctgagttttctgctactgtgtattgaaaatcataacatgtatgaagataaaatagatataaaatttaaatctaagccaatggaatacaaattttttatttgttcaattttttctgaaacatgccatgcagtagttaaattagaagcattggatgaaactgaaaacagagggaagcataaatattaactgtcatgataatttctgatcagtagttgtaagaatttgttaaaatgcttctaaatcttaatatgttttaataccataaaatatatttttgaggtaagccagtgtcataaactcttgtctaaatacaaaacaaattcctgaacatccaattctagcaaacttctgttcatttaagtaaaaatgctgggaaagtttagttctttcaccaagcaaatacaggaagaatttaggccaggcgctgtggctcacccctgtaatcccagcgttttgggaggctgaggtaggaggatcatttgagtccaggtattcgagaccagcctgtgcaagtcagtgagacttcatgtctacaataaataagtaaaattagcctggcctggtggtatgcacctgtagtgccagctacttgagagactgagatgggaggactgcttcagaccagccggttgaagttgcaataagctatggtcttgccactgcactccaggctgggtgacagagttgagaccctgtctcaaaaaaaaaaagttctatttgtaaggttcttatatcggttcgaaccccgaaagtgcaccgacagacaacaccaggcagagtgaagcaacatgctgttttaatgagcgcctgggtgcag

SEQ ID NO: 113025 - DNA, 2002 bp, Homo sapiens
agcctcaattttctgggatcaagtaatcctcccacttcaccctcctgagtagctgggactacaggtgtgtgccaccacactcagttaattttttcctatttttgaagagacagggtttcaacatattgcccaggctggcctcaagtgattctcccacctaggcctcccaaagtgctgggattacaggcataagccactgtgtccaggctggttggattatttttttacgatcagtttcaggctaggcatttttggtgggaacaccatattaggtgataatgtatccttctcggtgcttcacatcaggaggcacataattaccggtatgtccttatttttttcttttctttttttgaattattttttgccgatgacacagcttcaggaggtcctgacgacatgtgcccttggaatgtcctttcttggttgaagtagtgtctgccaggtttctccactataaagttaccactttcatctttgttattctagtttgtgggaagtactttaagactagataaatatgctgtgaaacttgaactcaagcatcttagcatccattgatgactgctgcttgaattaattatttgtatgatgattgcaaaatggtaattttctattatttcttttattaaatattattctaaagtgtaatgtttttatagaaaataaatacattcttttgcatgacacatatatcagaaataagtttgttttatgtctttttaaaaaatttttgagacagggtcttgctttgtcacccaggctggaacagtggcaagaacatggctcactgcagcctcaaattaccaggcttaagcaatcctgctgcctcagctccccaagtagctgggaccacagacatccacaaccatgcctggctagtttttgtatttttagtagagatggggtttcaccatgttgcccaggctggtctcaactcctgagctcaagtgatccacctgcctcagcctcccaaagtgttgggattacaggtgtgagccaccgtgtcctgcctgttttatgactactaatgtggaaaaagcatgttacattttggcccacacaagacataaaaaatgaaattaaagagatacaatacaatgaacaagcatttcactttctttccagaacatagaaatgtcttttggacagaaacagtcatgtaagactatactagtgttcaatataagaggcctatctccaagataaggatttagagaatgaaggaaacattttaaagaagaatggttatgaataaccaagttgagaataaacattgattgctaacaactacagattagtgaggaaggtatcagactgattttcaagctcagtttaaacattagtttggagggttgtaatcctacatgtattgaactgttttaataaagtatattttattttacttttttcttaaaaaatttgagtgtgctactgtttttctctgtttctcatactttaagcctggctagaccgtggcccaaagaactaatgggatcattactcacctaacagcaggatatagtaattgcacataataaattcaaaagaaacatcttcagatgctgaacttgcaaaaataaacatatcaagtgagaaaaaccttacctcagtggttctaaatcctgaaagcacagaaattcctggcaatgttttaaaatgctcaggcccaggccctcatcccacctcgatccggttataccttactctcaagagagtttcgccctagcatggaaactttgcaaaagcttcataggttattgtgatgtgcagccagtgctgaggactgctgccctaaatccatcacctattgaggaagcaattaggcctcaggctagttaaagctccataccagcttcattagttttttcatctcaggtctcaggccaacatctctttcttccttccaaaaccccttaggatttgtctagagggcctcttttctacagctgttaccacctgctctaccacttatagttcctcctttagggtaggacataaa

SEQ ID NO: 113026 - DNA, 1054 bp, Homo sapiens
caactatcaaaaagcctgaatttattaaacctataaattaggaaatggttattgaactatgaaaggattttgtcaattttaaaatgatttaatttaagtaggattctttcctagagctttactgtctgtctcttcacaaatcattgttgaagtggtcaggcatggtgactcacacctgtaatcccagcactttgggaggccgaggtgggcggatcacctgaggttgggagttcgtgaccagcctgaccaacacagagaaaccccatttctactaaaaatacaaaataagctgggcctggtggcgcatacctgtaatcccagctacttgagaggctgaggcagcagaatctcttgaatctgggaggcagaggttatggtgagctgagatcgtgccattgcactccagcctgggcaacaagagttaaactccgtctcaagaaaaaaatttttttgttgaagtgttcaagagtgggtaaaaggagaagtggaataaaaaaagaaaacatactagggacattcgcaaacaatgtttgtctcttaacaatgctattgagtactctgagtttgttggatttcgttttttttgtttgcttgtttttcagacagagtgttactctgtcacataggttggagtgcagtggggtggtcatggccggaccatcctggacctcccaggctcaagtgatcctcctacctcagtctccgagtacctgggactacaggcggacaccaccatgcctggctaattttcgtattttttgtggagacggggtcccactatgttgcccagactggcctcaaatgcttcagtttaagtaatccacccacctcggtctcccaaagctctggaattacacgtgtgagtcaccacacccagcctatatatgtgaatttttcaaatttttacttttaaaaaaatcgaagacttacagatatagtacaatgagttcccttatatctgtcatctaggttcatcagttgttaacaaattgtcatttttttctttctgtatataattattttattactttgatgaaatattaatgattagaaa

SEQ ID NO: 113027 - DNA, 1036 bp, Homo sapiens
ccaacatggagaatccccgtctctactaaaaatacaaaaaaaaaaaaattagccaggcatggtgacacgcgcctgtaatcccagctactcgggaggctgaagcagaagaatcgctggaacctgggagatggaggttgcagtgagccggtatcgcgccactgcactccagcctgggcaacagggcaagactccatctcaaaaaaaaaaaaaaaaggaactacatttcagcaaatgggtcagtgataatttacttacaaaaaatttatgtactttcattttgaagttacacactgctgccaccaaaatgtgtcagttgcacatgccacagatgataaataactggaattctcatttcttttctaaatgtgagggggaaaaaaaaaacctatggctattcaccactttgaaaatcaaaacagaaatgatttcttggctatgacaccaaaagcacagaacacaagacaaagcagatttcatcaaaattaaagactttgtgcatcaaagtaaaaaggcaaacaataaaatggagaggaaatatttgtgaatcgcatatctgacaagggattaatatgcaaaatatataaagatatacagtaggaatagggaagtattgtttagtgagtacagtttcagtaatggatgatgcaaaattctggagatggacaatggtgagggttgcacaacaatgcgaatatactcaatgccattaaaaatagttaaaatggtaacttttatgctatatatattttactatgataaaacaaactcagccgggtgcagtggctcacgcctgtaatctcaacacttagggaggccgaggcaggaggatcaggagtttgagaccagcctggccaacatggtgaaaccccatctctactaaaagtaaaaaattagccaggtgtggtgccacatgcctgtagtcccagctacttgggaggctgaggcaggagaatcacttgaaccagggaggcagaggctgcagtgcagggagctgagattgtgctactgcactccagcctgggcgacagagtgagac

SEQ ID NO: 113028 - DNA, 2397 bp, Homo sapiens
taagaatttctataaaaattcaaaatgctacagcagccaattccgtgaactctgtagccagatggcttgggatcagatctgagactactacttactaactgtgtaaccatggacaaaagagttaacctctctgtgcctcatttttctcacctgcagaattgggcttataataggacctggcccataaatctgttgagaaaactatgggtgaatatatagaagatattttggatggtgctgatacagtaagtttaggtattgttatccaagtaaataatttgtgaatctaccaacttggtatactaattttttaaaaattttctttcatatagttttttttgtttgtttcctttttagaacagttctagatctccatcgttataaaagagtattaccgtgttggtgtaccacaatttctcaagaaaaacattagctaagcccaagctggattttggtgggtgtcacaggtcattttttcctccattctatttctttctctgaattctttcttctcattgtcaaccagatgccacttaaggtgataataaaattgagacagaagttaggaaggaaaaagcaacctgactttcagagccctaagagatttttatgagcaaaacaaagaaagatcccaacattatacctagtaaatgctctaggaggataaaaagtgacaacaacctccaccaataaagtgcagtcactatagaagcttttccacatcagaacactctgaccttactctgagagcttctggctgcataatcctttcatggacgttatatgcactagaggggacaagagcaagaagagaacaaggcactgagtttcagagtgactaaggtatagaaattcagaggaaaagcagaggcagaggagcgattaacaacaacaacaaaaaagcagcacaagatttgacaaagaggcaaggggaacaggagtggagatggggaatgagataagaaagctgcacatccagggagagatatggggagaaatgcagtgcttagtagatggcaataagtagagttctgctttgaaaaaagaaatcaaagggcaaaaaagaaaaaaaaatagagaacatatggggaaataactagaaagcagctgaaagggttgcacctggaaggaagaaaaaaataagtaacatgtattcataacaatgtttgagagagggaagaaagattttcttcctcttcaagattcccatcccctctaaaaatacagtcactaagatgcagccatctttgtggtattcattcctccaatcccatttcccccttctctgacatttattttcattcaagtcagttgccagtcactcttactagaaactcgccaaatcatatttcaagaatttgtaaaagacaacgttctcggcaagggggtcttagaggttggctttttcttttggtcatgtggcatcaggttatccctgacagccacacagcagcaggcaagatgaaacttagtttacaggttggagctaagggctcagattacttcctcatgtgacccagttggctttgctttcttctgtggcagcaaactgaatctcgagccccagccagctgtcacaaagctgccaatggtcaaaggatgtccaggctcttaatatagcctgaggagccatgcaaggcacaacttagcccagagagggccaggattagaacctcttgtcctagctcaatgcactttcactacagagaccagatatgagcagttgaaacatgactgtgtaagatttgggaaaaggggtctcatttactaggagatgactatttgggtaactttttttttcttctttcttgccttctacaggactaataaagttttcttgttttttctccctgccctctctttccttttctccacattctggtttggaagctatgatatttcatttctttcagtcatttccattgattaaaaaaatactatggaacttctcaaacacactcaaatagagataatagtatgaacttcccaacgtatctgttgcctaacttcagctaacaataaatagccacttttgtttcacctatatacttatatacccacctacaatctcacccctgattatttagaaaaaattctagataatacatcatttccttgtatatattttagtattatgtctaaaagataagaactattttttgagacagggctttcctgtgtcacccaggctggagtgcagtggcaggatcataactcactataaccttgaactcctgggctcaaacagtcctcctgcctcagcctcccaaagtgctggaattacagatgcgagccactgcacccaaacaaaaactcttttttttttaagcaaaattataatgttaccatcacatctaaaaaaattaacaataattccttaatatcatcaaatatctg

SEQ ID NO: 113029 - DNA, 1033 bp, Homo sapiens
ctttttccctccccacaagccccaggaaaccattctaatgtgtattcttttggttgtaggtacaaaatgtatatgattttgtgctcagatattattaacttacacaaataatgacatattatatatttcattttttatacaattatatatatttttattatttatgctttttttgtttgtttattattagagatgaggtttcactatgttgcccaggctggtcttgaactcttgggctcaagcagtcctcccacttcagcctcccaaagtgctgagattacaggcatgtgccaccatgcttggcctaactgtatttttaatgtcctaaaaaaatctaactggtattttgatttggattgtataaagttcgtagatagaattctaaagaattcagagatttataattattttgtatctctttttataacatactgactaaataaaggcatggtcctatatctcttctaccagtatctggccaatccatgtatattaacaagctaaaatttaattgaatagtcaccaaagtagatagaactggtttcagaacactaagtgggtggcaaataaataaaaaatcagtgtcatatggccaggtgcagtggctcacacctgtaatcccagcactctgggaggccgaggtgggcagatcacttcaggccaggggtttgagaccaggcttgccaatgtggtgaaaccccatctctactaaaaatacaaaaattagctgggtgtgttggtacatgcctgtaatcccagctactcaggaggctgaggcacaagaatcacttgaacctgggagacggagattgcagtgaaccgagatcacaccactgcactccagcctgggtgacagagtgagattccatctcaaaaaaaagaaaaaaaaagaaaagaaaagaaatcagtgtcataaaaaggcatttattaaactcataattattcttggtattatactagattctgtactaaaaaagatgtacatgtgtatatcacattatttgggggtttccatttaaacagacaatattga

SEQ ID NO: 113030 - DNA, 1030 bp, Homo sapiens
gcttatgcatgctttctgacagtggattgccctcttagggctgccattttgtcctgagatttgatgactctggttctccctttaggagattgctatgaaaaggcagagaaccattggggcctgttcaatagggcacacctggctctctccgtctccctcatcaaggcctgtggggcatgatgagaactggcatcagcctactgatgctgagatttgttttgaagcattcgaagaggaagcgaatgctcaggggaagctttaaatttctttctacttacagaagttgaattgcaagagctatctctttaccattaatcaccaggtctagtgtgaagccagccaacttcagagagttagttaaaagagatgactaatgactcaactctctccttatctcacgctctcttcaggtttgatctcaccagacactcaggctgcacttacccacttgaacaagagctcttccagtgttctgcagtattgagggagttctgcgtttaaaggggcctgtcctgtacccccgtccaactgactgatggggaacttcaatgcccagcctgggatataagtggggccgaaggtggaagagtgagagtaccaggtctctatacatgtccaacttgaccgtgatggtttaggcatgacctagaatccctaggaggtcttgatcatttcagtttaaaatgactcttattatatagggaatcttttttgaagttagttcttctaaaagtctgcttttggtctctgctcacggagttctgtaagaacttattttagagataagctttcaaggctatcccaattgttccaacttcaatgatcaaaacatctgagactgtgttttgatttgatttctttgtagctattttatcacaaggttttcagagttttagattatactaagcaattactggttacctttccacagattcattacaaaacccctgattatatataaccaagtattgctctctcaataatattccagtgaagcttgttgttcaaatcttatacgtttccaatgatg

SEQ ID NO: 113031 - DNA, 1036 bp, Homo sapiens
agtgaatgttttgtcagcacaaagactatatcaggcagtgcatttttaagcaactggtagcatgatgtctgtattgatgaaatactggggactttactttgacacaacagggacttcatctggtcctttgttgttaagaccaaacactttttagatactctgaggatagtcattatctctttcagaaagaacaccagaatggcttattctcagttcatcttaatagatttgacacatggttagcagttttgaaattgttaaaatgttattaagtctgatcaaaacaattttctgttaataattctgatcaaaacaattttatttgtcaaaattcactgttgtggttcttttgaaatagtagtcattatttcctcagcatctattttcattttgttctaaataccattaaaattaacttttaaaacatcttagacacataaaaccctgatatgcggtacttaccatacactgcctcacactgttaattatcattttatgttatttatgtctcattcctctaccagatttacttttcctggaaacaattgttattttttgcatgtatttgtttgccccaccatgtctctcagtgtcttaaacataacagacacccaccaaacacgtgtgtgttcattgataggtttgacggtaacttgaaacacccattcctctggtcaggaatagaaactgtctcaaattaggtaagttaagaagagaagctgggcacagtggttcacgcctgcactttgggaggttgaacgggaagattgctggagcccaggagttttagaccaacctgggcagcacagtgagagcccatctctacaaaaaatttaaaaaattggctgggtgtggtggcacatgcctgtagtccctgctacttgggaggctgaggtgagaggatcacttgagcccaagaggtccaggctgcagcaagccgggattgcaccattgccctgcagcctgggtgacagagcgagaccttgtctcaaaaataaaagaagagatacaacagaacacttcccagatatacaag

SEQ ID NO: 113032 - DNA, 1080 bp, Homo sapiens
taggagagaaatcatcagaatgttggtgttatggaagccaggtgaaaataagaaaacagggcatgaatggacaacagtgtgaaatgctggtgagagttcaaataaaacaaggatgagaaattgccatgagatttagcaataagaacatcaatggtgatcttggcaagagctgggtggggtgacagagagcataagtcagatttcagtatattcaagtgtgagcgtagaccattcttttaaaaagtgtggctgtaaaggggaagggggcttttttagtggggaacataagtatatttaaatgtgtttgagaaggagtgagtaggaaaagaagaagggacctgagagagaagggctaatcttgagtttgagaccagcatcttgagtttcggtgtctcagggacttgggaggggaatctgggcacaagtggagggaaggtcagcttcccacaggaaagaagagcaaggatgggcctgtaaggaagactgtctgcaagtttggtgccagaagctgaagctgaaggcattcttgttcattggcttgttacctccgtgatagtgacgtaggttagaagctccagtgaaagtgctgaggcaggtggcaggagaatgcagactgaactgactaggaaaacagagtgatttcagggcattgtggaggtgggggataatgagtgtattctggaaccaatcagcacagatctgtgactttctccagtagcttagaagtccaaattcagcaatgaagaaggctaatatgtttgaattattctaggactgtcttcaaggaaaccattgcagctttgcagcttcctttgcccattctttaaatgcttctttttagtttctagcctaggctctgttttcttctcactttatggaaacgtcctattgatctcatccactctggtggcctcagttaatctctctatgctgatggctcctaatccaatatttgcaacccagcctttctctccagtaccagatttcttctggttcccatctgccttctggggcatcttcaattgggtgtctcctgggcacctcaaattgaactcatcatattcccactgtctccgagaa

SEQ ID NO: 113033 - DNA, 1835 bp, Homo sapiens
cttcaactgtcatctagcctcctaactaggcttactctctccagtctacaaacccgccgccctcccaacccatccagttccctaccctgaagccaaagggcttgtaaaaagtcaacatttggcccccatcctcctcctcctcacctggctgatgccttcgggtttcagctttagtgtcacttatttttagactgacgtcttctctgaccaccctcttcccaccaggcagatcaggtgtatgctatatgcctcccccaaaccctggagtttattgaaatcactttttaatattttctactggcccgtggacaaagaataggcctacttgcctgttttaccttgtctccagtgcctagccagccctgtgcctgggacatactaattgcttaacacatttgtctgaggaatgaagaaacattagacaagaaagttcagaaaacagttggttagaggtggtaggtgggagtgagacctacataagtgtttttctgattgagtgtggatcagaactaccaggaagggttgttaaaacacagattgccggatcccactttctgtttcagtaggtctggggtggggctggaaataatgcatttctgacaagttctcaggtgctgctgctgctgattagagaccttatgagttacatccgttctgttgttggtaagaaaaggctggaggggtagatcagaggactttcagataaaaagaagggtaaggtgggatgtatagactttggaaatctgaaaggtagtggtcaaaatgggagatacttgagtttgataataaagatggcagaaatttccagtagttgacaaggtccagggagagtagctatgagaatgaatagccaaagtaacctgtggaggaaggtataataacacagagggggtcaaagacctgaaatgcacaaacattgcataaaagtatttaatacccaaatggaaaaattgaaagatgtaagtgaaaaggaaggatgtaaaatggaatgtgtcgcatcattccaattttaggaaaaatgcatagaaaaaagaccaaaaaatggacaatgtttataatagttatccatatggttgagttttattacttcatttttctaaattttcaaaatttcattatcatgtattcctttcatgattagggaagagctttacttattttgaacctcctcagctttggtcatttccatctggtggaattatctcctgttatcccatttcatacttacttctctttgacatttttactttcactaaaagtatggaaatcaacaaaattaaaacaaccaaaatgaaaagcaagcaaaggaaaacaaaaagaaggggaagaaagaatctcaagaagaaagtaatttagttggtactgacaccaacaagaaacaaatattccatatatttggaggttgtaatgacctgcctggaggagctaaaatgttgttaaggactggtgacttcaccaacaggtcagacaaggaattctagtcctaatctcttacccttcatctcctgtgtcacggagttcagataggtgttgactgtggctctcaacttttcttgttcagaattatatgtaccatacattaggacaaggggtgttaaaaaacaaaaaagaattatatgtccttattcctctttgaactacatccctccctcatacaatattactcaacaaagttaataaaaagttattattattatttttttgagatggagtttcgctctcattgcccaggctgcagtgcaatggtgcaatctcggctcaccgcagcctccgcctcctgggtcaagcgattttcctgcctcagcttcccaagtagccgggattacaggcatgcg

SEQ ID NO: 113034 - DNA, 1283 bp, Homo sapiens
gaccactgaactccagcctgggtggcagagtgagaccctgatcttgaaaaaaaaaaaaattatctcgttggaatgtataccaactgacagtggtatttgccagtaagaatttcttgctcatttccctaaaggaatgagataatacaggactttagtgtatgcatcccttcatttcaaatatgaacaattctgaatctcttatcaaggccttataattctttacctacagagaagtagatgaaatgactaagtaaacattcagaggtttaatcaagtctggtttcaaaatcaggaatatgaatataaatatccaaatttctatttcataaaaacccattattatggaagaaaataattaaactgtttatgactacagcagaatgtacaggatatatagaattgtaattatcaccacgaacaggaaagacaagaatcttgatatttctattacactgagtaccttgtagctattttgttgaatgtcttttcatctctgataataaggtgtgaattaaaaagaactattccagagactaggaaatgatgatccggaatgatttggcaaggtaagacagtaagtgacagagtggaatcagaaactcgctttcctaattgccagcttagtacttcttattctaggctgtattatctgtgctgccgcaaggcaaaccatatcattgcctttcccattttagaaataggttgtataggagtttcctttgtggtctgatggcaagagacacctattatttaagaaatgccaactgctgatcattgatgacaaaatatttttacatgttccttatggattcaagttgtccgccatttcttcaaataatcatcacgtttctaagtttggtaagaaaatcagaaatgactgaatgttaaagagaaaggggccttaggcattatttttcctatcatctcagtggggaaactaaagcccaaagagtcatattgggagttggtgggagtctcctgacttcttgtccagggctatttatagcacatagcactgtttcagtggatgagtattctgaagccacggcataattgagactctgtacatggcaccttcactcatgttcaatgtgtcagtgtggggagtttgtgtgccattttatccctttatttttgtcatccattttattcaatactttcgttggtgcctgatgtttttgatagaaaaagcaaataaaagagtaagcagcaaatgtgagttaaaaaaattttttttttgagacagagtctcgctctgtcgcccaggctacagtgcagtggcg

SEQ ID NO: 113035 - DNA, 3864 bp, Homo sapiens
ggccgagggagtggacaacctcctactgccagggcctctactcctgaactgttatgaggttgcctgattcctcttaacaacccttcaggttaggggccagctgttaacttaattttattaccagggaagaaactgaggctcagataaagttcttttatcccacaggcacacaaactgctaactgatagagccagatccagccatgtctggctacaaagcctgtgtactttaacttctacagagagtatgtgcgaggtgaaccagtaaaaataacaataacaagtgcaatactaagaatagtaataatgatagttaacacagtgctttacatgtgtgatcgctttgaacaggattaagtgaacacatgaataggactggcagggagtctttctactcttcattagcgaaacaggagaggacatatacagtacttaggatttccactggcttactttgttttctgaaaaataactgaaaggctcaattagttttgttttgtcgcatttatcagattataacgttctggatgtgggtctggatgtgggtagttgggctggtgtgggattacatgaaatcaaacctgatatattcagaaagattcttccggtggacacatatgccttttgggttcgatattcaattttgtaattagtgatcactgttcctatttatttatttatttatttgagacggagtttcgctcttattgcccaggctggaccacaatggcgcattatcggctcatcacaacctccacctcccgggttcaagcgattctcctgcctcagcctccccagtagctggggttacaggcatgtaccaccatgcccggctaattttgtattttttagtagagacagggtttatccatgttggtcaggctggtcttgaactcccgacctcaggtgatccgcccacctaggcctcccaaagtgctgggattacaggcgtgagccaccgcgcccggcctgaatgggagtttttaatccgtacttttttcttattgaagttgaatgtcatatacccctctatttccctagatgaatccatgaaagaagtatgttgccctctatatgaaaaagcaagcttgtcttctgcagaaaatcagtaaccactcctttttacacataaatacccccaaatgaatctccgatgactgatctgatactagtctgcaattctagttttagcattaggctcactcctcatatttgggagaagatgtccaattctgtagtaatgtgtaacataaagtggtgtcaatttataaataatatcttctaatgaattaatgctcatttgcaatgatcacttccatacaaatttaggtaaagatgttattcagaattggattctctctatttaaaaatgtcatcctaatgtgcaactccctaaaactgttactacaaacaactattttgccactcagcctaaaaataaaacctttcacccaaatgacacatcttaatagccatattttaatctacgtaattttaaactattctgaaagaatccatttctagatgtcagacaagagttgaaactgggacagcagtttgaaggggctaatttaaaaacccacttgcttggagacacctcaagaatttctaggctcacaaggtgggtgaagtaaggaaagagactaagagctgaacagtgccgttctttgcgagcccccactggcgcaggctgagccggctgcggctagggctgcgaagagttaacgagggaccgagccccagcgccgcgggctccccgcatgctccctccgccctcccgtccccaccctctcgttttggcaagggattaaagtgctcccccctgtggcagcagtgacccagaaatgagtttgattcacatagtccttcctccataacaagccaaacgccagaccgagagtgcctccgtgcgcgagtgcccggtgtgtgcgcgccggcgagagcaggggcccgcccggctccccgcccgccgcggcccgaactcatgcagctccgagcgagcgagcggcgcccagcccagcgcctcggccgaacccctccgcagcaggtacgcgcgcgggccgcggggggcgcgcggggtgggcgcgccgcgcgtgtgtccgcgcgtgtccgcgtgtgggtccgtgtgcgcgtcccggtcccgcggcggcgacggcggcggcggcggcggcggctgcaggacgagccgagaggctcagccatatttgatggttttgttgctttgctcgggagttctcgggagtaatttaatgccgaaggtcgctgcctagtggaaataatataatacgtcattaatatggcgccaaaagattgggttctcgatctgtagcgaggagggagggaggcagccgctgagcgcagcgttactatcccaccagtaacttgggcattgccggggcgggggccggaggaggaggagaggatgatttttggatcctgagaattgatctatgttggatcagtaagttttattatgattttttttttcaaatttggggggctgaagacttagagctatttcttcttttggatttgcgaagaacatgcggttttcaggtgaatcatcaattaaacgcgtttaggagcagaagcccagtttaagttggctttagtttataggttttttttttttttttttttttttagaaagccaaagtgcattaggctgcatgaaagtggaaagcatagtagcaacttggtagacagatggcaatggcagaacgcaggttcgcgtacatatatgaatccagagtgtgtgagaccgtgtgtgtggtgggactgtatttgtccaaacataggtgtgcgtaggtacatctgtgtgtggtggccgcagccctggctcttgtcaccgcgtcaccacatgtccaaaatattcattgcatcaattcaagggcagtgagaggggggtgggggtgggggtggagggacagtttggcaattagattcttccgaactgggcttccagtgatcagatcttttacttacagcgcgactgcttgtaaagtgtaaaaccccttaatcgatgaaatggggtaggagttggcgttggtagagcaaagtaccgattaatcgtgaacttaaaggggattgcaaattgcaacctttggcaccatctgcaaattgtgggggtggggtctcttggtctccttgcttccttaaatgaacgtgtagtgtgtaccccgggactgcaagttgcagagcccttcagtgcacgtgtcttgtgcctgtgagtctgtgtttgcgagttgggggctgttgttcggtagccagcaggctttccgggttgctcggcattggcttgcaaatgcgggagagggatggaatgtggaatgttgaccggggaaccgaatcctgtcggaacggtcccatttgctggagaaattcgatcccttccacctccttcccgctcccccccgcccgccttcgggcaggaggcggggctgaggacgcggctgctgctcaaagtggcggagcgcggcggcgggaggcaggtgcacggcacccgccagtgggggtgcctcaacttccgcgggcgtttaaatagcagcctctctcccctcccaccggtaataggtgacctggcggccgagggcggcgggggagggaaccgggggagactcgggagcgagcctccgcggcacgtgggcaggtgctgggtggccccggggccaacttttgtagcccgcctctggtgtttgaggagaggcggcccagtgtggaaatgggggcgggcggcggccgaggcgctgcttctccgctgcggccggagcgtcacctaacggtcccagctgcgccgcccgggccggggtggggggttgcgggggcggggacgcccggcccgccgcgcccgccccgcacaaagccc

SEQ ID NO: 113036 - DNA, 1520 bp, Homo sapiens
agagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggccaagagggaatttaaattttcttttgtaaaatgacagctgcagtgaatgacctgagacagctacgtttttaggaaagtaggagaggatctgaggtttccattaatgggaatgcttagggggttctttcccaaaggttttttattaggtgaactatttttcctttttataatacccgccatgaaggctagctctcttgctacttgtagctcaaggctaatacctttcaaagctaatgaactagttttaagatagagggaaattatttccctgaaagctgatttaggtagtgactccccagtggttacagattttatagtaagttgcattttgatcatatcacaactgatcaagatttaatcacaggtggagaaaggtggagaaaggaagcattcaatatgtccatacttgcattgagtcaacacttttgatgtaataatttgttgtaggtgggcaacatacgtggggggagttaaatgggatgttttgtgagtaacactcttagcaagtacatgcaacccagaatttttattgtccttttatcccaaagatcttagtctcatttacttacggtcacttttttttttttttttttttgttccttgagacagagtctttcgctctgtcacccaggctggagtgcagtggcatgatcttagctcactgcaacctccgcctcctgggttcaagcgattctcctgcctcagccccctgagtagctgggactacaggcgcgtgccaccacggctggctaatttttttttgtatttttagtagagacggggtttcaccatattagccaggctggtctcgaactcctgacctcgtgatccgcccgccccggcctctcaaagtgctgggattacaggcgtgagccaccacgcccagcctgcttacggtcacttgtaaatcagatgactttctgcttggtattttgctgtcttcttcaaagtttggatacttctataagtgtcttttacttggcattgtcattttaatgtgtagaataaata

SEQ ID NO: 113037 - DNA, 4771 bp, Homo sapiens
aagttattacacaagtagtgttacatgtacgtttttgaaaattagaaaatacaaggaaacaaatataaaaacaaattgctaccatccatagatgactactgtattacttttcagataattttctatgcatgtgcatgtgtgttttaataaaaatgagatacatgaatataccatctgtaaggattttttcttttttttttttttttgagatgaagttttgctcatgttgcccaggctggagtgcaatggtgggatctcactgcaacctatgcctcccaggttcaagcgattctcctgcctcagcctcctgagtagctgggattacaggctcccgccaccacgcccagctaattttttgtatttttagtagagacgggttttcaccatgtttgtcaggctggtcttgaactcctgacctcaggtgatccacctgcctcggcctcccaaagtgctgggattacaggcgtgagccaccgcacccagctctgaggaccttttttttttctgtcagctagcttggttagttttaatataatctattactgtaacatgtccagatttccccatttagccccagactgtaatagagaagctttgtctaaaccactgcctaataaaggaccatttattgcatttggttgtttcccttaagtcgattttaatcttaagtaactttttttttttttttttgagacggaggcttgctctgtcacccaggctggagtgcaggggtgcgatctcggctccctgtaagctccgcctccctgtaagctccgcctccctgtaagctccgcctccctgtaagctccgcctcgcgggttcacgccattctcctgcctcagcctccagagtagctgggactacaggcacccgccaccatgcccagctaatttttttgtatttttattaagacggggtttcaccgtgttagccaggatggtctcgatctcctgacctcgtgatccgcccgcctcagcctcccaaagttctggggttacaggcgtgagccaccgtgcccggcaatcttaagtaactttttgacagaatatctgacactgaggaggcaagcctttggaaataaagttgcctggattttaaaaaagcaggaaatccaaatggtatttattgtaatttggaaatcttaaatttggagatcatctgcttgcttgatgttactttccacagacttgttggaaaaagatttatcagatgtttgtgtttcagtactgaggtggttggaacagtaaacatcaagatatcaaatacagattacatcctgtctctttagggtttggtcagagaagaggaggcataggaatctgtcacagttctgcttgctgctttactttcttgtttgtgaagctcttccctgtcatttagtattatggggcacctgttacagcattacagttaatggtctgtcagaatttgcattataaaactggttttcctgtgaggtttataaaacagttatagagggaaatatgacatattagcgaacacaccttgctttttatttgggttggcattaagaggtttagcttgattgttaaaacggtgaaagttacgtcacgtttaaacttatttcctcccttgtacaagcctttagagaattggcaccatattcaacaatactttttttttttttttaaacatgaagggtgggtttgcttggagtttctggtttcttagaaggtatcagcaatcttaaattaggaaagtattttaattcctgagacaggtaagttgtttccttaaaagtcttaaatctgttttctccgttttcaagtccttgcagcactttatatgaccatgtatttacaatctggacaattctttttatgtttgtggaatgtaatatctcagaagttgagatttagttgagtctattgagtctattgtcctttgcctagtgtatttctcatatgaaaactttggtttgtgatcatgagggtgtatgcattatttttattttttctttttttgcagttcatagccctgatgaagcaagttactctgctctcctaataaatgcaagaaaatgaccttggagggcctttttaattacacatagaagtgacaatttgtaagtttaaggttgggtgtcatggaatagaatggaagaaattgatgctaaaaactttggctatgatggggcctttcctagcccaggacttgaatgattattaaggatcctttcctcacctcaaagcacaaacataaagattaccagacttggactggaaagcctttatcactaggaaaggggccatgtatttttacgtttaatcccttagacccatagtgtacgatgtgcacacagtaaatgttcagtgaccaaattttggttactctaaaacgaattcagtatttactttttgcctttagttcttcaggtagaggtaggacataatgtgatagagagcagttgaagaaagttaatttttaaaaccttagatttttttgggcttacttgttgagggaagtaaactacattttctctctctttttttttttttgagacaagttcttgctctgtcacccagggtggagtgcagtggtgggatctcggctcactgcagtgggttcaagtgagtcagcctccggagtagctgggatcacaggcgcatgccgccgtgtctgtctaatttttgtatttttagtagagacggggttttaccatgttggccaggctggtctcaaactcctgacctcaagtgacccacctacctcggcctcccaaagtgctagattacaggtgtgaaccaccatgactggccagttttctattactttgaaagcgctcacaattgacatctgtctctttgtattttttgttagagagatgaggtttcactatgttgctcaggttgcccaggctagtcttgaactccagagctgagtcctcccgccctggcttcctaactgcgattacaagtgtgcacctgtgtggctggtggaagtaatattttaaactattgatcatttagtgtctcctgtgcaggagattttattattttgagaattcatggcatcttccatgagagtttataaggacttactttaagtgaagatttcagtggtgtgggtccacactgaggcataaaataatctttttgtttgtttgtttcccacttaaaccagggtaaggaacaagaaatagcaatgttattagcaagttgcttgaggttgaacttcatggcttgctttaatttagcacaaagtacactaaatgcaatttaaattttttattgattactctttgtcataatctttacgagcatcagttacttccatgtggaaatgccatgatgcacttaacatatagaggctgagtgttggtggttgtaactttttaagttggggacacttgacactgaaacccatggaagctctcccccagaaaacatgggtgtttccttaagcacatccttggattctagtttaagtgtttaaattctggtgacttctttttatgatttctctgtgatccttttactgccactgttaccatgtattgtagttaaaatgcctgttgagaacagtgatttttctgcttattggtcattaacttgaaaatcaaataagaagcctgttagaagtttttaaaacttgtgtacactggctccaagtaggagcctcaggggttttcttttgagaaaaacccactggttttactgtggcctttatttaagttgcttagaggtctcctcaatgccttccttttgattattctagttagggacttcttttttttttttgagatagagtcttgctctgttatgcaggatggagtgcagtggcatgatctgggctcactgcaacgtctgtctcctgggttcaagcaattctcctgcctcagcctcccgagtagctgggattacaggcgtgtgccaccatgccctgctaatttttgtatttttagtagagacgaggtttcaccatgttggccaggctggtctcgaactcttgacctcaggtgatgcacccgcctcagcctccccaagtggtgggattagaaacgtgagccaccatggccggccatagttagggacttcctaaggagtgattgtgtctgatccttaattttgtaagctttcggttgcttgtccagcacctggtaattgattcacattgaactaaacacgcataatggtggtttataaacatcatactactgatcggttgatttataggacagatcagttgcctttctctgtaaagagccaggtagtcaatattttaggttttgtgggtcatatggtctgtcgcaactgctcaagtctgcagttgtgccagagcaaccatgggcaaaatgaatgtgaaagtgatatttatggatatagaaatgtaaaatttttatgaattttgtatgtcatgaaatgttctttggccctctaccctcaaccatttcaatatgtgaaaatcactcttagctcaaaaaccatacagaaacaggctgttgacccctgattggttgattgattgatttgagacagggtctcaccctgttgtccaggctggagtgcagtggtgtaaattccagggctcacttgatcctcccatctcagcctccccagtagctgggactgcaggcatcccacaccaggcctggctagttttttgtattttttgtagagatggggtttgctatgtttctttgttctcgaactcctgagctcaaaggttctgcccactttggccatcactccctggcctccccagatttatagtaagacacagcagctacttgattgtttctgctggtggc

SEQ ID NO: 113038 - DNA, 2170 bp, Homo sapiens
gaaaatgcaagttgaaattagaagtttgtttggaggtagttggctacgctgagggctgtgggttgtttttgtttcgctctttttgcccaggctggagtgcaatggtggttttttttttggggggcaggctctctctgctgctcaggcagtagtgcagtggcacgatcacggctcagcaaccttctggtctcaggcagttctcctgccttagcttctggagtagctgggattctgatcctagatcccttttgaggataaaatgtgtaagaacaaataccttggtcatctctcacaccctccgggggggtcaagctaagaagacctgtgtaagaggatatgtattataagattgtgttccactacagagggagataatgtcaagtagggtgtatgtgtcacagcaatcagaagttaatgcctaccactccgggagaactcatactcctgtggtagtgtttaaggaactgctgacacattcttccagctttaccttttgtgtgcttcactatgcaaaatgaatggcatttgtgaccatcttgccatgaatctgtgtttcagttttcaagttaacagactgttgttcattgattacattttcagtttttgctctctgataacgtatcatggccttagtcattcacatgacctctttttaaatcccagtgtacatccaggaggaagaagcccatagtccaggaatctgggaggaggtggctggcacaggaggagagtgcccctccacccacctggggaactggtctttggttcttccactgcctttgcactagatctacttatgtgtgtttgtgcaagttgataaacatgcagaaatccatgtactcctctttaaaagtaggaaaggtggattaaattattttaaattgtttttgaaatcctctctagctctgcagttaattatgattttatgggtttcttttgggaagatttctttttttttttgagatggagtcttgctttgtcacccaggttggagtgcagtggcatgatcttggctcactgcaacctccatctcctgggttcatgcaattctcctgcttcagcctcccaagtagctgggattacaggcatgtgccaccatgcctggctaatttttgtatttttggtagaggcagggtttcaccatattggtcaggctggtcttgaactcctgacctcaagtgatccacccacctcaccctcccaaagtgctgggattacaggcgtgagccaccacgcctggctttcttttgggaagatttcttctagacacaatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctggg

SEQ ID NO: 113039 - DNA, 2227 bp, Homo sapiens
ccagttacttgggaagctgaggcaggagaatcgcttgaatccgggaggcggagtttgcacttagcagagatcacgctcctgcactccagtctgggtgacagagcaagactctgtctctcaaaaaaaagtatctttactattataagtgtagtacacaatcatcgtaaaaagttaaaatcatggccaggtgcagtggctcatgcctgtaatcccagcactttgggaggccgaggcgggtggatcacctgaggtcagagttcgagaccagcctgaccaacatggagaaaccccgtctctagtgaaaaaaaaaaaatacaaaattagccgggcgtggtggcacatgcctgtaatcccagctactagggaggctgaagcaggagaatcgcttgaacctgggaggcggaggttgcggtgagccgagatcacaccattgcactccagcctgggcaacaagagtgaaactccgtctcaagaaaaaaaaaaaagttaaaatcatattaaaggtcataaagaggaggaaaagttcccaactcagtctgtcttggaaccctttggtcacatttctcagagatgaccactatgaacatttatattctttcagaaatgttctatgaatatacaagcaattgctgtaggtattttctctcctcctattatatataaatgctcttatattttgggttttttccctgcagttagcctgtttttctcccctaatatgtcttgggcatctttccacatctgagcatttagatctaacagaaaagaattctgagtagatggaaataaggataaaagctcaagattggagaccatggtgactgactgccttttttgtttggttgtgaattcatttactcccatgtcaagggaagttaaaaaaatacattccaagtacaaatgattggaatgttttgtcatagctgctcttattcagttgctgactcttaattgagtcagcaattacagagtcctggaaggggtttaatagattgccttagagctcataagcagtgattggattatttatacattggcaaatgagagctgcttgtgattcattcagaaccactcaaatttaaaattccttaaagtcttgagaaatgctttcttggtttttaaatctgagttcaaaaataacttataaagaatttaaagtgaactaatgtattatagtacatgggctttatgagtaatgctcctaagagtaaatattatagttatttattatgtggtcagttatcataattttttttcttttggaggaggtggctattgctaatgtaaacttgtcagctgaatatttgtaagttttacctccttccagaggttctgtattagcttgggccagcattttccttaaataagttttgatgtatgacgttataaagagcacatttttttgcttgagatatttagacaagattaaaacattaacgcttaagagttaagctatttgtcagttaaatgtatgactttatttttgactagatataaccctttagttaaattgagaatctgtgtttgagttatagtcatagtagcatttttagattctgtgagcatatgaattagataatgttgccagttggaaaacttcatatttaagcgattaatgtttactttaaaaactgaggtaagaaaccagctgggtttccttcacattcatttaggggcaggtggacagattttattgtgaagttataggtcattatatttgggtatttagaactgtatattccatagaagacaaaagtgaccaattattaagaatataatgtatctttttgggggagtattctatgttcagtaatttaggaatcaaattatcaggtacctagtgtttaaaaaataatttgaactatgtgaacttaaacagaaaggagtggcagggcgcggtggctcacgcctgtaatcccagcactttgggaggccgaggcgggcggatcatgaggtcaggagatcgagaccatcctggctaacacggtgaaaccccgtctctactaaaattacaaaaaaatatatatatatattagctgggcgtgttggcaggcgcctgtagtcccaggctgaggcaggagaatagcgtgaacccgggaggcggagcttgcagtgagctgagtgagccattgcactccagcctaggtgacagagcgagactccaactcaaaaaaaataaaataaaagagaaaggagtagctcataaaatacttagttttatataaga

SEQ ID NO: 113040 - DNA, 2087 bp, Homo sapiens
tacattctttagtacctttaggtattagattttagctatttgacagaatggaagggcatcaataaatttaaaagtgaatacaggagaagttattccagttaaaggtcaattagatattaaagtaaaagcatctcaaattcaataaagtggagtgaacataaggtaacagtacgggaactaaggcattcatccagtaggttattttaatacatagtattgcattgggtgatatataaaagtatgtagcggtctttaattgagtaccttctagaacttcttgagtgaaataaataaaaatggaaacagtagataaaactgatactttgagagagaaaccagcctttctgcatatgagccataagacaaaatcactaggttgtaatccttattatagctatagagtttatggcctgataaatgggccctgttccaccacagagagtaagtaattctagtaactggacagtttgttttcctcaaatcagtccttgtttcccaggaatagcattgaataaacatcctcaaattcttagttacctttccctttttttgtttcttttttcgagacagagtcttgctatattgcccgggctggggtgcagtggtatgatcttgactcactgcaacctctgcctcccgggttcaagcgattctcctgccttagcctctcaagtagctggaacaacaggaatacaccaccaaacctggttaactttttgtgtttttagtagagacggggtttcgccatgttgctaggctggtcttaaactcctggcctcaagtgatatgcctgcctcggcctccccaagtgcctggattacaggcgtgagccactgtgcccagccctcttattcttttgtaaaagtccttctctccttgtccatgacgttctcattctttcttagaatcatcacatcagtcatgaccacgcccaggtcactgaacttgttcgctcaaattcctgagccaccctagggatgggttccttcacatagtggctcctctgaatctattgcatgcagatttttcccagtttcagtcagaggaatgtaaatttcaaggttttcaggtgccttgctatctcatgtgcatgtaagcagtaatctggtgacttttatagcacttaccacactgaagccacttgtctagttatttgatgtttcctccaggtagactgtgtgctcctgcagtgcagacattccatatcttgttcaccgtatctctgacgtctaccttgataaaattttcctcaaattattatgttagctaatgtactgcattttaacccacatgacagaagggatccaaggagagagtaatctgcatataatctaaataggggtttgggccagtgggtaaagcctgtgtttgcatttcctgaggagatggttctccggcagctgccacagatgctcagttgtcttggtgcatctcttcgtgcagtgagtggagtagagacaccagaggattgttaagtaactggtccagccagggtctttggccagtggcctttccaggcagtgttctgtttttaatttaacttcctaggtagtcttcctctttttgggcaaactcccaaatgcccactaactagctcttttgtctctgtagctattatgtttctcgtggcaagtggacactccaggctccgataagctggataactttgcatcagttttgaggaaatgtaaacagaatgtcagggtgagccgtgtcgactggatccagagttctgagggcatctattgtagccacgctgagaggccttgtttctgaccagtctgagttggattcaatctctgtcccgtactgcaaggtcccattgcagtgttccctatacctaccatcatggtcccccttctctgttatgtctttttttttgaaacagagtttactcttgtcacccaggctggagtgcagtggcacacgctcagctcactgcaacctccacctcctgggttcaagtgattttcctgcctcagcctcctgagtagctgggactacaggcatgcatcaccacgcctggctaatttttgtgttttttttttttttttcagtagagacggggttttcccatgttggccagg

SEQ ID NO: 113041 - DNA, 2253 bp, Homo sapiens
gggtatctgaccactctgtcctatcttatcctggcctgtcttcaagaataatcctatcaaattagccataaaccccttatccttgatatttctgtttagtagtcagtctcctatccaccggccccaccctcctccttggttataaatctccacctcttttggaatctgagttgggttcaatctccatccccctctgcaagatcccattgcagtgttccctgtacctaccaccatggtcccccttgagtaaaatctgctttaccatttctaacaagtgtcatgaggaatttttttcagtgatactattaaggtaacagtgcattgaaaagcaaggtgaaaaagttctaaaagaggaagaaagttgaactgagcagtacagaatataagtgtttggagttggagtggtcagtggctttgagctgagccccagaaaagtggtgggattaggatagggagcaaggagcaacaggagcagcattagcagagaatgagaactgaaagtaagcagagtgttcagggaagaagcctggcccaaccaatgcaagctctgggttttggggcttgctagaacagatgcctgagtaaagctgtgagaagtcagaaaacttcatttttggctggacactttggacttagacctatttgtaatgtggaatggagggagagatctgcatatagtattttgatgaggttgcctcatggggtgtagttaatttgttgttttaataattggaagtgggaagagatcatagtttggagaataggtgtttaaagctttctaggtacaagtagttgaagggcaaacccacagggcatatggggacttcagagagtcataacattatgaatcagtaaaccttggcaattggctataaggtgagaatggatgtgtatgaagatgctacccagagtaatatgctgtgttacacatatgttggtaagtacggtgctctgccccaaacatgcccctttttctggctacctcctctttgttcttcaggactcagctcagtcttaccagcctcctctgactcttatccaccttttgtattcctgtagaactccgcatttaccactgtcaggcacaaacagtagtgaatttccgttgttttcctgtctgcccaactaggccagaagctctgtgaggtcagggttagtaattttcatccagcacctcctaatatatgagatattcaaatgtttgtcggctgcattatgtgccattatatcttcttgctactttggggtgttgtgagtagccattttaattgattattacttatcctactactgtctagattagtaattagccattgccctgagagtcaggaaaggtgatgatgcagatgctggcttttagtggggcagatgtttgcagcatacaaccactgtattgtgtagctgaaagatagtaacatgtattttgattttctgatacagtaagtcatcctgggtgagataaatcagcttgatgtcaaggtttaagtactttagagccacagaggaggaaattctgctgagcactaacccccatactgtgccaagttccctggagaagcaaatacagcactctcaaaccctcattactcaagatcttcagcggatgaaaatggatttcattagaaagaaaatactatttttactcttcttttacttgaataattttgcttaagagagtatttatgtgtgtttaggtgcatcattgtattttggccaatgcttgcgttctttatttagtgactgttgaagtgcttcctcagggagttgtgtttgaaagctggaaagtaagcattttgattcaaaaagattcttaaaagctactctgttaggtgaatctaatttttaaatttttttatagagataggggtctccctgtgttgcccactccggtctcaactcctaggttcaagcagtcctcctgccctggcgtcccaaagttctaggattacacatgtgagccaccgcgaccagcctagtactaattttttttagcactcttttgtaatgttggctttggggagctgaagctgttaggagtgagtggtcttctgcctttcccttttcccttttacctcttgctggatcctgaggggacccagaggtgcattctctagaaggttggagagcttacctgtctgcagttggtgtttttggcacacacagggcagagaaaacagttgaatagggagtggaccactggtgtttcttggttatggaacctgagggctggagtgggcttaccccaggccaagt

SEQ ID NO: 113042 - DNA, 3859 bp, Homo sapiens
tgcctacagcatgaaaccccagcttgtaaagcgtgtccataatatagctcatgacccatactgatcaggacttatgttcagcctttctcttggtacatcattttaatggcttttgaagaatcaattgataaacaaaaactttaactgggtgagtttctcaggaagaaaatataaaatattgcaattatagattagggacctaaatatttggatgaattgtgtagatccattttttaagtgtagtataggaaaaacttttcatctacttttttaggttcagttcatgcgagtctgaattaaatgacaaaagacattacaggagaaaaggcaaacttcactgatgttgatatttttatgtgccagatgtgggtaaagggaaggagacttcaccgaagagaaaaaacccaagaagagttagacctgaaggcttatatacaattttaacagagggtgataaattgtgaagtgactagtcaaaggaaaagggagtttaggcttttttgactgctcttttgtaggcctttttagagtggagctttggttttttaaaattgctttcttgttctatcacagtggttctccacatttttctttttttttcaagacagaatctcactgtgtcacataggctggagtgcagtggtgtgatctccactcattccaacctccgcctcccgggtttaagtgattctcctgcttgagcctcctgagtagctgggattacagatgcgcgccaccacgcacggctaatttttgtatttttagtagaggcagggtttcaccgtgttggtcaggctggtctcgaactgctgacctcgtgatcctcccacctcggcctcccaaagtgcagggattacaggtatgagccaccacacccagcccggttttccacatttttttctccacaccattcctatgtgccccacttctattgttgtgtgtatgtgtgtgtgtgtatgttgagacagggtctctgtcgcccaggctggagtgcagtggtgtgatctcggctcactgcaacctccgcctcctgagttcaagcgattctcctgcctcagcctcctaagtagctgggattacagacacctgccaccacgcccggctaatttttatatttttagtagagacggagtttcaccatgttggccaggctggtctccaactcctgacctcaagtgatcctcccgtctttgcttcccaaagtgctgggattacaggggtgagccaccatgcccagccacatttgcattgttaacaccacatcatacatattgtgattcccaatgaggaggaggttgggatgtacttttctgagagggtggatgggtaggtaggtgatggactaccatactttttctcacttgaaaaagctccctttcatttttaggattcattgaactgacagaccagtgccctaaagatgtcaggttgatcagtaattttaatttggaaaagctttttgtatttgtttagagagctgccctgtgtgaatataaccgcgagaccatctgtataagttcattactggccattccgtctcagttcactgccttcttacctaaatgcagcctttctcatacttgagggtagtgctagaattctgttatcatcagctacctgggaggagttggccaggtgcgctgggtctttgtacaaactgacttcttattttggctggatttgggtctatttgtcctgaagggagctgaggtgaagtggagtggaaatagtgttggatttggaattagaagctccattcccacaacgtgaccttggggaagttgctgcttaacctttcttggctttagtttcctaatgtgaaagggaggggtctggatcaaaattgtataatgtctgtggttccttcctgttccctctgtggggttagagatggctggaggagacatttgcattccattacccgatttgttttgtttctttcgcctttagggttattttagtaaaatttgcctgagaagcataatcatgcccagtgcagtgtaaatattcacacatccaggcacaaccccaccccaccccccacatgtacgcataaaatatgaatctgtctgtagtgaggaagcacagtacagtgttcattgctgtggatttttttctgcagtgcttgctgccagtcagctaaagattcctggagtagttatagtaataatgtcacaggaatatagaaagaaacctggcatctttgggagacctactgatatgtgacttctccacccctccccctccttttttaacctggtttgttaatgattgcacctaattatgtatctttggtctttttactgtttacaattcaaatgctacttaaagccatttgtttgcttttgtttgctgtaaatcctgggctgccatctgaagcacaacttgatgattgtgtattatcatcttgggttaagtgctgtctcattgctttgcaggctgcctgctgtttcccggggagatcatgaaacgaggtcgccttcccagcagcagtgaggattctgacgacaatggcagtaagtcctgctttgttgttcttggagcctaccagggtttgggtcggggtaaaaacatgattttttaatgtaatgctttaaattgctgaggccctttgcatgtcaggcaggtcagagaaagccaaagcctggagaaacgtacctgagtgtgatactgcaggtctgtaaccagatcttactgggtaaggttgactgcaggcaagcattcctgaggcttcctatttgttatcctgggaggaataatccagttccaagagtcactggtgtgtctggttttcctaaacatcatttatggtacttcgcagttgcgctttatgaaaggggaacttaatcaaagccaggtaatcattaactggttcaactcaatacaaggggaggttgaagactgcctagtgtgatgtgaaaattattaagtacaggttcttaataggtcgaaagtccctgctcttcacttggttttaatgtgactatattgaatactactgctgtctgtatctcagctctctggcaacttcatattttcacagtgcagctgagaaccagaagttagttggcttccaggcagtcaaaataaatatcacacagtgtctgtgtattgagaagctaacagactactcagagaagagctcccctcagataacagagggaaattttgtacctagcacagtgcctgagctctagcccgttagcttatgttttacattacaaattaaacccaggacaccttgaaagaatgtgtgatgggaaaggagctgggcctgctttcaaggaactctgctttagacatatgtaagaagagctctgatgtgaaagtcatcagggcagtaatagagatgtctttttgatgcactgtggaaacagatacagatacagattcagaggaggggagggcagggaaacctgcagaggagatgaaagttgtatagatccttaaggatgaaatactttttaggcaaatagggttattttcagttttctgtgctctaagttttcagcaagttaaaagctgcacattagaaagcaaggctttgctgctgtaggtgccaccctgttcagaagaggggaccaggaatatgaaaaacagaactcaatgtggtatttcggttggtgtgcttggcacaggcacaggcacggggcttttggggaggagaattggccgttatgggagagtgtcaggtgtgaagggcttgcaatgaggacctctaaggaattgagagttttagggttgactgctgatgttggcagcaggagagaagtgaactagttgagagagggtgtaggggctccagagcgaaagacctttcctcttatttcagagaaaggtattaaaggtctgtttccaa

SEQ ID NO: 113043 - DNA, 1836 bp, Homo sapiens
ctggccaaatatttcatctaaaatatatatgttcaggatgggcatggtggctcatgactgtaatcctgacacttagggaggctgagctgggaggattgcttgagcccaggaattggagaccagcctgggcaacaaagcgagaacccatctctattttaaaaaaaaaaaaaaattccacctagaactctggttaggaaggaggaagagagtgtccacagtccccaccaaaagtgtgtctgtcaactcacaagtctgtactggcctccgtcaagaagctggggatggagaattaaggtaaatatttataggttatcaaagggttagcctaggctaaacatggaaatctggtggtggaggagaggaatgatagttgctagtagaaggttggctgtccttttgtcatacagctggttcaatataaagtatatattgatgctttacagccatgctgtctgtccacgctcaatgatttgataaggtggatgatggtagtggtaaacgcagagttctcattaagaacccctgaaatgccaggcttataaaaagatgcacatactcattgccatggaacacacccctttccatcccctctgaaggcagctggttcacagcctctgccaccaactcactcatttgcactggagccttccttttgtatataactgggtggcctgcgtcatggggtgtgcctgctgtccctgctttcaggtccacaaaatgagccctacctgggttaactgcccatactctgccttccttcagccgggcctgtgcatttggaaagttctgcttacaagaaagatagggtctatgcagtggccacacctcagcctctccagcctgcaggcctgacagaattttggcagcacttcccagcccagtgcacaccatgtccaagtgaaggagaggcagctgcagacgtcagcatggggctgcagcacgagccacagccatggctgggacttgctggcctctggtctggagccctttgccttgttttctggcctggtccagaggaataccagtgtggtatttacagttggggacggacaggcattttctgtgccaggtgcaagcccttatacagctgcagtcatagttgaagcctttctccaggtgccctggaggcccagccctgcagttggatggaataatgttggggtgtttgcaggcagcgtctgcagttgctgggcttctgggactgggtggctcagccagtctctgaagttacgcattgcgccagagcatggccaagggaaacaagtccttaattttctgctttccagcccaggatcctgtccttagggatttggcacatgtgggaatagggtccactaactactttcagtacagttgatccttgaacaactccccctaccctgcaaatcaaaattctttgtataacttttgactcccaaaaatttaactaataatagcctactgttaaccggaagccttactaataacataaatcaacatattttatatgtcatatgtattatatactgtatttttacaataaagtaagctagagaaaatattaacatcataaagaagaggaaatatatatgtatatatataaaatatactattcattgagtgaaagtagataatcataaaggtcttcaacttcgtcttcatgttgagtaggtagaagaggagaaggaggaagagaaggcgtgggtcttgctgtcttaggggtggcagagagaaaattctcacgtaagtgaactgggcagttaaaacccgtgttgttcaagaggcaactatgtttctaaaacctaaaggacataccatgttatcttcagtaaacctgtagaggctaatttaaacatc

SEQ ID NO: 113044 - DNA, 2342 bp, Homo sapiens
cagagcagtgactgagacaggatgaccgctgtttgatcagtggcaaggttctttcatagtttgcattttgtggtgcagcaaacacgaagactgccattcattctaatttctgaacctttcatgcatggcacaacatgagaagcttatcacacaccagctaccaaatgtggaaggtgtgtgcagtatgtgttagatttactcttcaggttttccttattttagatctagggcaagacagcatggctatttttaatatttcaaaggggagtgagtgttggagatgtctgtataataggacctgaaggaacgttgtgcccgggcagggtccatgctcatggtgctacaaactctgtgccttttataactttatattaacccaaaggattctgttttaatggaagttggggatattaaaaacaagacaatgtttttccccactcagtctttcccatgtttaacatgaggtaatgtaatatagaattgtttttaacagtgtatgtcaagaattttaagtcctttaaatttgtcagtaaagtgaacttaactttaggtaataattttaccttgtgaatggcagtaaaatacttttagacattattagcagatttttagagttcctaactcctttcctgaaagcgaaaagaaagtaaaacaaaattttactcgtcatgtgcttaaattagtttgtcattaaatatcagcactctggaaacaaacaaaatgcaaaccaacccagtgtaatcttaccacgcggtttttaacaatagcaagcacactgtttttaataagtgcgtgatgttttgctgtagtataaatcactgactcctggtctttttagtatttaaaatattctaatttctggtttgaccccactgtcccacccccaatattttccagaaagtgtttataaattttgttttaattaaaaaggagtgttttgattttaataatattctggtagcttcctgacctcctgggaatgtctggggagagcctggctgtagggagaggtgttggtgtagcaatgtcaagacactccctttgagtctctagcctgtggccttccatgaatgtttctgtagatgtaggtgcattccaagcaggaaacagtggctccacaaatctatctttaaatgtattattgctttattttccttgagctcaaacgcatgtcttctattaggtgaaacaggagtaaattcttagtgcctgccaccttcagttcatgggttacagcaatggttacagcatgattgactgtcctcaacaatgacatttaaaaaaaaattatctacttttcaaagaaatattgagaatctgctgtgtgcacagcactgactaacttagctatgctctatgttgtaaattctgcgtcttataccagtggctcttgatagattaactttttggtacaacaagaaaatgagaaggaatagatcaccagcaaatacctgctcctggagatggaaggcagagcagttccctcgggttcacaaccccctcccagattctcacttggttcatcagcaaagtctaggttttatacagaccacttgtgtaaagtaaaatagaatttttttccccttactgttagtggatggtatctcagtgataaatgtttaatagctttattgagaaataattgacatacagtgagcctctgagcctcatatatttaaattgtgtactttgatacgttttgacatgtttatacccatgaaatcattgaaatcaagataatccttccctcccacttttctctagtcttccactgatctactttctgtcactatagattagtttgcatttctagagttgtatgtaaatggaataatacaatatggactcttttttttttggtctggcttctttcactcaggagaattacttcagcatttattcatgtttgcatgtatcagtagctcattcctttttattgctggatggtgttccactgtgatggtgttccactgtatggatataccagagttttttcattcacagtctgttggtggatgtttaggttgtttctgatttttggcttttctaaataagctgctaagagcattccttatgccagtgataatttaaatttagtttctttaccagtctttccctgtctgcaaagtgagtttaataggattaattttgcttttccttcttctgtattgtatcaacactaggtaaattaagaggaaaaggaacagactatttttgggtggactagagtttctcttggttattactattggataccaagtatgtagcatctttgtatatctgtttttaaaagcaaatgtggcatagacagcaattttcaggatttatgaaagcagtcctag

SEQ ID NO: 113045 - DNA, 2216 bp, Homo sapiens
ttcccttccccagaccttctgataattccatccagacactgcgtgtgcttttcctcgtctcttctttcaggctgtggaccggctggaggatggcctccaggacaagagggagaaagagaggcctctttatagaccctaggagccacccagccaccttcatctccaggttcctaacttggcgtctgtcttccttttttccagtaatgaccagatttagaacttctgcaggttgggctcaccccagtgtgcccagaatatttctttcagtgtgggagtgaaatattcttgttcatttagagtctaaagaggcacacttagtatttttttaaagaagaattttctaaaacatttactgaaatgccatggggccaccagcaggagctccagttctgctgattgtgctggtggaacagcagtcagttgacctagtaatgagcctcagaactggtgctcaagggtagtgccgatgttgtccctgtcagggaagcatggcaatcccatttggtcttggtcatcgcaaatctgatgataggcttatgtgcagaatctatttcttaaggtccccaaggtcttaagggtgctttgattctctgttcctgtctctggaatctgtagagataagagcttcctgtctgagtgacaaatgatttcactggcagaatggcagttaaccttaagcttttttggcttttatttttctggattttgttaatttctggaaaatggtacagtaggtgttcaggattggggtgatgattattaaaaataggaggtggaggtgaattatcagaaagttggacaaatactacatgtgggtgttagggttgtttcagatctctggcagcagtacggcacccacaaatggaaggttttgcacttaagttgtctttgtaacaaattaacaggaggcagaggcagagatggagaagaggagctggaattattgggaagttgaattgacctaccattgattgtgtcctgaatgagaagagtctaggacaactcttagatttctgacgtcaagtagaaatggtggtaatagtcatcaaagtaggaatgtaagaggcagaacaggtttgggtaaaatgttgagctcagtttttataatgctgagttgacagatctaaggaataccttaggattgatgtcttatgtgaaggtgaaactggatctggagcttgggagggaggttagtctgggaatgtaggtctggcaggttcctctgggtgtgctgggtaagactgtggacatgggtgagcacccccggggagaatatttggagcaagaaaagagcaaagagttcaggagaaacccatgttgatggggtacatggagaggaggaacccacagagtggaaagagaattgccactgaggctgagggagtatttcaggcaggatggagttgttggtgctgagaagtgtcagggcagagaagagatcagacttggcagcagttgggagaccctgttaggcagcagttaggtaccatgttctgggggaggccagatgataggagtagacccccctttggaagaaaggcagagaacagagccaactggaattttcatgggaaagtggagcaaattttaaaggttatttggcaattggccccttagtcttcactaagtttgtttacctcccgtcctctcttcttatggcactatgctagctatttactacaccataggcctgaggttccctgtctagggattgctaagtttttaggccttgtagagtgaaacctttttttaaaacagtgttttagaaagcttcctgaaaactcagtaagatgtttttcttttcttttctttctttctttttttttttttgacagagtcttgctctgtcccgcaggctggagtgcagtgacgcagtctcggctcacttcagcctctgcctcctaggttcaagcaattctcctgcctcggctttccgagtaggtgggattacaggtgcctgccaccacgcgaagctaatttttgtagttttagtagaggtggggtttcaccaagttggccaggcaggtcttgaattcctgacctcaggtggtccacctgccttggcttcccaaagtgctgggattacaggcgtgagccgccacccctggcctgatattttttcaatttgtatttagcagcatgagactttgaacctcttcagtgcaggcttatgggtgaagactacacctgcatggtgttcttaaagtcctctcttc

SEQ ID NO: 113046 - DNA, 2882 bp, Homo sapiens
atacagcatccctgcacagaatgagcacattaggcctgcttatgagaggtgagagttaaataactgatggacgtggaagagctctgtgagagccaggagggcatcacaggtggtctcatggtgcagtgctgaggtgagcctgggatgagtttgggtaagaaaacccctgagaacactcagtgacccctgcaatttctaatggttcttatttggatatttgtttctttaggcctgtcaactacttggtcccagaattcccgatcccagcataggagaagctcctgctccagacatgaagatcgaaagccttcagaggtacttcttgaatgcttgcctgaccgtgcatgaatatatgctatcccatatgcctagttgagtggtatctatttgtgcagtcctgggcaaattattcaaatccttgtgctccagtttccaaatctgtaagacggggagaacacaagtgtctacctcataggattgttgtgaggattaagtgggttaattcacatagactaatacatgcaaagcatgtgaatagttgctggcacataaaaagtgctcagtaaatgttagttattattattaattacattctttttttcctttcttgttgcatcttcgctggctcccaacaacttttcttcctctggccaggatatcagcaggttcagctgctgccaagtcactgccagcctcaagttagttttagccatgggtttgtggcttatttggcaacaagcaaaactctgggacttttgtttaggggattatgctgaaggctttccccattctttctcaatttgtttctcatcttatgtttcctctgctccctaacttttgttatctatctatctaaagttgcttttaggtgcatttctttctgctggtctttgtttaggggtccttatgagacctgaggtctgtttattctaaagacttttgctaggctttaaatcatcgaagaaaaacattttattttatcacagttttcaagtgagaaggttataggaagagtttctttggttgaatgctttgctttgtgctgcttcttatgggatgagttcacaaacagcctcatcctgtaatggcaatgcataggcagatattccttggaggaacttcccaggctctaatagggaacgtcagaaggctgccctgctgtggagtggaggagttatttggttgtggaatagcttcctccatgaggaagtagtttacatcctttagaattgtggaaaaccatcccaggaggcactttagcatgagatcaaatgtacttgggaaggtagccacttcttccccttactttatttcaggccttttttcctttgaacctttagtgctctcttccttttctttgccaaggagtgtctctgctgctctttatttcttaattccttgtgctgtgtctgtaacccccaaaatacctttctgatgttcacactaaactcctgttacttcagcacaggaatacaagggggacttagcagctgtgacctggtgtgacgagggctggtccccagtggtgtagttcgaaacctacttccagcagtgacaccaagcatggagaagggggcccagcagcacgggttgctgtgctggctttgtcccagccctacattttggtccagatgtttttctcaaccctgagtccaaactatatgtatggcactaacatactctaccagagactccagagttgacgtccatttgagggcctttgtttcagttcttgactgagtctttgagcaaaggaatagcaggctgcctttttttcatttcattgcttcagtttgattttctttcttttttggcaaactcctttgttttttatttatatcagttagttggaatatgtttttacctgattggctcttgaaggtataggcccatctcttaggttttaaagtacttttctcttgggggccagggagttggtgtccactgggctgggcacctgcttctgcggctctatgcttgaagggaaggatcctggtattacacgtgatttttgtgggaggtgcatggcctaattcttgcttgttaataggtctttagaaatgaagagtggcatactggggaatagtccgtatggaaaatgacaggcaggagaaatggcctctttattcagacactgcctcagactttattatggggaagtttattaaagtgatcactagcctgaaaagccaccaggaaaaacaaatatggacctattagcaggcgtatgatgtgaactgtgcttagtagcacaagaaagaactccctgtcctgagaaaagagagttcagcattgtgacttgtgtaaacagacagggcagcttacagatgcaagcttgctcgatgccaaacacaactttgggctggtcctgatgtcaaggtcagagctttcttatgcagccttagacaccagtgggccaaggacgaggcttgagagggagccagctgtgcagccctggctgggaggcggtgttgtgctccaccccaggggcaggcctcactgaccaaggatgaatgccacaggcccaggagtctgcagtggcataggcactgggatggctgcctttcctgtggtttccttcatttggcctgtgataaggaattggggagctctctcggtagaggggcactgttggatctgcctgtttttggcagagtggggagagggtagtgactttctctatttcctttccccacaaataactcttcccaggtagaagttttgccaggtgaaggtgtgcaaacatgttttttgcaggcccatcaacccagtggcctgtggttgcttctcttccagatttttctaggccagcccagaccttgacttcaccagctaccataccataaaccctggtgccctgggaggtagggcctgggtggggg

SEQ ID NO: 113047 - DNA, 1672 bp, Homo sapiens
ttctactaaaaacacaaaaattagctgggcgtggtggcgtgcacctgtaatctcagctactcgggggtgctgaggcaggaggatagcttgaacctgggaggcagaggttgcagggagccaagactgtgttaccgcactccagcctgggtgacagagcaagattccatctcagaaaaaaaaaaaaggagatgagtccctggtggttctgggttttggcttgaagttgttacatggttagtggagttatatttctagagcacccttgagtgcagtatctcccttcagagatttccaggtacatgttttcagcagcccttttggtgaactgagagacatttttcagaggcggacaacaagattttttgttgtttttgttgacgttgttgtggacactatggactgagggagtgagagggcagtgttccctcagcactgccaccccccatgcctgagtgaggtaaaaggcgtgtcaggcaaagtttttctgtaataggtcaggcttgttctatgttgatacagtgaccttgttacatggcagctccatggttacattgcagctgccagcactctgaataagaatgcaaatatcaaatgtcagtgtccctttctcttcctttccaggtgtttaggacagacctgatcactgccatgaagttgcatgactcctaccagctgaatccggatgagtactatgtgttggcagatccctggagacaggaatgggagaaaggggtccaggtgcctgtgagcccggggaccatccctcagcctgtggccaggtagagatgccctgaggacagaagcctctccacccacccttgctcttcttccctgacagcaggcatctgagaagagacaatttctgtgggaagagacagtttctgagttagcattaaaatatcatgaggcctcaagtggaaatagaaattcaggagcaacatacttcaggcatacagggtagtggttttgagggccatgagcctccaaacttaacattacagccaccactgtggggaggtgctgctttcttatgagaggaaggcaaattccaagacatcctgggaagtgatgggctaggggaggaaaatttgggtgttcacacgtctgcatcctcttttcctgccctccgtattcgctctggagagtggctctcctggagagaagcatctggctttgttgggaactagcgcgggcagctgctctgcctactgcggttgcctctgcctttggaggaggacaggtgttaggagacctgtcagttagggtttgtggagaggggagttttggagggatttattttgactggtcacattattcttggggtacgttctctggatttactgacttatctttaaggatccctcagggtcgagtccctgccgactctcctcacaatcaggttgcagctagtttactcatttcctcactgtgccactctgtgccacctggagagtcctgttaggagggaggcttgagtgccctctgtgctcagccggcacctggcttctccgccatcatcagttggctgctgctttgcgaaatagtgtctttctccacgctgagtcattactgaacttgcttcctggccctcacccactttgtgtctctttttttgggcacttaagattatcaaatttgagttgtcattttgggatctctggggagtctatcc

SEQ ID NO: 113048 - DNA, 8741 bp, Homo sapiens
ggtttaggtgaccagtcaggagtgccaggatggcccccacaggctagagtctggacctgtggaatggagtggtcatggggccctgcggggcagaccaggtatctgcctcagagcctgtgtctgagatgcagcatcacctgattcagcactggcagccccagtccaggaatcacttgctgaatgcttcactttcagtggggagccaggacagaagtgagcattaatacagcttgtggaagttttacaagctgtattaaagttggagccctgagcaagttggatccctgctcttggctgagtaggagaaataaatcccttcagtttgtccatgtcagtgtcacgtagataaaatcactcccgtaatataagggtgatgaaggtactctgacagactctgggcagcctgttgacagtaatttaaactgtggaaatgcatatgtggaaggactttgttgaggcctggggtctgtgattaggaagatggcctttttttggttccaagtcgggagtgatttgctcttgcacatgcagtcttattttgagtggggtgagttggaaggcaccactccaggtgttaaaggtcgggagagattgtgtggcagtaccaggaggagaaacttgtgcttttgttcctgggatcatgggtatatgttgggagagtcagtccccttcttggctgggactctgtttcttagattttttggtaatggccggggtcttatttccttttttttgtttgcgtttgagacagtctcactctgttgcccaggctggagtgcagtggtgcaatcttggctcactacaacctccgcctcctgggttcaagcaattctcctgccccagcctcccgagtagctggggttacaggcgtgtgccatcatacctggctaatttctgtatttttagtagagatggggtttcactgtgttggccaggctggtctcaaactcctgacctcaaatgatccgcctgcctcggcctcccaaagtgctgggattacaggcttgggccaccttgccccagcccaaggcctgattttcttttccctctctccctctttttttttgtgaggtgtgagggttggcgggtttctccctctggttctcagagtctgctgcgcctgccctgcctgtgtggtgccctggttctaatggcctccagcagggatgggcaggtctggttaagggaaagtgatttaatgactaactcttgaaatgtatgggtcagtgtgttttggtgttggctgcaggccagagtggtcagaggtggtgggcagggcacagcagggtcccgggaagcagattttgaaggcttctacagtgttttcatttgtatctattgcctgttagcaggctttaacaacttctagttaaggttttattagcagtgacattcaggttttcagcctctggtgatgacctggggctctaagggttggaagaggaagacatttggggccttgtggcacacttcattgtctgtggctgaaagggtaacctggctgccttgtttttttattatccagggttgtgtctgaagagaaatccctcatgttcatcaggcccaagaagtacatcgtgtcatcaggctctgagcctcccgagttgggctatgtggacatccggacgctggctgacagcgtgtgtcgctatgacctcaatgacatggatgctgcatggctggaactgaccaatgaagaatttaaggagatgggtgagagaccatgtattctattattttattaaccaatgatgaatagagacattttaggcaggtaggtgagtagcagaaagctccttattgccagttgcaggcagctccatcatagctttagtcagtgagaatcgcagccctgccttagatctcagcctgtttggctgtgtcagatgtgctgagatggtttcagagtggaagcaaggctcctcggctcaggcaccagggattcccatccccgctctgatctaactccctcattcacttaccttaaggaagctgaagtccagggaaacgaagtgacaaaagggcatggcccacagttacctgctctagtgtttttttcctgtgatgccattcggattccttctttagccgtggtttgctgcttctctaaatgaacactcttccaggcatgctccccatttccaagcacatcatgtgtgttttaacttgagcgattttccttatgtcatgctgcaaacctggagttctttttccctccgtttatctctgtcctggctttccttcagtgaagcctgacattagctgtgtgcccagcccttctccacctcttttctgcaagctcattttagcgtatgtagacgttggagcatctcatggtgttgagactgggatggcgtataggtctcatctcacatgccagtcctgattgctaagggttgccttgagggtcttgatgaacaagacagtggagtcaagtctgggctcagtgtgaaaaactgtgaggattaattagcttttgtgctgtaggtacacggtggggaggtggtggcaagggccatgtattgtaatctaggacatagtaaataatcacaagatcggccgggcttgttggctcatgtctgtaatcccagcactttgggaagccaaggtgggcagatcacctgaggtcaggacttcaagaccagcctggcaaacatggtgaaaccccgtctctactaaaaatacaaaaattagctaggcgtcgtggtgggtatctgtggtcccagccactcaggaggctgaggcagaagaatcacttgaggtgattcttctcaagtcacttgagggggtggaggtttccttgagccgggattgtgccactgcattcccacctgggcaacagagccagactccatctcaaaaaaaaaaaaaaatcacaagatttttgtcatggtggatttcacagccttgaagggccaagaccttttgcgtctttccagggaacgtagcatagggtgtggcttgcagtagatgcttgtcctgccattaggctcaccacctgttgaatgggagtgataatgtagactgagctgagcatggtgttgtcttctactcgctcagttactcaagtgtttttatagacaaaatagacttccttcttcttggtcctgctttaggtattaatggccaaaacattagcaggccacaaggtggttttatggcatgagttcaggagttctcagagatcttttggaattgaatactaaattttagcttcacagatgatacagtttctgctgtgttgtaagcacattataaagaccagtgtaatacacttgactggaatctaggtgtcctgtgttaagtcagaggactcagcccaaagactcttcgcatttatgaatggtttaaataataagaactgggctaatccatatttgaagatactgttgaatacattggcaagattaattttgtaattttataacataaacggaacgcatgcttaaatatgtttgtcttagctgttattggtctttttttctttcttttttgagatgaagtctcgctctgtggcccatgctggagtgcaggggtgcaatctcggctgactgcaacctctacctcctgagttcaagcgattctcctgccccagcctcccaagtagctgggattattggcacctgccaccatgcctggctaatttttgtatttttagtagagacaggatttcgccgtattggccaggttggtcgtgaactcctgacctcaaatgatctacctgcaaagtactgggattataggcatgagccatcgcgcctggtgtttcagtcttttttgcatttggttaactatgtttttcaaccttgtagaagtaagaggatgaggagggataaaccatttaaaaatatttgagtgcccaaagtgaaatctgttttgagagaactgttttacctaccaagaaaggcaaatttttaaaaacatccataccattatatgaagtcatggttttgaagtcacttacgtgttagttgttatgtgtaatgagtataatgaaatgacttattcaacaatgtatgtatttaatatccttgaatccttttaaaatttaccttttgcttttccatttactacactgcatcttcactacctgaccataggaaaataacagtttcctggaagactctcccctttgaagattgtttcttagaaggatctgataagcatttaataaaaaattttggggccctcagagatggatgcatcgatgggttgattgattgatagattgagacacggtcttatgtcactcagcctggatcacagtggcacagtcatggctcactatagccccaacctcctgggctcaagcagttctcccaccgcaggctcttgagtagttgggactacaggtgtgtgccaccacgtctggctaattttcatattttttgtagagatggggttccactatattgcccaggctgaccttgagctcttgggctcagatgtgagccaccacgcctggccagtgattggatttatttattgtacaattatttattcattatacattatttttaagtataaataaaccagtactattttgtaatatttattaatatggatttattaaaatgggttttgtggcatttttaacttcaggaatgcctgaactagatgaatacaccatggagagggtcctagaggaatttgagcagcgatgctacgacaatatgaatcatgccatagagactgaggaaggcctggggatcgaatatgatgaagatgttgtctgtgatgtctgccagtctcctgatggtgaggacggcaatgagatggtgttctgtgacaaatgcaacatctgtgtgcaccaggtatgtggggcagggaggccagaaagaagaaacctggggcatgagcctgtctgctgtgggagtgtatgcctggagtccaggattcttcctccgaatggggtctgtgtttctacgatttaaagaaatgtgccctatagactttatttttccctagtaggttcttacagtgattgaaatatatcctctgcttttgcagccagaaggatagcaccctctgtggaaatcgtctttcttcacagtgttttattcttatccataaaagtcaagtttacttaaaaagaatgtatgagccccctctgtcctactgtaacacttaaatttaggtattaagaacactgagaaaacaaacctttgaaaaggtggttagtgtgctgtattagtttcttacagctgccctgtggaacagacaaattactacagactgtgtgtgcttaaaacaacaaaaatgtattgtcttgtggttctggaaactaaaagtccagaattgaggtggtggcagtgctgtgcttcctctgaaacatgcaggagagcccttccttgcctcttcgtagcttatggtgatttgggcaatcttgggcattccttggctcgcggctgccttcatcatcatgtgtgttctccctgtgtctctgtcttcacatggtggtcttctttttttttttttttgagatggctggagtgcaatggcgtggtcttggctcactgcaacctccgcctcctgggttcaagtgattcttcctcctccgcctcccgagtagctgggactgcaggagtgtgccaccacacctggctagagatggggtttcactatgttggccaggctggtctcgaactcctgacctcatgatccgcccaccttggccttccaaagtgctgggattacaggtgtgaggcaccgtgcccggtccacatggcggtcttcttagaagggtaccagtcgtatgggactagagacccaccctacttcagagtgagctcatcttaaataattacatctgcaatgactacttctaaatctaaagaaggtcacattttgagatatttggagttaggacttcaacatgtcttttagaggacacaatttgccgtcatatttgtgagcatgtgttagggtataagctgagctgttagaggaaagcagccccttttcctgaagacgatttcctgtcttaaaaaacaggacagtaggttttggtgattgcttgctaccatccacagaaagggaaacccttagatttcaggaggatgggcgctaggtaacttaaaaagtttatgacaatctcagtgcctcttttttatttagtttttaatgcagtaatgaagaaatttggatttgggtggggacatgtgcccacgtatattcttaggatttaaaaggctatcctgaagtactttctttaaattcacctgttgatgctgagatttaaagcaaacttaaaagaaagacttgtatggaataggtgcttggtgacttcttgggaagaagaagcacgtttgctccatgaagttcttgattaccctttgcttcataatttgtgacctcctaggctttccctctgtctgaagacctccccagctgtggcccagtcctggctccttgatagggagacctgcgactcctgcttcagtcatcgccgtctgttgctctggatctcacactgtctgggaagtctccttacggtagtgagaattcctgtggtggctttgttctgtgacatgagcatcctgatgaccagtgttgcttttttggttgctggtgcttcatgtatttacttggctgacttctcagtctttttcttgtctttacttgctatttttttccccatgaaaaatttttttgagtaaaagctttctgcttgaaaactggtcaacccctgtgttatcagtgagttaactgatgtcagggcaggcttgtgcaagctctcacggtggacgtgtggcagagttgtaacttaaggcttttggatgcccccttctcaccttctcttctttctgccatatcaccttttctcttttcctcaacatttacttcatttttcctttgagaaatccttcatggcttatctttaaggcatactttatgtaatctcctaaattaatttagacctgcttttccaggaaaaaaatttcttccttcacatgtggctgtagaatgtctgatacagacctttagtgttttgaaacctttatagtgtcacttaactccattaaaaatttttttctagtaagtctgcgttgacggtagcttatttatggcccccaaacagcactctgaggcttccatctgaagtgtgacttttctttgctcaactctcatccttgtggtttcctctttgcatcgtcgtgggtattcagattgcatagtggctgtgttttttctgtctgaagaattagagctatgctactgtgactctcgacttcctgacttccaggtcatttatgaataaagtgctgaacagttgggtttttaaagggctctctgaatatgctcctggtaccatcgtggtttttatttattcagttatttaacattaaccttttctgtctttgaactgtcttaattactttagttgtaatagccttgatttctgcagtttatgccatcttgtttaattttgccatcttgtacaaaacaggctttgttttattttttaatttaaattgttttttttgtctccatttctgaaaggctgaatttgttttaaataccagctaaggagacgacattcttcctgtgtagaaggtctcctttttctgccctgttttgttcactgggagagtgctgggatctagttggtatggagtttgcttagcctagggagtgtgcatgcttctctcctgttccattgccatctcattcagcagctttgggagattctctcagctgctgtatgctttttctccacactctgtattccaccccacctctgtcagtaaagtagagaaatagcttctctcacggaaccctgtggagtgtttcgaggacttactgaggacttactgctcaatatttagaaacttggtatggatgggtttctgcggcaacacagcaaagcagatttcatttaaacctttctgtcctcaagtagtttccaggaccaccctctgctaaataaatatgtattgtgtcagcagagctcacctctattatgaatacatattcacctcctaaatgctcctgtgaggctgccgggcattttcccgaggggagacggtcgtagccaggaagctgtgggagcgtctctgctttggtggtagttctgttaaaatctttctaagtgtttaaaatgaatagatataatgggaaaaataacattttctctttctctctattcctctgggatgtgccgtggcatcacaggcctgttatggaatcctcaaggtaccagagggcagctggctgtgccggacatgtgccctgggggttcagccaaaatgtctgctgtgtccgaagaagggtggagctatgaagcccacccgtagcggaaccaagtgggtccacgttagctgtgctctgtggatccctgaggtacgtgtggttctttttttgttgtttttacttttttttaagacagagtttaactctgtcgcccaggctggagtgcagtgagctggatcatggctcactgcagccttgacctgctgggctcaagtgatcctcccacctcagccttttgagtagctgagattataggcatgtgctaccaggcccagcttattttttattttttgtagtgaggggatctcactttgttgacctggctggtctcaaactcctgggatcaagcagtcctctttccttggctttccaaagtgttgggattacaagcgtgagccactgtgcctggtcaagcatggtttttaatagcaccttagctcagaaggtcctggcttttaactgggatttagtgggtgggtggagaacca

SEQ ID NO: 113049 - DNA, 7248 bp, Homo sapiens
tcttattgtgcctcaacctttttaatttcaggtctggtctaatttatttctagtctcagaccttgactaatataatttgcatagctcagtgtgagaatataatttgctattcaaattccagcatgttttgggtgtgattttggtacattttcctcttggggaatattatttgaggatgatttggattgaggtttcatgattcgggtcttggtagcactgagtctcgtggtttggtattgatgggatacaattcggtgatccaggctgaatgcagagatgataccttatttatctttgtaatttcccatcttgaatgtagtcatgtttcagactgaagaaaatggttttttttggcgagagattaaaaacaggttatatttacttaccctgttgttgacaacctatttgaatcgatttaagatggatttttagtcttcaccaatttgttatgagctagagattatagacggcattgtcctggtacatgactctttgtcatcagacgctccggtgagaagtgaaaactcagttatctaagtgtttttgacagacagggatgtctgtcagatggggactgggctgtgagctcagttgtcactggggctgttctgaggcttttaaagtaagggtttgctttgagtgggtgccccttgccactgtctggtaggagagatgtaggaaagtaatggatcttttagtttctgacattcatgttcagcctttgacgacctgagccaccctgtcttgctgttttccgacctttaggtgagcattggcagcccagagaagatggagcccatcaccaaggtgtcacacattcccagcagccggtgggcgctagtgtgcagcctctgcaatgagaagtttggggcctctatacaggtaattagcttcctaagaatggcttcattttcctttcctgcgtggtggggagcaggatgagggaaggctctgtgaactgtccaagggtttggagaggggactagaatccaggaagcaggacgaggttcccaaggggtgactccagccccagtacacacacctttaataggctaactgtatccggtgtaactagaacccaagctttcacagtcacagggtagttcagaagttcccctgagctgtgaggcggttgcagtttgtctctcgctaccctttctgcccaaagtctagcatcgcaacttctttccataggccaacacctcctagcagtcttagtgagatgttccttgacacggcatttgagagttggccaccctcccacctgcagtcactgagtgtagctgcagaccctggcccacctctgtggcggcctcctgagattgcaggtttccatggtgtgcgcacatctgttagtaatcaaggggacatgctaatgcatttgcagttggaaaaacagagactctttgaacacggcctgggtagaggggcatctgtgaggagttcctgtgtatgctgtcatctcattggggcatcatttggatgtctgattctttatggcaccaggcgcgcatgcacgtgtgtgtgtgtgtgagcgtgagcgaaagagtgcgtgcacacctgtgtgtaaacatgttgcctgcctgcttttgcatatccaggtacagacaagtataggatgtcatgagataggggaattaaggagggaatatagatggcatgctgtttttcatgtggtctaagaccctactgagaagttcgtttttaggcctcacattattgacatctagacagtcaggattagagaggcctgcagtgctgtgtggctgatgggggcccttcaggttaagtttggatcttctcggatgtactagcacaggccacaggctcttcttccttggtttcctcattgaattctgggagcagaggcactgttttgggatggcttctttctcaaagcagctcagcacagacataagctccgagagcatggtcatcctgtcagccatgggttttaaagaaatgacctcatttggcaaagtcggtttgtattttgactgataaatactttttgggaaggtggttttaaaatttttttttttttttttgagacagagtctcactctgtcgcccaagctggagtgcagtggcatcatctcggctcactgcaacctccgcctcccgggttcaggcgattctcctgcctcagcctcctaagtagctaggattacaggcgcgcaccagcaagcccggctaattctcatttttgtatttttagtagagatgggggtttcaccatgttggccaggctggtctcgaactcctgacctcgtgatccacccacctcggcctcccaaaatgctgggattacaggcttgagccaccgcgcctggctatttttaaatttttttaacaagccaagtggttctacttttcttctttatcactttgactagtgttcaagaatccaaaatataacagaaatatttggagggtgggtcatgagacagctggtgggatttggctggggaccttgaaatagtggagatatttttggcatgtgaatacatgacaaacgcctctggcccgagttggattggggaaggaggaggaaagagtggagcaggaagagaaaagggcagggagctgatgaacttgagtgtgtgtgtgtatgcatgtgtgagtgtgtgtgtatgggtgtgtgtgtgagtatgcgtatgtgggtgagcatgcatatgtgtgcatgtgtgggggtgtgagtgtgcatgtggttatgtgtatgtgtgtatgcatgtgtatttggttatgcatatgtatgctgtatgcatgtatgcgtatttgagtatgcgtgtgtgaatgtgtatgtgtgtgagtatgcatgcgtgagtgcgtatgcgtgtgtatgcatgtgtgcatatgtatgcatgtgtgtatgcgcgtgagtgcgtgagtatgcacatgagtatgcatgtgagtatgcatgtgtatgtgtgtatgcgtgtgagtatgcttgtgtatgtgtgtatgcatgcgtgtatatgtgtatgtgtgtgagtatgcgtgtatgtgtgagtgtgcatgtgtatgagtgtgtaagtatgtgtatgcacgtgtgcactggcaggaaacaggctgcagcagaccacattccccggtgttctgagcgtagaatttatgcccttgcctgagtatgccaatctggtccataattaatgtttaaaagaggtgggcgaatgggatctttgtttcccttttgaagagagatgatataatgacttttttgttgccattgacctctttttcccagaacattaatctaaagaagaggccaaagaaggctgatgatttttcatatcttcacagaatggattgattttattaaaagaattcctctctgaaatgtctgcagctgtgaaggctctggtttacgtttctgtaacatctgtttgctgagtcaacctgaatgggaaaacccagaggaaggccatttggcgtttttacaaagtcctgtataaatattctgctgcagttcatttctctttagggttagagcgcttgggttaagtgtagtttaagccaaacacagatagtgtctcagtcatctgttcccacttttacttcccacttggctgtgtgctacaagggaagacactttgtcttctcatgacagtggccaggtgtgtatgtgtgcgtgcttgtgtgtgtgttctgccaccaaagctgatttcatacatttcttagaattgaggttatttatagagaaaatacagatttatgtcagtctctgtggttgaagtgtttgtaagggtggaatggtgaagggagctggattttctcctcttctcagtaaaagagacctcatagtaatggaagaaagcctggttggcagtgagtttcctcttaaatactggaatgattagggggaaagcctcagctctagcctctgccatccttggtgatgtgattcaggatctgttgaatgagttgaattcaacttctcagttggcttgaagccgctggattctacagctctgtgcagcccctggcatgccccggtgatcacttggcttcacacaatgcagtgctgcttttcagggactggcttcagtcaccatgaggaaccaccttctagggatttgctcagcaagatcagtggaggaggagttaatcactttgctcctgctagaccagaggcttgttgtctggatcaaaggcactaaattgtggccctgtttaggcagtgagaggggaagtgttcttctgcataggttgctgatacctggcctctacgttgacctccctgtgacgcatgggaaggatctttcacggttctcctgcctctcttcagtggccaggatcggcgtgcaccgatctcagggctcagagccctccatgcatctggtgaagcttcttcgcaagtgtgaagacctttccctacctttcctgtgctggattcctcttgtctcctattttttggggtttttattcagtttctccttcgtgctgcttcaaggaagtgcactgttcattttctcactcgtgttgggactcttcctggctggggagtcaggatttatgttcaaactgtgagtagtagtcattcttcccaaggaggttcttattcaggtttgcaccaaaagagctcaaatctgtaagaaaacccaagttaatgcctgaaagtggactttgcatattgagtacagattcttttgaatatgatcctagtgccacacctcctttctctacacatgtcatttgtgtaatcatgtctgctccaagatgggatttggatgcagttacttttctgaggaagttagggtttggttgattaaacctttcatttgaagagggcccttaaattccaagacttggctgggcgcagtggctcacgcctgtaatcccagcactttgggaggctgagatgggcggatctcttttgcccaagagttggagaccaacttaggcaacatagggagacctcatctctataaaaaaaattccaagccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagttgactcaggatggtttacagactgatttagaaaaccagaacggatttcatttctaatggagggggccagagatgggaaaatttcttgttcagtccggggaaacacacctaggtgctggtgatgggcttatgaaggaagctaagcacggctgctcactggcccccactttgtttcttgggtaattcacaggggaattcccagtactgtcatggagcagagcaggcagtgggtgctgatgtgtgtgcatgagctgtatgtacacatgcatatatctgttacagaagatactcctggcagtgaggtgctaagtcatcactgaggctgtgtgtgtgtgtgtgtgtgcgcgtgcccgtgtccatccatgtctctgttgtgtgtctgtgtgcgggtatgggtgggattcctggtggacaggggtgtcagatctgtctgaggagccccagtcatgctcagcacgctacagatgtgttgtttgtcacactgagattgctgaatgtcgtggctgttggctgccgagcctcagctgctggcatttccttctgctgtttgctgcttttgtgcctcccccactttccatcacctctggagtcccgtctggacgtcccttcctgctacaggaataatgaggcgtgggctgcctcccgctagggcctcctgctccctgtaggtagtttctggctgaggcttgctaattggggatgcttcttagagcatcttccacatcaactcccctggctgctggctaccgattaaattcattagtgtgaaagaggtgggagtgaggttttctggcctgaagcagtctgcactgaaaggtacccaagtggcctgaaacagtgtagggaaagacctgggaaacactggaccaaaaaagcctgatctcatggagacctgcatggccctgttagagatggcgtagaagtgaaagtcttaaagggagcattagagatccttttaatacacgactgagtgccagcttatttgtgatgccccttcccagaccaggttaggattcctgggaaggccgcggattccggccctggaagaggcaggatcctggagcagttttgtgaggcttttgtgctcccatacgccccctggtggtgagtgtaaagaagactttgcctctcacaactacatgtatgtgtggcatttttgttagagatgagaaaaggattgagaaggataaactggaatcctggtaagaagcctttatgccagcccgacacctgctgtaattggggtgca

SEQ ID NO: 113050 - DNA, 1449 bp, Homo sapiens
cactgtcgctgtttaagtagaacaatgccaacgatgtatgagaaacagggaataaatcaggatttgtgtgtgtatgtgtgtggcattacttacatttactttattaaaaagcctaaggaactttaaagaatttgtattcagtttatttttattttttcaagacagagtctcactttgttgcccaggctggagtgcagtggcgtgatctcggctcactgcagcctccgcctcccgggttcaagtgattctcctgcctcggtctcatgagtagctgggattacaggcgtgcgccaccatgcctggctaatttttgtatttttagtagagacggtttcaccatgttggtcaggttggtcttgaactcctgacctcaagtgatctacctgtcttggcctcccagagtgttgggattacgccactgtacccagccttagactcagtttaaaatgggcttattgtaatgaaaaaaaatacgctacccaaaatttgccatgatgcctgtgatggtgaaggcattaaacaattgaaatctttgccttgcccagagagttgcagttatttgtaattataaacagtaagtgtatcagggcaggggtgacaataaaaaaccaatcattactaccaacttgttttctcaagtaagttagttttctgtttaattcacacaatatcagtttatagcagatcctcaaaaatcatttaatacctgtgactacaatcaaggcatatgatcattctcagactgacaaataagtagccatcattagaaatgcagacaactgagtaattatggtgactgctcttccttcagacacacacctcggggcattgcatacctgggtaccagttctggatctggaagttaggtgacaggagtagatttcaggagggcttgggagcacacaactttaagaagacacagttgctgatgtggtgggtagccatgtcattcccaaggctgccacttcactctcattcctttcccctaaaagatgcagtaaatgtgagttcagcaaatgagtatttattcagataaagacgtgctaccactgcactctggctagcgttatggaaagtggccaagtcctgggggcagtcctgtagtcactcagtggaatggtcacctttgaaaatctggtagtggctacagtgtcccctgaacaaaaggcacgttcaactttagtgctgcaaacagttttggattcaagaaaacactgaaaccacttttagatgtcttagagcagtgtatctcagggtgttgtccctgacccagaaacttaggaatgcagattcatgggccccacctccaaagggtggttctgttttgtgggtaccccatgtttctgtttgggaacactgctttaggggaaagggatgatcaggtttaaggtggtgtgagagtgcacctggagatggtttaaatgttttttaagatacctccttgcaggc

SEQ ID NO: 113051 - DNA, 9438 bp, Homo sapiens
tgaaagcctgtgttctgtctctcttaatgcttcatgtcctcttgcaaatgagactgccttcagcacagctggaattattagggtttagtctacacttacgctctacaccagagtgcaaaatcttttgtgtcttcacaaggcttgttgatgcttgttgctgtcctcactgccaaaagaaaaggttggtgacctttggactttttccacttaaagtagggtgatactactttattgagtttatggggaaaaaattataaaggtgtcaggggaagagtttgctcataatgggatatttttaggaaagtgaaggcatgcctgtaggagctaatgggaaagatgtggtcagataaagatgctaccactcctgccactgagattacttaggaggtcttgtccacatattcctgaagaagggtttaattgtgtatttggtgtgctgtgtctgacatctgtgtttgcaggtccgtgtaatctaatcaggttgaccaatagaagattttaggactgaaggattaggggagtttagagactaattctttaagttttgtgtattgagtgatgacaggtggggaacaaatctaaatgttgattactgagcataggttagggttatgtgatccaaagcagtcacacatcagataggaagtagagccaactcttagcactgggtcttttcagttacaagcgaatcgggagagggcaataccagtttttcaagtgatgatgcagagaactggactggagatgtctaaccagcaaatcattggcaaagctggaaatttcctaggcattcgcacacctcatagcaacacataagctacctgctaactccaggcctttcagtgagttcagtgtgcagttgacaaagacatttactaggattcttggtaaccatttggtcttccagtgggcctggtgcagggggctccactttgatgacccttggccccatgtttacccagttcagcctcagaagatagttgataaagtgcagaagtggcttctgaactgctttaaagccattggccatccaagtaatagaagatattgatgcaataattagcaaagtcgactggcaagaggttgcaagttttgacttggacaccaatggcctctgtgccgggatgggttaggtgtgatggaggaggcaggacttttgtaggagttctctaggtgtccctcccactcctgtgggtccctaaccctcttcgatgttgcttctgcctatgttgagggctatatgtggaatccttcttatctgcccaaaaggagatcagagattggataaaatgtttaaagtacctattgatttcaagtatctgtcaaggccctagtaggagtaatttctcttaggtaaagaaatttaaaaagcaccaaagtactgttatactgtattgcttacttagaatctttattctctacattctaggttcggaacctcacttacatggtgacccgcagggaaaagattaaacggtctgtgtgcaaagtccaggaacagatattcaatctttacactaagcttttggagcaagaaagagtttcaggtatgcattaagccctggtaggtcaaagtatagggcaggggtttgtaagctttaacactgttgaggaagaaataatcatttcttaattttcttatagaagaatttaagaagcatagacgttcatatttaaaggaagtctttaatttgaggcatcatgtttaagggaaaaagctatgaatttgccctctataaatatgggtggaatcctgtgttctctgcttactgagcaaacacatgaaagtcttttgagtctccctaatttcttcatgtgcaaaatggagatatcgcaagctacctcttggaattgagagactaaaatgaaacagtgacttatatattacacagtacttggtaaacacatcatggggatacctaacaggtttatattcagccttgggctctatctgtaacatggtaaatatggtcaatatatgttaagactgtacttaagacacagtccatttttagataatgttcacagtagattttttttgtgtagatggattgttgactatttctgagattgagcaccaaatatttatttagtgtcttctattttatattgccctgggctaggcaaacagaaaaagaaaactagggtatatacttcctctactctggacaacacatcagttacttgggagatcaagggcaaagatcaagttgggcaggttgtttaacctctctgagattccgttgatcttaaagtttgttttagaatcaagaccccttaagtgcatttgagccctatattctgtgatcataagcccccaaaagtaggtagtataaggatttcagagaagcagagctgctgagtgtggatcaggcagaattagggacccatggaacaggtaggtcttagactggacttcattggaagatagtcagcctctctcctgccttggactgccctttaaagttctagctgcaccattcttggtgcttgcgttgtgcaatcatagttgattcactcttgtttttgtgcatttgtggctttttgtcactccatctagattattatggtgcacagagaacaaagaagttgttataacctgttgtgttgaaatccaaattctggtttatctaaccaattatgtgcgactagagggagctcggtcatctgaagaaataaaaaaaggtttagggaggtttaaataatgttcttgaagtgttacatagtttgaatgcaataacttgttgatatcctagatattttcttcccaagattaagtattttccaggtgaatcaagtgtatatcattagctggaacttgcagtttaattgttaagattttaaaaataaattttctaagtagggtgtcatatgtaaaagtaggtcgattcagattccctaaggtgagctctctcttcatgattcctacctgaatacaaataaatgagatctgtttaactgccttggaagactgtctggtgcagatcaccgagcctacagcagcaaatgctgagctgggatcactaatacaagttgtgcctgtggagttgtgccattggagggctttctgcaactcttaggtcattatgtaatgagtgattccctgtaaaaataagccgtaaagagcattttcatctggtttcatttgagttatttctcatggatattgcaggcaggtttttgcatttcatggctgaggtttttactgggtgagcgaatgatattcttaataagtctgggagttattttgtggtaacagagctgtaatgtagatctgcattcagaagtcctactatttcagaaaaggaaaacaaatcttcctttcattctgatgtaagaaccataggtatgatcagttgaaaacatttatcttcctgtaggattctgttgagtaatgcagttgaaaccctttagggtgctttttttctttttccagtcctaggcttcagtcgtgttcttattcatgcctaaaggctgtctcctgcctgaagtagagcagatggtcatgatttatatgtcatttagggtccatggtttaaactctgtgattctgagagtgggtagggtcatttgctgagagtgtcctcagtggcaacagtgcttatggggggtgggagggtcatgagttggaggctctttagagacatggattacagtcaaggagatagaaatcagagttcagaaaatgttagcctcttcttaccattctcttttcctgtggcaggtgattgagtaaaagaaatatatgcagtgtgatgtgaaggttgattctaatgattgattcttgagaaagcagcatttccaaaccagcaggttgtaaaacacctcctgtggtcatgacagctctgtgttctgagtcgctagctatgtttcatttgcttgcagtgtctgtgtctggtgagcactaggttctcatatggcctcctgtctcataacctgggggctgaaccttgttttcttggtggctcatatcttatgggagacagaaaacatgagaactgctctttctagatgatcttgaggctgttgtagaatcatggtctttatgacaaacactaatgtgttatgaattcacctgctaggggtaacaactcattagtgggttgtgagatgaattcagtgggtcatgaccagtattaaaaacaagtaaagtataataggaaatgtcagagtacattatcaaatgatgagggttaatattatttcgtgaaatgtgaactcttactaggtcatgctgtggaatttagtcactgtgatttgcatcaaaaaatacgaaaaacatcaatttaacttacttcaagttgaatgacaattcagttgaatcccacaaatgtattttgcacataataataatgaacatttttggaacgcttactatgtgtcaagaattatttcacacatttcctttattcattcacatgtttacatgtacttgtcctcgtaatagccctgtgagggtacagacacatagagaaacttacaagccccgagccctgctttttgggtcctctcagtctcgtacgggaggcagaagactggaccgtggaggagcgcggcgcaggtgctgctctgtaaccaggtagagggagcagaggcagccatcagccacctgatgagttctgcatggagtccgctctgaaaatcagatcagttattttgtttggaggaggtctagttttatgaaaaattatgtgagcttcagctgttttagaaaatgtggcatattgagtctgcagattgaatggagattctcaaggcaggtcatctcttcactataaaaaccaaatttgtacaaacttggtggtgtaagtgttgtgttgttgggtggggagttcacatcaattgggccacactaagggtgtagaattttattcttttggatttgcttctgctgtaatttttctttatttgtggttttatgtttataggtgtgccttcttcctgctcctcctcctcactggaaaacatgcttttgtttaacagtccttctgttggccctgatgctcccaagatagaggacttgaagtggcattctgcattcttcagaaaacaaatgggtacttccttggttcattcgctgaaaaagccccataagcgagatcctttgcagaatagccctggaagtgaaggcaaaaccctgctgaagcagccagacctgtgtggtagaagggaggggatggtggtcccagagagctttttgggtttagaaaagacctttgcagaagcacgtctcatatcagcacaacagaaaaatggtgtggtgatgccagaccatgggaaaagaagagacaatcgttttcattgtgatctcattaaaggagacttaaaggacaaatcttttaaacagagtcacaagcctctcaggtccacagatgtgtcccagaggcatctggacaacacaagagctgccacctcccctggagtggggcagtcagcacctggcacaaggaaggagatagtgcccaagtgcaatggctccctaatcaaagtaaactataatcagactgcagtcaaagtgcctacaacacctgccagcccagtgaaaaactggggaggattccggattccaaagaagggggaacggcagcagcagggagaggcccacgatggggcctgccaccagcactcagactacccatatttgggcttaggccgagttccagccaaggaaagggcaaaaagcaaattaaaatccgacaatgagaatgacgggtatgtccccgatgtggaaatgagtgactcagagagtgaggcatcagaaaagaaatgtatacacaccagcagcactatcagcagaaggacagacattatcaggagaagcatcttggcttcttgatgcaacagagatgatgcggaagccctttgggctcgtcattgggtttgctagaggagagctctgatgtgggggagaagcagaaacccattaatcctgagctacacaaacacatttacttgcaattcagattaatttttttccagagtcatttttaaatcatttttgtgagaagtttgtgttatttgcaacttgttgaggaaacagaagagtagattgtaaccataagacactgctaagactagaacccgaactgaacactaaaataaaaatgaaatgttttaaagaaggcaaggcttaaataagcctcatgaatttttatagccctctgcattcttcccaaagcacaaactcatggttacctgaatatagggaaccagatatggttcttgagaaaccctcatggtaccattcacagcccataaagtttattttctaggactgtggtagatcttgaaatcatatttatatttggccctcaaggctatttttgttgcattatagcatataggcagcagctctgaagcttcagtaacactaagaaatttatgtgtaaatatagcagtcagggaagagaattttaaaaaaggtcattattgaagaagctgaggggacagggtagagctgctgcaatatggagatttagggtaatatggcaaggtcctgctgcttgaagcctgtgagtgggttgtggatatgggactggtggagagtgagactgttaggaaagttgtatctatgaataagggcagttgaagtagaatttttaccagtccacttgaccttcttcttccctaaccactggctcttgagccagcttgggatttccctggccattgccaatacctggccatctggcttccaatagtacagtggctactcaagttcaagcgaagaacttccagactctggtgactgttacttcccagagccaaccactagtgcatatgttagggaatctgggcttccaacatgaatggattccttaagaaaaaggaaaaaaaaaaaaaaaagaaaaaaagaaaaaaaaaagaaaaaagaaaaaaagagaaaaaagcgaaataggttatattttaaaaacaatagaaaggcaataagttgcgataagctcttactattgaccaaggttatacaggaaagagactgaagtgtacccttgaataggttttctgtagtcagagttctaaactctaatttgtaacttggactttctaattgcaaatggcaataactattaagttatcagcaataataaatttagcattaaatttgagtacaatgttttgtttttgcactccccatagtgcgtatgtattaagacagtggatagtgtttaggtcctgttaattttctttggaattcaatgtggttgtgaatcaaacttaaggaaggaacgtttaaatagcaatgagatacagaattatgggcctttggaacaagcccgacttcccctaaattctccttagtttgttaataccagtattcagattcctgattcatttatacatctgtttccatatggcagggacattatgatacttaatgaataatgctttgaggagttctgcagttaactttcaagtcttccagatgattgtcaacaacaaaaaaggcttattgaatcccatcttgctatgcaagttttatcagatgatcaaatagtagatctgatacatccccattgtatgtacgacattttcaaaccaagtcttaacttttcaaggacattttagtagctaattcaggggagggggaagaatgatgcaggtttttagattgactgactatttttgagttatggggctcattttgaaagactgctgtccagatcagcttgttgctgcagataatagaaggttcttatgaatccaagttgtatattcacttgtaggataatttaaaaattagattttttttgcatatgagcaaaaaccttttgctggatacaggagaaggttggactttatctacagttatcttttgattacagcaacagctctgggtgagagtagaatttatagagggataatttgtcaagccatagaaagaaaatctaaattaatctagtaagtgtatgacctctcaccattttaagaggtatcagattcatttgcactattaggaatgctagttttgtgcaaaaataatgccttacctgttttttccccacatttaggttgaaaagctttcaaatgttccaagttatgctgaaccaaaaaaaacaaaacaaaaacaaaacaaaaaatattaaaaaaaacccacacaaaaacaaaacacacaaaaataaaaagcccacactttttattcctgcttcgaaatgcaaatggatagagcacggtttctctgacagtataatgatagctttgtgagttagtttcatgtcatgctgggaactctctatgaggtggccataagcagcaaccagcccaaacacccacttgcgttctattagtatggaaccatttgcatttgttttttttaagctttatctttccttgtgcatcctgaccaagaaatatctttgattatgattaatgtattatgtcaaaatgtaggctagttaaacttttgtaaagttgcctggaatgtcatttgttaggttataaacacaagatctaaatgaagggttttatgtgttgtgtacaaatcttattttgaaatggacaaacttgtcattacatttgtaaccttgtacagaggatttttcactatgtgcctagcttggtgtccattcagctaaaattgaaaaaaaaaaaaaggtgcatgaagagttaaaaatcaaattaaagtatatgtagagatgactattttatattacatgacccaatcctgtatttatttctaccccctttttgaaagtatttataaaactagttgaggacagctgtatttttttgttgaactatttagtagaattgtgcctttttgtctgtatgtgaataaatgctgtacattttgcaatacattttaagtgtcttttgaaatctgcttttgctaaatatttaaaggtatatatgacttagcagtcctgaatcagttgtttactgtcttccactttaaatcaggaatgagaactgtagagaacatatcaaatttgtgcagagcacagattcactgggctgctttctggctcaactctgatggcgagactgaaaaataacggtttgagtttagtcttccccacctggagttctttccagaatacagttttggatctgaaaacagaatcgttgaaacaacgtagacttcagggtcagagagaactgtatttaaaggctaaactatagtttaccaggcacatgacattggccaagtcacttaaccgttttaagcctcagttttcccagaaagaggataacatcttagtaacttagatattgaagtagttgtgattatttaaagcaagtccattgagcaccttacagagagcatatattaggcatttagtaagtggtaggctattatttttattaggaacaagacactgatgtttacaatattttaactaatgagctttctgaggtgaaaaaatattcctgaatgatgggacggttgtatttttaatacaacctttaaataatttttaaaaataatttttcaaagag

SEQ ID NO: 113052 - DNA, 1072 bp, Homo sapiens
ctccatttggatttgtaaagcagcgtggtagatactgtggaaactaaaaataatccttcttttaaaagtttctcctgggtacggtggctcacaactataatcccagcactttgggaagccgaggtgggaggcttgcttgagcccaggagtttgagaccaacctggacaacataatgagacatcatctctacaaaacacaagattagccaggcaagattagccaagccagctgcttgggaggctgaggtgggaggatcacttgagcctagaaggtcaaggctgcagtgagccatgattgtaccactgcactccagcctgggcaatagagcaagacccccatctcaaaacaaaaacaaaaaaaagttcctattccacttagaagaatgtgtgtatgtatgtgtgtgtacatatatgtgcatatctatacatatatgtaaaatactagcattataatacaggattgataaatctcttatacataaaataagtatttaatatcatagagatttgatgtgtaaagaaagctgtctggattaaaatgaatggaaaggagacctgaaaagaagggggacaagggtgcagtctttttttttaattttttttttattatactttaagttttagggtacatgtgtacaacgtgcaggttagttacatatgtatacatgtgccatgttggtgtgctgcacccagtaactcatcatttaacattaggtatatctccaaatgctatccctccccccccccaccaccccacaataggccctggtgtgtgatgttccccttcctgtgtccctgtgttctcattgttcaattcccacccaagagtgagaacatgcggtgtttggttttttgtccttgcgatagtttgctgagaatgatggtttccagcttcatccatgtccctacaaaggacatgaactcatccttttttatggctccatagtattccatggtgtatatgtgccacattttcttaatccagtctatcattgttgcacatttgggttggctccaggtctttgctattgtgaatagtgccacaataaacatatgtgtgcatgtgtcttta

SEQ ID NO: 113053 - DNA, 1050 bp, Homo sapiens
gacattaaggaaatttgcaaaagtattttaaaaatgctactcttctcaaaaatttttagttttggagaatatacttatttcttataaaaatattgttcaggttaatcggtaagaaattactttttaagagattagtaggtaaatgtctttaaattttctgttttcatttctaatatggtagattttcatagaacccattataagcaaaagatcttttttttaattgtgggtaaaagcatcctatgaccaaaatgtttgacaaccacggtccttttggatataccattctattcactctccttccactttcatggcaaattcttggctctttaatatattatgtgcttatttgtcttttatgccctaaaagttacaattttatttttatcaaaattattatcctgagtgtttttatcagatattaatcatttttattctagaaccaaataatgagtaaatgtcttaatttacaggttgcaaacaccaaaaaacaatgtaatatacaaatttctcgattaacagaagaactttcagcccttcaaatggtatgtttgactatactgatattttcttccaaatattacttattttaaaggccaagatatatactattggggattcattcattcaaaagatacttattaaaccaagccctggctaggtgctaagaaaaaagtgaaaatccagatagacatgtttgcagcagccttgtggcttatgttctagcaggaaagatagatggcatttatcacattttactgtaactacctgtctttgacagagaatgcacaggatgctattgctagctgtagctcctatcatatgctgagtttatctgggaaaccaaggagaaagagaaagtatatataacagtgggaaggaagaaatacagaaagcttcctgaaagaaatgaatactgaggaatgagtaggccaagaggggagaggaaaagaatacttgtgtggctagaggtgagattggaaatagaagtttaacttgaagatttgatgtaatgaaatttaataaccttgcttataggagaataaaagt

SEQ ID NO: 113054 - DNA, 1072 bp, Homo sapiens
aaaaggtttgtgttagagatgtaaatatggggattgtcagcatataaatgatatttaaaactgtgagatttgattagaccactaagagaaggacagatagagagggggacaagaagtgaaccttgggtagtccagtattaagaggttcaggagatgaggaagaatcagcaatgtagactgaagaggaatgatcagtgagataggaggaaaaccggtactgtgtgtgatgtgctgaaaatcacatgcagaaagtacaacaaggagaggaaagtaaatatttcaagtgctgctggtaaagaagtactgaaaatttacttatagataatcaatatggagatcatggtggtgaaagcctgattcaagggagtataaaagagattgagaggaaaagtcttggagatgaacaagttacagagttttgcttctcagagaagcaaggaaatggactgtgactgacagcagagctaggattatggcaatatttatttggtggaggatggaaatgattggaattatagaaatacatcaaagagacaaaacaagtagtgtctgcaatgatcaaattatgagttaatgagtgacataatttgaataatactaaataatggaaagagagagaaattcaagagattcttataaggatacaatacctagatttgattatttactttatatagggacttgaaaaaatggaaaattcaacaatggttttaagatttctggctgtagagattagaagggtgttagaaacactggctgaaataaataccatagagaaagtgtctttagttaggacaagggcaggtgaggaggttagggaaaataaatatcattcgtgatttcaacatgatattcaagtagagatgtcccagaagttttgaataaggaagtgactagtggataggttttcacctgttattatctttactaataataatgttatctataacatgaaatgattattttctgaaggctctacttgaggagaagcaaaaagaagaagacatagagaaaatgaaagagacagtttctcggtttgtacaagatgctaccataagaaccaagaaagaag

SEQ ID NO: 113055 - DNA, 1057 bp, Homo sapiens
taacattctctctctctttctctctctccctctctttctctctccctctctttccctctccctctctccctccctctccctctcctccctcccactactccttcccctcccctctccctccccccaccttttccttttgccctctcattcatttatgattgatttacttgtctcctatgccccaggtactatgctatctcctgaaggtttaaaaattaataagatgtgatccttgcttttaattatcttacattgtatattttttatgaactcacagttccacaaaggagaatctctatagtattgattacaatacagtgtgttcaattaataatgtataaagtattatatattataagtattgagatatagggtttttgccaaggagaagttagtgaagacttgaagatggggagatttttgatctaggtcaaaattaaggaattggttagaaaaagaagaagactagtccagccaaacatgtgaaaaaagaaacaaggatgtgtttagaaaacagcgagtgagtactttattatacttggaatataaattacatgggggtaattggcaagagatgagactctttgaggctagatgttgactggccttatatgccagtagaggagtgtagacttatatgtagaggagtgtagactttatgccaaaaagtgtggaatccaggaatcattgttaaataggagtttttattactagataatttttttaacagataagatacattataaagaatgaacaaaagaggagaccatcagtgaagagatgagtttggaatctactggaatagtcttatgagtgataatgaagctaaaggttgggccaaagaatgaaaaaggaatacacaattgaaagacaacttagaaatagactcaggccaattagattgaaataaggaaagaatctaattctagaattttggtcttggcaaattgcctaatccacctctgtttttggacatgaggtctttgagacgtgcagcatggtcaagtgaattgtattaagacatattactagttagtgacagaattgggtccctgcc

SEQ ID NO: 113056 - DNA, 1136 bp, Homo sapiens
agcctcccattgttgaccatttttatatgtttatttacctatgtggttttcttttctcataaaatgcttgttcatatattttccccatttctacttatcttgttcttattaaattgccaaagtgcatatgtgatctgtattctgaaaatttgttgatgtgctggtcagtctcaacacagtaaacaataaccattctagaaatttgaaacaagaaaggatttaattcacttacatttaagtgctactaaatcattagttttacagttacacctcagagactataatcctggggttaggaatttatggtgctaccaccatccctggtgctaccaccatccctattactaccatggcagcattatttccataaaactggagacttgatattggaaaaagggtcataggatattgactacaagagacatttttgtctatccagttttacttaccagccaccatatcaacagaaaaaatggtctcagctcacttctaccttttatatctcccttaaatgcctctcactggtaaaattttaatcttatccacaacttcagctgcaagacatctgggcaatgtagttttggactttccgcccctgggacagaggccagaatgtggaagggaacagaaataaataatgagtgccagtggttcatacaacacattagataataggtgtttcaaatgtatattcccagactgtggtgtgtttgatgaacagaatttttttttcttttttttttttaacttaaagtaaatctctcactcttctcctgtggttattgttctttgtatctcctgtaagaagtcctttctcagcctaatgtcatagagatcttctcttatatttgctactaaaaaatgtttaaagcttttccataccaagtttcttaactttaacccataaaattcatataactggactgaaatctgatacatcattttttgttgacttttaactagactaaaaatccaaaattttttgagttctaaatttattcaaaacatgggctcttttaaagtttgacattcttttatttgtatttttctatgttatgtagtaattttattttattttgattatatttatttttattttagtgtagctatatttaaattaatacatgctgttcctt

SEQ ID NO: 113057 - DNA, 1012 bp, Homo sapiens
ctaattttgtagttttagtagagatggggtttcaccatgttggccagggtggtctcgaactcccgacctcaagtgatccatctgcctcggcctcccaaagtgctaggattacaggcatgagtcaccgggcctgggctggccttgttattaccaagacctctcacctttattctgggtcttcttcccccattgtctcttacccactcctgtttaatttggattcttcagcctgcaatttctccttaaggtggaggtttgtcctggaagagtttcaattggttttaagaattctaaaaaatatgactatagcttatcttcccaatgcttctcaattttagtagtagtaataagatgtggagaatatattttactttcattaacccgaagagcaagccagcagagactgagatttcatgtttatgaaatcagaaatggtagttctttgcagatgttatttttttcactttggcagtaattagttggcttagatatataaaagggcctattttcaagttttaaaatggtgtattgaaactgatgattcatcttattttgagaagcagtgaagactagccgttttgcatgggatacatcaaataattactgtatttctagttttaaagaattgaccattactcaatgaactgaaatctgttttcccgcttgtttcagatcgaagactaaatgaagattttaggcggtatcaaatggaaagtttttccaaatattcatctgtacaggtatgtaaattataaattctacttgggaatattctcatgtgaagttgcctacagcactttgaaacttggcttacaactttgattcctgtaatgggaaagcttgtttttgcttaatgaaagtaaatcttttgacaatagaaattgcccttttccccccaaccagagttggagcttatatattatatatgatatataaaatgtctgagttctaaaatgggaattcattcgagttctgaaacatcctaaaattgtttctcaatatacctctagtt

SEQ ID NO: 113058 - DNA, 1049 bp, Homo sapiens
atcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaagtaagctccatgtttttttgagacttcatatacaatgtttaatatcgtcgtcgttgaccgacaaatcttttttgaatgctggttgggtacatttaaattggtaaagagttaaagaagttagttgcaggaaaaaaaaaaccttgatgttatacgtgaggatgtgtgtatatttaagcagaaccgtgtggtagtacttgtagcttacacagaattctactagacgctaaacatgtttgttatgctcctctcgtgctctgaagattagaaggctaatggccagcaggagtttccaagtgtgcatttaaaatctaggggcacagctctctggccatttattaaaaagatgtttattgaactcctgtttctattatgtaccagacactatggaagaacagctgctgcaaagataaacaggacagtttttacctccaagaatttaatttggggagggaaatgtattccaaaatatattgaagtgacagcaactgctggctcttttgccacagtctcatagggttgttggaaagattaaatgaatattaaaatatgtaaaggatttagaatagtatctgatacattgtgttaaacaaatattaactattacacgattattattaaaatatgttcaaggaaggtgctattgggctgaaacgtgcagtacaaatatgaatttactatatgaaaaactctaggcatcccaaatagaacaatatttgtgacactgaggggattaggaatatgctttgttaaagacttgcaatacggctggtttgagtgtaatattgatgtaaattga

SEQ ID NO: 113059 - DNA, 1073 bp, Homo sapiens
taactgctatgaacatgcctccccaggaatatagtataatatagtttatagctggtataatataatttatagtttttgcttatatggccagttagcctttagttgtattaaatgaaatatttctgtacatgttatattgtaatcttaatgatttacagttgattttcaaattattgcacagtatttatatttctgaatcacccttccttcttctaggaaaccactcatactttagtggaacgattagaagtcttcagttgttcatgtgtggcccttcaacatctttctttcctagaaaaatcaagcgtcttagcttcagtgttctaagcccctcccccagaacgtgtaggcagctgggtggagcctaaagccgagccctctcctgtgacctcggctgaaaagaagaagccagtgtttgagaaaagcttcgtggtctgtgttctctagttgttccctcttctctctgacattcctttcgtcgtcgccaggtcttgtttttcgcttgatctctggaaaatactgaaaagtattttacttttcagctgtctcctgctaagtgagcgtactccccctttcaggctgacttcctcatttctccgtttccctgataaatgggcggggcctcggggaggtatggaaactgaaaagaaatcattattgtagaaaaactaaagaaatttttgttgagcagaggaatttggaaattttccttgcagatcatttggttgagaaaacacctttaccataacttatttcttttaaactttgcggacattttttcttttcctgggttcttaatgctccagtgttcggtctcctttctcttccttcgtttccttttagaggtctttccaggtaaagataaagcaatcagaacaattgaaaatttatttttttaacttgttttaagagcaatttgaagaatagaggttaaaagtagaaacatacagagtaacaataaatattgtattaagaaagtctaaacagccaaacttaaaattgcattgcaggacagtaatcatcttgataatatgcattatgacttttcggaaacgttcagcatatataatata

SEQ ID NO: 113060 - DNA, 1023 bp, Homo sapiens
tatatgaattccataatttacttaacagttctcctgtataataggagatgtatttagagaataagagataatcttatgtaataggagataatcatttagatcatttctaatttttgaacagtactctaatgaatggcattatacttaattcttttcccagttgtcagattattttcttaagataaattcctagaagaagataactggctcaaagtttatgtgataatgttaatttctttacaacctgaccagcactagttttaattaatcttttcaatatgtggcaatctgatatgtgagaaaattgttgatgatttatttcctatatatttcttcttccaggcaatgtctattttctttgctctttttcctattggggatagtattataattaagaatagttaattcattttatattctaaaggaataaattatttattgttggaaagcaatattaaatatctcaatatgttatatctctgttttcaaaagttgtggaagcatttttcttgaatgatataactgagcaatatttagaagttgaactttgtccgtaagtataaaatgttttttcttacttattactacataatttgaacgtgttattttctagttataaatgatatagtaaaagctcattaattccagagtaagaatggtactctgaatttgcttgaatgatatgcttttatatatttcttagtttcaagtacagagcacatatttagaatgtatgtttagaatatactcatattctaaatgtttgaaaatcctatgtcaatattttcagttcattaatgtagatttttgtaataaatttcaagataatttttttcaaaacgaaaagtcattataaaacaaaaactctcattatttacgcaataaatttgcattattataatatagctgttcggaaataaaaggagagatatgggtataattaattgagctagcttataaaaatgtttcttttaggggatttttaaatgactagatgaaactttaattttatgtattacataa

SEQ ID NO: 113061 - DNA, 1089 bp, Homo sapiens
caactctcaagacacacatttcaggggaaactaccttacttatcaattccttctatcaaaagatagaaagatagaaagaattcaggtcagagatcttcaattttcattatgcaggggtatataaataagaaaagctacacttatgtcaattatttcttaacagaaattttagtaagcacccattcacccaaaaataatcagaaaattgggtcttttggttaattgaacattcttgtaattgacatttgtcaaatatatcatacatggattaacagtgttcaaaaaactagaataaaattacatgcacttgacatcagaattataactttaaggctcttcctagctgtataattctgaacctcttcagaatatacaagtgctcagacattacttaaagtatgtcattgatttaaattaatcaacaaataattatatttgtataacatttaggagtaaaaggttaagctaataaaactgaattgttattgactcttggacacagcttgaaatttgattatatgaaatacatttgtgaagtaaaattaaaataaactagaaaatgttattggataaaaaaattctgtctttctagttgttggttttcttggttaatgggtgggtacgtactctattaagctttaataaaatgattggtgtctaccttaataagatacattttctaatattattatgacttttctctacacttgcatggtattagcaatacattatactagcaacaagtaatcagcaatatattagcattatattttcatttctcctttgaatttatttatctgctagtaatcttttacatgataatggaaaaaaatcagaagttgcatatgtgtgctatgaaaactatttttacagcaaactgattggagagcatgtaattttttttgtcttctattgatcatcactaccaactagttcaaagagttttaataatccttaaaatacaacaacagttttaaaaatgtattgcaaatttgtttgttccctgaaaagaaaatagcctttttcatactggaactgtcaaaaactattacattaactggttcaagtggtacaagtagaaaggagatt

SEQ ID NO: 113062 - DNA, 1066 bp, Homo sapiens
attctcttcattaacaggaaaaataaatacaacaataacccatgagtcatctgcatttgatcacaatcatttaatatatgttaattgaaataatgatctcaattttgtctctgttcaaaattataatttcatgtaaagagtttcttttcccttcctgtttggatccgtgagagtaaaacatgctttcataatcaggacctcacataagccatttcaaaatggtgaaacagaagatataaaattaactgtatagaacagtaaatagacataagggtttgcaagtaactatatggatataaatgaaaaataagtcagaccaaggaaatatcagttcccctcaatgatcagagaaattcaacctaagcatttttttcctgaactattcagaaaattacagttctctaagactattcctgatgtgcttgcaaaataattctttaagagcacaatcatttgagagctacccaacgcaaactgagctctgcaactatcccctgaattcagactgtgaagtcaaccaatttaaatcatatcacctcatttttttttttttttgctgagtagatattttcttctcatcttctaactgaggaaaactctataattcatagtttttaaattgtttaataaaagcttttaacaagtaagttgcctcaaactggtaggctgtggattttgaagggttgacagttaggttgatactgccttctcagttacttgccagtgctatattttaagcaaataattggataacactttctttcccccagaagtctcaggattttacagtgacattcccagtgtcagcagtggcttcatcaacagttacgtaaaatgtgaagatgccaccaggaagtcctgtttcacactttagaaaacgaatgttagtggatgtgtgggtatgtgggtgtgaaaaaaataggctgtgtattgtagcaaaatttgtaatggaattttttttttaaagaaggattcccagaatatcacactataagcattggacaacctagagattttgtgaaaaatgaacactcttaaggaagaaggattttttgcatctgtttca

SEQ ID NO: 113063 - DNA, 1282 bp, Homo sapiens
aaataattacacacatctataccttctccccacaatgagccataaagaatggattattctccctctatggctaaaaagaactatgacttgagggttatggaacgagccaactcctagtaagaacatcatattaggagttgaacgcattggaatattttagctaaccttgtattaataatatgctgaatcaaattaatatgctgtagtcttatttcagaccaccaagccctagctggggcttacctacacaaagtaaggatatttctctaccacacaggtctttatcattctcatctctgttagttattgataatttatttaaatacatactactggtgtatatcagtctttcactgctggtcaatgtctaacagtaacactgctcaaaagatcctctgaattaatgaaagaatcaggaaaaaaaactgatggtagaatcaataatcaaagacaaaattacatctaagactccaggcaagaaagcaattgagaaagaggggaagatatcagtttgactcaggagacacagagatggacatcaaatatggtcacatcagaaaaaacagccaagtccagttccaagttgaagttgtgtatagcctagcagaatgtgagaagctctccaccctatttggtgatgggccaaggatataactcaactgcacatcagttgcccctctgacaaggaggaataaaagtcctcaaaggaagtctctgaaaaggaagacaaggacaaaaacaaacaaaaaaaaggtcctaaggaagatgttgtccagaaacccaagccaaaattatacacactccgctggaagagacttccatgaatttcttgtaagtacactgaaaaagaacccaaagaacaaaatgatgctactaatatgaaagtaggagattctgaaatttattaaaacaataactagttaagaggttccctcagatgacttcatatcactggaggcaattacactggatagctgcctatttggggatggaccacaatgttgctcaaacttgaaaatctgtcatcatcaacaaaaccagtaacataagactgcctgaacagagttttcaagacatacaaaggatgagaagaatatagaattttagcagagattgattctcaagagaaacaattcagtacagaatgagattgtctggaacagatatctacatgacagctggggattagcttaaggggctgagctgccactcaaggcgctgagctttccctaagcagccaacagagcagcatcaatagtgaactcaaatcttcagagccatg

SEQ ID NO: 113064 - DNA, 1101 bp, Homo sapiens
atattattttgggttactaaaatctgagagataaaaatatattaaaatataaataaaacatttgttatcatgcacattcccatcatatttttcttacaaagtatgcctctttagaacttaaatggattcagacaaaatagtttgtcaatggattttatggtcaatgtgtgtcacatgtcaatgtaggtaagtatatatcaatagtaggcaatatagtttataatatagtaacaaaataattttttaattatagaaaacataggtagcccaaatggaatttatattcatttgcactaaagtatacaatacatattcagcttcacatattcagtttcactgattgaaatttctttcccttgtcttcagaagtcctgttctattaaaagaataatttgtaagctcaatacaaaaaaaaaaaaaatgagtggcagagcactgacttttcaaagaattttcagatgctatgcctatattagccaaataaaatgtttaaaaaatagataaaaatgggaaaattgactcattcattggttgaattgccatgaaatgatctaattctactgattttcctattctcctgaacagactacctattgggatttcctatttgctgtaggctggacctgatgaacataagctttcagagagattgcggctgacaagacattagagagggctctttaggggttcagactgaacttgtatctctcttttatacctggtataatagcctaaggaagtcttttgatgccgttgcagcagcaattgcagcaacagcattatcggtattgccccagtgggtagtaatgcatcagccaaccattactagagaaacaggaatgtagaaggagtctcagaatgtaggtgcaatggcagtagttactctatttcactttcaggagcaaaacactgcagccatcctttgctttagaactttctgttttgtcaagcatgtcaatgttaattcattggcactattatctaaacatttgtttctaaaataagtaatataaaactttatttgtgacagaaatttaagacatgtaaacccatttgcatgtacactttcagaaagtgcttattttatggaatcagaaagct

SEQ ID NO: 113065 - DNA, 1036 bp, Homo sapiens
aaattgaagtcaccaataaaacgatctggataaaaagtttgcagctgtgctcagccagctagttccacccactgggtgtgagctgaagacccaggacaccaccttgtactgttcatttgtgggactctcatcttcagacaggtagtcaggtagctctgtgttctgttctaccacaggaaggtcttggaatgggaccagcatctcttctccactttcacttttcacaacttacggagctttcataaccttggttgatgctctcgctgatgcgaaagcctcagctttcaaatctgaacggattcacaccaagcctttgaacagccatttgaaaagtaaagctaataacacctttaatttttaacaaagcctcttcatatagatttctcgaagacgtatcatcaaggccgtctatatgcaaaaccactgttttggcacgtttgtttgcagttcccagaaaaaactgagctttccttcaatatgaattcatttcattgaaactatcaccatctgccttattggaggactgaagtatgtcatagatttcagaggccagaagttttgtttctcccagagttgcagttttctgtataacattttgtaggctcaacatcatacccagttctcctttcatcttttctctgtttgcacggtgttctcccaagtatcaaagagcgagcaaagccaaatggactggagggttggggtggtccataaataaaataaggcaaggcagacatccctgatcctggactacagctcttctgtttaatggatctgctgctatatcccctaactggttaactaccgatagagtatcagactcttcattcatggtggaggtggaagaattcatcttctatgccatgcacatgaataaaattttaaatttgctccagagctttaggagttcagagcctgctgcaccatcgggccacacctacggatgaggtagaaacccaggcggcgtgagcccctcggttcacagccacagcgtcggcgatcgcaaacaactggactaactcagggagccaaagag

SEQ ID NO: 113066 - DNA, 1027 bp, Homo sapiens
catgctgatgaactaacacatcttctggaaaaatcattcaacatggctatttttaaatgttctcagaaaagaatctttctggggaatggacataggcgtgggacgtctggcaacaaaacatgcttggtctctgctttggaggagaccccagacaacaggtatgcccctcccaacctttctcaaccatgaccccggtccctcgcaagagtaagctttaccagtcttgtccaaagcaggctacacatggataagctcaggttacagctggtgggtggggattaatttttgctacccagttctggtatgctcaataaaagttctggacatccatacatctgtttcagtttcccccggtgcctattctgcctggaaggtgtaggcatggagatgaggcccttcccccatttccccatagagactctcattattctgtcctaaaaccaaatctgttcagttgaggttttgatatctgccaacatcagatggccctatcctccacggcacccctaaactgttagcttttcagtgaggctattatcaaagctgtctggaccacttagggtcatagctctgcaactcctctgttgccagatatcagttttcttggtcttctattgcaatgtgccagctccactatccctccccattctgaatcttacactttgatcatctggatacacccactgggctcttcctttagccgggtgctttcccagtaccttgtcccaacttcttccctttacctcctggctggctgcctcaagactggttgaggttattacagtgcacctaagggtaatagaaattcaagaaaatgcaagtacactgtgagactgacctctgaccttgcacatgtggatctcagttgcatcactttaatttccctgccttttcttcttcaaggagcccaagaccaaaaatattaaaaagagagaaaggaagtatactagtcaggattctccaaagaaacagaccaataggatatacaattgacccttgaaaaaagtgggggctggagttatcgacc

SEQ ID NO: 113067 - DNA, 1050 bp, Homo sapiens
atgccatccaagtgaaagtgacagttcagcatatataataaatatatatatattttagttaacaaatatacacatatttgttaacttcaaaaactcaaggactgatagaaaaaaatgacaaggattacagagaacaaaccaaaagtgaatttaaaagaaggatttcttagaggccaccatctgaattcaaatgtatctgccagtaggggcaggagcaggagaggatgaagtcacagtacgattgcaaaatgctgccaatccacttagagttgtttactgacctcttccccacttgcttcctcccagtctttggagaacataactgagagttctaaattctaattttcttctcatagacacttccatgggaaatcatgatgtaattcacgaatgtccctgttgccaactttagccatttaatatcacggaaatctgctaaggaaatgtttgtgctatttcccatccagcctggcaaagggcaggcccctttgacatattgagaaaagttgccagagacattttctggtaaactgacacagttcctggggctcggaaaaagaaacagatccctctaacaggccaagacagacaccaagaaagggagccagagaacaaagcaagcagattttgtcttttttaactgaactttttcctttgacattattattgatttatatggagttgcaagaaatgctacaaagagatttcctataccctttgcacactttccccaatggtaacatcttgcagaatgatactacaatatcacaaccagaatattgacaatgaacagtcaagacacagaacagctccatcaccacaagaattcctaacggtggtcctttatagcatcgtctacttccctcccaccttctccccctccttaacccctagcaattgtaggtaagaaaatataatttcttttctttccctttataggttcatagttgagacactctcctaaaaataaaaatcagattaacagaagaaaaataggccgggcacggtgactcgcacctataatcccagcatgttgggaggccagaggca

SEQ ID NO: 113068 - DNA, 1002 bp, Homo sapiens
gagggacgcgcccggcctgcgccgcctgcccgccccagggctgcgccgcccgttgtccccgccggctgctgttcccaggcccgcatccccccggctgctggcggcggcctcggcggcctcgggcgccgcgaggtcgtgttcccgaacaggtgagtgcaccccagttccgggcggagaacgccacggccgccaacgcgcggccgccacctggagaccgcgcggaatgaatgagaagcccggggctgccggtcgtggagtctggcctgaaagtgggtcctttaccggagcaaccttctgcgttccctttttcctctttccctgttccccgacttgcctggggcttgcatcaaagctagtaagaactgggagactgtattcaggttcccgcttgacccttagaggccatgctttcagaatttcttgttcttgaccgttaaatttcccccttccgaggccgcgagttactatgttggttacattttttattgcacgacttaacggaaatttttatggaaaaaaaaatctaaatgatgcttatttgcttatatagctttcatggtctagatattaagttttttttttaagtcgtgataataacacattgattcgttttacgttgttttttttttttttttttttttttttttttgagatggagtctcactgtgtcacccaggctggagtccagtggcacgatatcggcttaccgcaacctcccgctcccgggttcaagcgattctcctgcctcagcctcccgagtagctgggattacaggcgccagtcaccacgcctagctaacttttgtatatttagtagagacgggggtttcaccattttggccaggctggtcttgaactcctgacctcgtgatccacccgcctcagcctcccagagtgctgggatcacaggcgtgagccaccgcgctcggccattttacgtttctttggattttttttttttggaggcttccactctttatagttaacatcattttttgtcctg

SEQ ID NO: 113069 - DNA, 1038 bp, Homo sapiens
tgacctcaggtgatacacccgccttggcctcccagagtgctgggattacaggtgtgagccaccacgcccggccactaattagagtttatagggctttgatagccacttaagtggtggttatacttcagtagataattagaaatttgaaggacagtgtgcctgggcgtttagcctcatagtaaacctgtttggacttccacggaaagcagctaagatactttttatttattgttattcttagaatgggagaaaatcagccttcccacggagggagtgagacctcaagtgaaaaccttagctgtcctctgtatctatgtggcctcaaagcaacacttgaatcatatattaatacttagcaagaattcagtgtcaggtatgtgggcaacagtgcccaggggaaagaaggctaaacaaaattggtaccatccaatttgaatgtccttataacaatttttttctccttccagtatataaaaaaatgcgtgggtcccattcagatcttctggattttaatatctccaagtggggcctgagcatctgctgattctgacataggctccgggtagacaacagccacatattgacaacacaggcggacacctgtgaggaggctcgttttactaaatgcttagaagcctattctaagtctctcagtgatgtgattctcctgtccaaaagttagagaccactgttggattgtggagagttgtgcagaaaggaaaatatttattttatttattgtagagacagggtctcactgtgttgcccaggctgctcttgagctcttggcaagtccatgaaaataagtgcttagaagttacgatgctgcccgggtaccgtggctcatgcctgtaatcccagcactttgggaggccaaggaggtggggggaatcacttgaggttaggagttcgagaccagcctgggcagcatggcaaaaaccccatctttatgaaaaatgtaaaaattagccgggtgttggtggtgtgtgcctgtaatcccagctattcgggaggctgaggcaggagaattgcttgaac

SEQ ID NO: 113070 - DNA, 1007 bp, Homo sapiens
tgtctctcgtactttaaatatatcaagatgtgtgtgtgcctgtttctcctttaggcctctttcctggagaggaagggagttttgcatgttgttttatttgtttgtttgttttttgagatggggtctcgctctgtcactcaggctggagtgctgtggcgtgatctcagctcactgcagcctccatcaacctggttcaagcactcctcccacctcagcctcccaagtagctgggaccacaggcatgcaccatcatgcctggcccagtaatacaacagttactgtatttttagtagagacaggttttccccgtgttggccaggctggtcccaaactgctgagctcaagtgatcggcccaccccggcatcccagaatactggcattacaggtgtgagccaccgcgcccagccagttttgcatgttctgagtgggaaggtaatctggagaacgggcagccaggcttccttgttgaatgcgtgagagggagcaggctggtaactaccgcctttgtcaaagaaaggagggtttccttctatattcttcagtccaaccccttccccgctttttaaaaccatccttgagtttcagagttagctcctgatctggtctgcttctctttcaggtccattcacctttgcaagccattctaaggctatcacccattttctttggggtattctttggttctatggagcaaccaaaagccacccttcccggctttgtctgtgagagaggggacacatgtaactagtgccaccgttcactttcattcttgaacgaattgccctaacagttaccccctcagcttctcctgccctttctatttcttgattcagcttggagtttcttcaaggtgctcttgggaaaaccacatttacctttggtaacttgtactgccctttccttctggtttctctgttaattcaaacttgtttctgtcttcttggaattcctccaaatatttgctccattgatgtcatgcatcccttcttgttttccaatgttattg

SEQ ID NO: 113071 - DNA, 2239 bp, Homo sapiens
ttttttctttttttttttttttttttttttttttttttgagacggagtctcgctctgtcgcccaggctggagtgcagtggcgcgatctcggctcactgcaagcttcgcctcccgggttcacgccattctcctgcctcagcctcccgagtagctgggactacaggcgcccgctaccacgcccggctaattttttgtattttttttttagtagtgacggggtttcaccgtgttagccaggatggtctcgatctcctgacctcgtgatccgcccgcctcggcctcccaaagtgctgggattacaggcgtgagccaccgcgcccggcctctttttttttttgagacagggtcttcctctgtcacccagactggagtgcagtggcgcagagccagctcactgcaggctcagcctcctgggctcacgcaatcctcctgccccagcctcccaagtagctgggaccacaggtgcatgccaccatgcctggctaaaggctcattttaatatatctagagcagaggttggcaaactttttccataaagagccagctagtaaatattttaggctttctgggccatatatctgtcgcagctactcaactctgctgttgtagtgtgaaagcagctatagacaatatgtaaactttatttatggacttttttttttgagaccgagtctggctctgtcgcccaggctggagtgcagtggcgcaatcttggctcactgcaagctccgcctcccgggttcactccattctcctgcctcagcctcccgagtagctgggactacaggcgcccaccactaagcccggctaatttttgtatttttagtagagacagcatttcactgtgttagccaggatgatctcgatctcctgacctcgtgatccgcccgcctcggcctcccaaagtgctgggattacaggcttgagccaacgcgcctggcctatttatgaacattaaaatttgaatttcatatcattttcacatgtcatgaaatattactgttcttaaggttccccccctccccctaccatttaaaaatataaaagcctttcttagcttgcaggcagcacaaagacaggatgctgccagagttagctcatgggtcacagtcggtagatccctgatctagagaggactctgtacagtcagcagaaggcgccttatagtttcatatttccactcacactgtaaaaacacgtcatttttccaagtgtcccagaaatgttagtgatgggagatcaccagatttttaggttttgctttttcacatttttatttcagaggattgtgctagaaaagcccagcttgtggaaatgatttgtcagccaatagacaattgagcaccagtcgaacatgttaaactaagcatttatcatggaggggattcccttctctttagagagcttttccatatgagtctgtcctggctgaaggtatggttcagtcttgtctggatgacgcttcagctttcttgtctggtctgtgactgccacctggcaaagagaggttgtttggattgtcacactcagtctaggtgcttgtatttttagacacgttaggttgagagttctgaccttcacttgatatctctggtaatgccaagcgggtcgtggcactgctttgtacactctgtgctgtggcagtgtgtgtgtgctgtgacgacagtgacgtcgacagatggaggaggtgcaactcgacctctgtttctttctggcctgaagaatgggctgctgtgtgcgcctggggctaggcaggacagctgcatcgctgttgccctgaggcagtatcagcacagctggagatgctgacgagcagcagtccaaggtgcaggtaactttctccagggccagcccccttactagttgttcaatctagagaaagctgtgcagatacccacttcaccagatttgggacagaataatgaaaatacatggaagcagtctggcacattatctcgaatgttaataatagccttctctttttgttttgttttgttttgttttgagactgagtcttgctctgtcgcccaggctggagtgcagtggcgtgatctcggctcactgcaacctcctcccaggttcaagcaattctcctgtctcagcctcccgagtagctgagattacaggcacccaccaccacatccagctaatttttgtatttttaatagagacgtggtttcaccatgttggtcaggctggtctcaaactcctgacctcaagtgatccacccaccttggcc

SEQ ID NO: 113072 - DNA, 1122 bp, Homo sapiens
cctgggtactttgaagtcacggttttgtaagagctgacaactgactagctttttcttttcagctcttggagaaggcaaagacaactttgtacagtgccctgttgaagcactcaaatgggaagaaaggaaatgtctcatcctggaagaaatcctggcctaccagcctgatatattgtgcctccaagaggtggaccactattttgacaccttccagccactcctcagtagactaggctatcaaggcacgtttttccccaaaccctggtcaccttgtctagatgtagaacacaacaatggaccagatggttgtgccttattttttcttcaaaaccgattcaagctagtcaacagtgccaatattaggctgacagccatgacattgaaaaccaaccaggtggccattgcacagaccctggagtgcaaggagtcaggccgacagttctgcatcgctgttacccatctaaaagcacgcactggctgggagcggtttcgatcagctcaaggctgtgacctccttcagaacctgcaaaacatcacccaaggagccaagattccccttattgtgtgtggggacttcaatgcagagccaacagaagaggtctacaaacactttgcttcctccagcctcaacctgaacagcgcctacaagctgctgagtgctgatgggcagtcagaacccccatacactacctggaagatccggacctcaggggagtgcaggcacaccctggattacatctggtattctaaacatgctctaaatgtaaggtcagctctcgatctgctcactgaagaacagattggacccaacaggttaccttccttcaattatccttcagaccacctgtctctagtgtgtgacttcagctttactgaggaatctgatggactttcataaatacttgcttttgtctttttaatcacaggagtctatttttttttttttttttttttttttgagacagagtctcgctctgttgcctaggctggagtacagtggcctgatctcggctcactgcaagatccgcctcccgggttcatggcattctcctgcctcagcctccagagcaactgggacaacaggcgcccgtcaccacgcccagctaattttttgtattttta

SEQ ID NO: 113073 - DNA, 1050 bp, Homo sapiens
actatttagcctggaggggcttttgttatttaaatgtcagatttctttgatacattcttcaaaaataatccttgtcctgcctctatgttccattattgtgtttcttttttttttttttggagacagagtctcactctgttgcccaggctggagtgcagtggtgtagtctcggctcactgcaagctctgcctcccaggttcacaccattctcctgcctcagcctcccaagtagctgggactacaggcgcctgccaccacgcccggctaattttttgtatttttagtagagacggggtttcaccatgttagtcaggatggtctcagtctcgatctcctgacctggtgatctgcccgccttggcctcccaaagtgctgggattacaggcgtgagccacagcgcccggccttattgtgtttcttgaagagattccaattagttttcaattatttaaccaattagttttcattattgctgttatatttaaactttaccattggaataatattggtatgcgtttgatattagtcactcgatgtcatcattatttgtattggaatgtgctattcacaataggttatttagaagctgtatgtggcagtggccaagagagtcagtaggaccttcttttcagagataggaaactttctagaaagcctgttaatgggctttcattgaaatttcctaagatagccagatactgtcattcaaaatatctagaaagaagaatgtaaaaagttagataacctgggtcgggtgtggtggctcatgcttgtaatcccagcactttcggaggccaaggtgggcggatcaactgtggtcaggagttcgaaaccagcctggccaacatggtgaaacctcgtctctactaaaaatacaaaaattagctgggcatggtggcaggtgtctgtaatcccagctacttgggaggctgaaacaggagaatcgcttgaacctgggaggtagaggttgcagtgaacccagactgcaccattgcgctctagcctgggcaacaagagtgaaactccatctcaaaaaaacctggaattctc

SEQ ID NO: 113074 - DNA, 1330 bp, Homo sapiens
aacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggatcgaaagggaccaagcagctcactacgatatcaagttacactaagacttggaacactaacattctgtaagaggttatatagttttcagtgggaggggttgggatgggtaatctcattgttacatatagcaatttttgatgcattttatatgcataccagcaattattactgtgttcgcacagttctcacttaactggtgctatgtgaagactctgctaatataggtattttagaatgtgaattgaagaatggatcccaaaaacttcagaaagaggatagcaaaaaaagatctagtgcgattttatatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaatacc

SEQ ID NO: 113075 - DNA, 1045 bp, Homo sapiens
cattttgggaggctgaggcaggcggatcacctgaggtcaggagttcaagaccagcctggccaacatggtgaaaccctgtctctaccaaaaatacaaaaattagccgggtgtggtggaatgtgcctgtaatcccagctactcgggaggccgaggcaggagaattgcttgaacctgggaggtggaggttgcagtgagccaagattgtgccactgcactccagcctgggcgacagagcaagactccgtctccaaaaaaaaaaaaagtagaaacaagtatattcaggatttttatgatacaatgaaggacactttatttgcttttaattatgtatttaattatgttaatgaattttaatcaatgtctgtcattgtttttaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgaggtaaaaactcaaatgagctagtattcaaacaaaatttatgtatttctttatatgtctattagctgtttaaagagaagctgaaaatcctttacaacttttaactttgggggatattctagaggagcttcttagatttggaagtaggtggggagataggagtttggtctacgtgcttataattttaacataattggaaaattcatttttgcagaaaatgtgcttttgtacttaggagtgtttcttaatagaaattatgaagttgtaggcttaaaaaaaaattaaacctaaacaaattatggttcctaaagttagtttgttttttagtttttaggggtttgttataaatggatttatgttgataggaaaatttatcttaagttttatcagtttggctgggcatggtggctcacgcctataatgccagaactgtgggaggctgagttgggtggatcacttgaggtcaggagtttaag

SEQ ID NO: 113076 - DNA, 1119 bp, Homo sapiens
aggcggatctcgaattcctagcttcaagagatcctccggcctcacactcccagagtgctgagattataagcgtgagccactgccccttgcctatttttgctttagaatttgtgtatcctgattaaaaatgaaaacagcaccaaacctcccccattctgtgctttcctaatttgtggagtaagatgatttcaagtaacatttctttttaaaattatttttattatcttttttttttaattttaaaatcttttgtagaaacagagtgcccctgttttgcccaggcttgtcccaaacccctcgcctcaagcgatcctcccatcttggcctcccaaagtgttgggattatagacatgagccaccgtacctggcctttaattttcttgtcactcagattctgacagataaagtatcatttcagtagtggttttagatgtgttctgtctgcccatctgataaccgaaaatttatcactttcatgaataagtgttttcagaccaatattcaatagttggataaattttacattaatatatttaaatttattctgtccttatcaggtggtttgatttaataattttaaataattaaaacagaaattaagtctagtttaaaaaaaattgtctccagtaagcctaccaagaaatttggtatttcattaggtcaaaaaaaaaaaaaaaaaaaaaaaaggtgacattgaacacattcaggaactggtgacccaatttgggagaggcttaggatacttttcttatttccttgtttgtctttggttgttgtacacttctaacatcttaggtttcttcttttagtttatattgaaaactttaaaagttaacatagtatgtattagaaaattaaactgtaaatatacagttattactgttgtctttttaaataattcttatcctcagtggtatcacttatacttgaatatcttttgcttaacgctggagaaaaactgtgaccagtttttaccaattaaaatcacatctcattacaatttcagtcttgtattaaatttgaggcagtgtgttataatgtaattaattgaagctgttacagtcaaacctgtattcaaagtccagccagtgttttttcttctgtaaaattgtgataata

SEQ ID NO: 113077 - DNA, 1302 bp, Homo sapiens
atagaaatgtcatatcttggttatttgtgcacattagaaggaagccagagcaacattactgtatgtactagaataccagataacaatttgtacctactgttttagtgactaaaacatcaggactgttacattaaataaaactttaaataccgaaaggtaatatttcttgtctgtaatgagcaagttttccttttcatattctaaaatgaactataggtgcttatgttttactgagtacatatttataaatctttcacattttgagccacatgcatatattacctgttaaaaaataatgacggatatgtggatggaaagtaattattaactaactcactattatactattattttcaaatgttttcacaactcttagaataatttagaatttttctacaattagtttgaaagtataagtgtgaaagagtggagtgactactcatgatccttgccttacccagaggattaacatttttcctttaagttgattttccatgcatttattttccttatgtagtttaaatcatatcgaatattcagcaaattaacttcttcagtattaagctcttatcctgctttgattaattcttaacacacctcgcctcttctaaatattgaactgtccacataagaaacattgatgggggtgggaaattttaatttttcaacttttttttatagtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggtagagtatatttatacatttctgagaaggcaggtgaaaatttttctcttatctttttcctcatcaagggacatagaaagtagtatatgctgtagatttaagattgatgttatcttaaccagatattctcaaagaatcaacattgagattttaaatttagtattttaacgtactcatactgtttaaaggagttagtatgtaaggcttgaggataattgcctgacaatgatatttaacaggtgttcgacacacagaaggcagatcagagattccctgcaccttgtcttactccatcttctccttgttgatccttttatgggtacttggttacttaaaaaaacacacacacacacgcacaacattttattctttattttacaaagtcttgtcttcccttgctttcatggatattttttaaaaagccaggcacgcctttagtcccagctg

SEQ ID NO: 113078 - DNA, 1297 bp, Homo sapiens
taaatttcatagatgtagaaagataccagtaagtcaagttttaagtaagataaggaattctacttttcagctcttgcttgtagcttgcttactttgattgcacaacactgttaaattcatgcttattcttaaatgtgcaaaattatagtttaaattttatttgaattattgatctgaacaaaatagtattttttttttaattacagacacaagtaggagaaatatttcttaaatttctgttaaaagttacttgacttatgtaaacaaaaataaaaagatagtgctcacttttacaaaatgtgttaagttttggaaactggcattagtacattattgtaaattgatctgagaacagcctcttagatttttgtattttgcattattttagttagtaaataaaaatgatgagataaaattagtaagcagtaaaaaagtaatcagtgttcctcttaacatgcttgtaacttacaaagtaagtttattttacatttttatttagttttgaaatatcttccatttaatgctctctgaactgtagattgagtgttctaaaatctgaaactgagcactgatgtgacactcgaagtgctcattaaagcattttggatttttagatttgggatgttccactggaaatatatagtgcagatatatatttttttaaattcgaaatctgaaacacttctggtcctaagcattttggataaggcatgcccaacctatagtagtataagcttcatgaggccagaaatctgttcacacttgtgtcaggtttatagcacagggtctgggcacatggtaaatgtcagcaacgatttgtcagttgtacgtagagtattagatcttctggctgataacttcataggtaatttatgcatattttatgttgtcatcgtaaatttaaagtatgaatgagtaaattttctaagtatgtattttactctgtaaatataaaatatttctgagatataatatgttgaattttaggggggaaggggaagttgaggtcagaaatatgtgcaagaattacaccttgaagaagtaatttccattgacataacaattttaataacacaaaatcatggttttgaaaatgtgcctcaaactatgtaagaattcagggcacgtaatatgtaactgttaggcaaatttcattttgtttataacttgaaacattaaaaaaactggtaaaattctcttgctgtattattattgaatacttgaagctctgattttaatatggtaaagttttagggtgtgtcttaatacaattacataaggaattagtttgcccagg

SEQ ID NO: 113079 - DNA, 1101 bp, Homo sapiens
tattagattgcttccaggaagaaaatatgattaatggctcttttccagaggggggacaattgcagacttttcttccgcagagcgtgaaatgtgcctcttcctgccgaggggctgtgtcctcgcgcggctcccggagccgtttcccagcctcaggtgtctctcgccgcaggctgcggccgctctctggagcaagcgtccgggacttcctgtttgggcgcggggcggaaggatcgcgttgccagctgcggcggccgccacagccacagccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcattcgggccggtaaggacaggggaacttttctcccgtgcatcggtgcagcaggagagggggtgcacagaaggcggggtgactcccctgtagcagtctgtgctgggggtacagtgtccacctcacagtcactggggcggctgggggaaaggggggagtgaatgaagtaatggaggcgacgaatcaggaagtgatcaccttggagagtaacctgcctcgaatccggcgctgtcgcttcagggtgggttcggcgagcagcagcagcagctgccgggctgagcgctggcagcgggtgctggagaacggagccgcggttaagttgggcactcgggggcggacgagttgtgcgcttcaccccagttgctgaggaaccaggaagtgagtgaggctgttgtctctcggctgcgcctgccacgctgtctggccggagaggccgctgctgcccgcgttcgggggcggcgggcttctccggcgaacgctcgccacccccgctcggttctcccttcagacttcgtcca

SEQ ID NO: 113080 - DNA, 1286 bp, Homo sapiens
tattgctgagggcttttaaagctttgtatctgtttcttggatcagataagtctaaagggcagtgaggagccttttaaaagttttgagcagttttgaaaaatacaaatttagtttttttcaaaatagtaagtgctgtaaatgaaaaaaggaataggacagtcaaagaattacttaaagtctgaactccttggtttctcattcatagctccctgatatctagctaactgttctttttcaccttccactaagttgtctacctctccagatttggggtataggtgtgctcattgcctacactaagttaaaagtagtagagattaaaatagttgctcagccagcctttctttttggagttaacaaggtagatgctttgtacggtgttgtttcaggaggaggaatcattgtctcttatccattgtccatgcccatttgtataaacttttgggtttttccaggacctgggcgagactcaaaacagcgagtcctgattgaatgccatgcctatttgttgaatttgttaggtatttatctaggctggtggcctttaagtcaattgtgtaataggaatattattttatattgagaccttgtctgtacaaaaaaaaaaaaaaaaaggttggtatggtggcatggacctgtagtcccagctactccttgcagtcccaggagttcaaggttgcattgagctgtgatggcgccactgctccagcctgggcaaacaagcaagaccctgtctccaaaaaaaaaaagtatatcattttgatcatttggactagacagcgtaagttaatatatttcttttggtcttgatgtctttgaggactaacttgtaagtaaaagttatcttgaaactctatctgtattttcagcgctgcatacaaacaactgctggtttttatttccactggcatcatcgacagtgttctaggccttaggtgtcatagtagataccataaagagaattatatacagaagagctatgatttgagcctttgcaactaaatatatatcaaagggctttataatggattttttttctttttaaaaaatgtaatacacaatatttagaatattctaaaaaactgaaaaattcaactaataagtatgtactactaaaattaataaaatattggcagcagtgttaatttaaatacatcttatgttcccgaatttaattttcccctttccttcttccttaagataattactatcctgtttattaatgatataatggaatatttacaatagaagtatggaagattccggatatgtgtgttttttaattg

SEQ ID NO: 113081 - DNA, 1182 bp, Homo sapiens
tctttcctgaaactctcatttactgggaattaaacattaaaatatgaggcctgtgaaaaatggaggtgagttgtggtatagaaatccatgtcagggggcgcggccaggccaggcccgggggctccgcatgctgcagctgccctcgggcacccccgccgctgccctcgccgcggcgagctaaccccagccagccgggggcgtcccggaggcggtggcgcagggaggggcccgatgcgcgcacgtggccccggcggccgccatggcggacagcggcaccgcggggggcgcggcgttggcgaccccggcccccgggccgggcagtggcggcccaggaccacgcgtctactttcagagccccccccgggaccgcaggagagggcccgggcggcgcggacgatgagggcccagtgaggcgccaagggaaggtcaccgtcaagtatgaccgcaaggagctacggaagcgcctcaacctagaggagtggatcctggagcagctcacgcgcctctacgactgccaggaagaggagatcccagaactggagattgacgtggatgagctcctggacatggagagtgacgatgcccgggctgccacggtcaaggagctgctggttgactgttacaaacccacagaggccttcatttctggtctgctggacaagatccggggcatgcagaagctgagcacaccccagaagaagtgagggtccccgacccaggagaacggtggttcccacaggacaatcgctgccccccaacctcgtagcaacagcaataccgggggaccctgcggccaggcctggtgccatgagcagggctcctcgtgcccctggcccaggggtctcttcccctgccccctcagttttccacttttgggtttttttattgttattaaactgatgggactttttgtgtttttatattgactccgtggcgcgggccctttaataaagctaggatacgcctttggtgcaaaaaaaaaaaaaaaaaagaaagaaaaaaaaaatccatgtcagtgctgagcatgctcctaaattgtgtgtgtgtgtgtgtgtgtgtgtgtgtgtgtgtgagactgaagtctcgctctgttgccaggctggagtgcagtggcgcgatctcagctcactgcaacctcccgggttcaagcgattctcctgcctcagcctcctgagtaactga

SEQ ID NO: 113082 - DNA, 1038 bp, Homo sapiens
gagcaaggtgaagaagggtggagaataaatctggaggggcaaatggaagatatctagtacaactaaagcttagtaaagaaaggtcagggagaaactgatttgggaatcatcctcatttaaagccgtggaaataaatttccgaggggaaacgtatttcatagatttttcccaaggaaggagatacgtaaattctatatttgtctctctgtgatggagaacaaaggacatagaattaaggaattaaccttagagaatgtttacattttaaagagtggagaagaatcaaagagtagtcaaatatgatagaaaatcctgggcgactatttctgagttttgttttgttttgtttttttgccctttaagtagctctctttagtaggaaagggaagaatattgacttgggttagttagttctgattttcaaatttcccctttatcacttacttggcagtatttaaccttttcagagtgtttcactgtcagaaaataggaattcagggttgtgaagattacataaaataaatacataaagcacagtgcttgtgacagagtttctttaacttcattagcaccttccctgtgacttcaagtatagacaggacttttatacattagaatggaatatttgtttaactttgtttatgtctcttgttttctccttccttttgcttccacttaaaaaaaaaaaaacaaatgctttataccttcagtttatactttttccttgtcattccttccttgattattgtgctctggcatctccatttatcattctactgaagctctttatcagatttcggtggccactcttctgtcaaattcagtgacccatagaatcatccagaagtaatccttcataatctggctgccttatctgctgaaacactgtattctcctagttatttttcttgttgacctttgcatggattgtactatttatgcttctgagtgtttgctcaaagacagtttcctcctatctataatgtgctcaggtaggtattagccatcttttaaggcccaactacatgaagatttcca

SEQ ID NO: 113083 - DNA, 1025 bp, Homo sapiens
taacaactgtgcctattatgcctcaaagatgctattgttgttcctctctggaaagtaacctgtcttctgctgaggtggaggaggtctggttgcttagcatcatgaaggagagagaaggtctaggaatcaaaagtgcatgtaattggtgttgctttctgtagattctctacactgtacagtgtgttgtttctcagattttttttttttttttttttttgctgccagactgatttggctttgctgggtctgctaacccactccatactcatccagacactttcagtcttccaggattttgttgttcttacctcttcttgtttgttgctctcacctcttgtccttgtgggtttaggtataaaagagtcttttactgttgttttagtcagctttcataattaagtgaaattatatgcatgtttttaatctgccaacttaatcctaaagcacagattatttaaaatgtttaatctatgtcttacctcttgagacttgaaaggattattaaagttagcccttttcatctcttgttttggcttttacattcatatttataatatttgaaactcattatgtggactgctcgagactgtattagttcaaggatttataagtgaattcagaatttgtaaatacaaaggttgattgttctttaaatttgctcttataggaaagtgaaaaggtttctgaatatccagcagtgattgtggagccagttccaagtgccagattagagcagggctatgcagcccaggttctggtttatgatgatgagacttatatgatgcaagatgtggcagaagaacaagaagttgagaccgagaatgtggaaacaggtagacatctcataaaatgttcattatttataactttctcattttgtaagcttcaacaatactattgccagatgaaaaatatactgaaaaacctttttaatgctatttagtatagcttggaaaccagtgaaacatctatgtttaagggaatttgtgtagatataaaacttctattgtataattctatgaggt

SEQ ID NO: 113084 - DNA, 1078 bp, Homo sapiens
gctagaaaatatttgtatatgcctgtcaggatattctggttgtagcataattcatttttttcttccttgtttttagttatctttggctaagatagtgcatctatttccttccctttttaaaaagttttattttaggttaaggtgtacatgtgcaggtttgttaataggtaaattatgtgtcatgggggtttgatgtatagattgatttgtcacccaggtaataagtatggtacccaataggtagtttttctctcctcatcccctgtctcacctttcttcctttttaaagcattctatttaataacaaagatttccaaaagggaagtaaaagagtaagtggtgtgcactgatttctcttctttgctacactgggattatggtttaaacttctaatggtgattacagggagacttgagtgtacctttggatgtggcgtgacaaatcttaaagctcaagaaataaacctaagcatacatttactttcaggcttacaagacagtcacatcagaccaagccaaacacacagaacataaaacaaatttgaaagaaaaaacaaaagcagagatacatccatttcaaggtaaatgaatttcttaattttttatttttatttattttttgaggcactaatttccatccacttagtctagcaatgaacactatttgcttttggcttctttcctagcttaatccagaatgactctaggtataagttcatttagaaaggaaaagttcaactgaaacctgaagaacactgttacaccttttggatgaatgcatttgacaaatgaatgttttacatttatattgctgaccagtgacttttgactcctttgtgtggtaatattattttcccctgctcaggcatccacccatgcaggcatgagctttcatttttctcattatctaaaaataataatataacaaattatctttcagttttggctaagaccacctgtgtgcctttgtgcaaacaaggtacatttgacataatagaatcagttgtgtataatgagtccttcagttgataaaatggtgaccatgggaacagaaactttatattttcactctttccttc

SEQ ID NO: 113085 - DNA, 1058 bp, Homo sapiens
cttcgtgtgtgtatttcttaatgtctgtttggtatcttgtacacttgagtgtgaattccatgagaacagaaacctattttattaattatcctttattcagcaacttgctcatctggtccatttaggagtttaatatttgtagaagtgatgaatgtataacggcaatcgattctttttattttattttattttttgagacggagccaccaggctggagtgcagtggcacaatcttggctcactgcaacctccgcctcccaggttcaagcaattctcctgcctcagcctctcgagtagctgggactacaggtgcgcgctaccacgcccagctaatttttgtatttttgatagagacgggcttttcccatgttggccaggatggtctccatctcttgacctcgtgatctgcccgcctcggcctcccaaagtgctgggattacaggcgtgagccactgcgcctggccagagcaatcaatttttaaatttttttctgcatgactatttcattatgattgtcaactcaactaatacccagttggacagttcctggtaaaaaacctagttatgaacaagatagtttattctgcatggtctgtgatttaaaagagaaagtttattatatatatatatataaaatatatacatctggctgggcgcagtggctcacgcctgtaatcctaacactttgagaggctgaggcgagtggatcacttaaggcaaggagttagagaccagcctggccaacgtggcgaaaccccatcagtactaaaaatacacaaaaaatagctaggcatggtggtgcgcgcccgtagtcccagctactttgggaggctgaggcacgataattgctttaacccaagaggcagaggctgggaggttgcattgagccaatattgggctactgcactccagccagcctgggcaacagaacaagactctgtctcaaaaataaatgaatgaataaataatatattcatctatagatatgtatcaaatatatataagtataccatatacagtgtacatatatatatatatatatggtgtatttctgaaaac

SEQ ID NO: 113086 - DNA, 1048 bp, Homo sapiens
gcagacgacccaaggcccagcccacgcctgtcccctacgcagggctctctgctccccatcacccgcctctagcacttatccaagttcaacctgaccactcttggcctttgtaaatggactttgggtccttgccttccccacctctgtacgttaggtcccgtaaaccgggagaggagacaccctccccggggcgccccttacatgaccactcccgagtcgtctgagggtccgcaagcccttaaacgaggctttgaaagcctcggacaggacaggtgcgtcctgtctaactcgccagtggccctgggcgaggtacttgatctctttgaacctctatttccttggctgtttaagtgggagatgggggagttgaagggagaattaaatgcgataatacgcacgtaaatgttagggttttttccctacaaggcagtaagttacaaatttacagaccctcttcccctttcagcttcagtgcgatcaaagttctacgtgcgagagccgccgaatgccaaacctgactggctgaaagttgggttcaccttgggcaccactgtcttcttgtggatctatgtaagtactttactcccggatgtcgtgagactacaccagcgtggtaagggaatgacataacattgcgagattgaatggtgctgttatatgttgtatggcagtgaaactctcataacagtaggatatttatataatcgctgatacgtatttttccataagagaaatcccaaggactaaaaagaaattaagatttcagcaacattgaaaaagtatgatgggactaaaatttctgttattgttccttaacatggttttgtaaggaatggcagttttactaaatagtaattatactttttttttttttttttgagatggagtctcactctgtctcccaggctggagtgcagtggcgtgatctcggctcactgaaagctctgcctcgcgggttcacgccattctcctgcctcagcctcccaagtagctaggactacaggcgcccgccaccacgcccggctaatttttgtattgttggtagaga

SEQ ID NO: 113087 - DNA, 1663 bp, Homo sapiens
tgtgaggctccgggcaagcggtggggaggatttagccggtaaccgggcctgtcacccctaacctcggcccggcgggcactgagccactcccgcccgggaccccgccttcatagctctcgtcaggccgaatgcattgctttgctccctctctgtggttcctactatggcccgcgcgccagggaccacaggcttcttcattccatccccacgcttgaggccctggttccggactaggccccgacctcccggcttctagactgccggttctcattctccccgatctgggggagaagaggcccggcctttggcgggcaagtgggcgacaccggcaggagtcgcggcccggttggtgtgggaaccctgctggcaggtcggggtggcacccttggaaggaacaggtggtgcggatgcagcaggctcattcattgcctaaacgcggttctccctccatcatctgtccctccctcttcctcctctcttgggattcacctgtctccgcccggcccggggtcacccaatgacctgagaggagggaaagaaggagttcagagaaggaaagaaagcttttcaaacgactacctccttgtagtcagttgcatactggagtcttcagctcctctgcctccgttgttctcgtttctggagtagggatgaggcatttatttcttagtttccgagcgggaaacagccccaccccgtcactcttctcgggaggtggggcccattgcgagggggcggttcggtaggaagtaaaaagttgagtctttagttgaaacgttgcagacctagacttttcttatacactgaagtatattaacacatgcaaaaacttaccagagaaatgagaatataagaacttttgagatggattttgttgacgctagctcagacttattccctacggttcaaatgtgtgcagtttgtatttttttaaaccataaatgcattgatgtttgcagggactgtttacattgtaaaatatgtcctgtagccttggagctataattaacacattgtagcacattttttgtttggcatttagtatgtgggttccccctttcacgcaaacgtttccttatgatagaattaactgtatttgccaaatttaagacttttaaaatttgggatgtgtgtgtgaaagtgttagccttttcccccgcagttataatttatttcacctgtttgaaaagtagaacaactctggggattcagtttttctagaaatgaataatcatccatttgaactaactttgattttacaaaagtgtccatatgccctacagatttagtgaattcattttgaaaaacattagaaagtcacatgcagtgtcgcaaaactgttaccttgaaattcttactggaattttgttttgttttaagactaagagtgtaggtggagctgtaaaatagttttaggaaaaaagttacttttaaacccttaaaaagactaattggtgtgcaggtagaactgtaacataagtttagaatagcaatttatctttaatctctttttcacaattctttattttgaaaaaaatgaaactgaaaagttgagagaacaaggaacactcataaacctttacttatatttatttgccatatatgctttctctctccctatgtatatgtatatatacatttgtataaaagtaagttgtagatg

SEQ ID NO: 113088 - DNA, 1009 bp, Homo sapiens
ctttttaaataaatcaaacttttaattttgagaagactgtaataatcacgtagtttaaggaataatacagtgcactttactcagttttcccaacactaataccttgcaaaaccatggttcattattataacattgatacaatccaccagtcttattcagatttccccactttacttgtacacgcgtgtgagtgctcgcgcacgcgggtgcagtcatcccttggtatctgtcgggggttgatttcaggatcccgcgagattccaaaatttgcaggtgtttgagtcccttatgtaaagtggtgtagtatttgcatataacctatgcgaatgtatactttaaatatctctagattacttataatacctaatgcaatattactgttatatagttatactgtattttaaaaatttgtattttttattgtatttttaaaaatagtttttacctatggatgcagacaccaaggataatgagagctgactgtatttacttctatgcagcgttatcccatgtatagattgcaccactacaattaggctacagaacaagttccttcagtccaaagtacccccctctgttgcccttttagaaccacatccattatctctcccaccgccctcccatcccctctcgctgcaggctccagcaaccggtacatgtcctctatttgtataattttgccattcttttgggtttagagatagagtcttcctctgttgcccaggctggagtgtagtggctatttataggctctatcaaaagggcactgtaacctcaaactactggactcaagcagtcctcccgcttcagcctccggagtaggggggatcactacagggctactacatccagctaatagtttattcctttttattgccaagtagtattccatgatatggatgtaccacagtgtgtttaaccatccatataatagcaatttttgattaaacatcttaatttttttgtggtagtgttagtggggcaaaaacctgtaagtttattgccaaaa

SEQ ID NO: 113089 - DNA, 1157 bp, Homo sapiens
aaaaggatgggatgaatttaatgtgacatatactatgtaagagtttattttattttgtttgttttttgagacagttttgctctgtcacccaggctggagtgcagtggtgtgatcttggctcactgcaacctccacctcctgggttcatgcctcagcctcccaagtagctgggattacaggcgcctgccaccacactcggctaatttttttttttgtatttttagtagagatggtgtttcaccatgttggccaggctggtcttgaactagtgacctcaagtgttctgcctgcctcggcctcccaaagtgctgggattacaggcatgagccactgcacctggtcctatgtaagagtttaaggaagacttgtgtttgccagaagctggtttttttttttttggtctggttttttttttgttttgttttgttttgttttgtttgtaattacaaacttttaacttatttggaaaattaagtcattagaaaattgtggcctttgcctactgttgatgctatttgtttatctaaaagtttgaggaggttaccagatatttataccactttgttaggatctaggttaagggtaggaaaaatgaggttgccagagtagaacaaaatccacaccttagattttaacctgcttggaaaagatggacatatcctaatgcctttcaatcaagtattggtaggttggttgctgttgctgctgcttccttctctcttttttgctcttcaaatgttaatgtcagttataagaaaaatctaagttgggaatagttaaaatattgtacatcaataaatgtagttttggactttagcctgaatgatttaaattgttagttgtaagtgttaaaggacagaatttttctttcctagaaaagtggtgagagaagttaaaatagcatgatgattatgtttgtgatttgtcactatttgccaggtaaaatgagaaatctaccatttgccaggctctgctctaggtgctttagaatagcactgcacagtagaattttctgtgatgatggaaatatttgttatctgctctaatatgatagccattggccatgtgtaggtttgttttttgttgtttttgttaagacagggtctaactctatcacacagtctggagtgcagtggtttgatcacggctcactgcag

SEQ ID NO: 113090 - DNA, 1023 bp, Homo sapiens
gggaggctgaggcgggtggatcacctgaggtcaggagttagagaccagcctggccaacatggtgaaaccccgtctttactaaaaatacgaaacttagctgggcgtggttgcaggcacctgtaatcccagctacttgggaggctgaggcgggagaattatttgaacccaggaggtggaggttgcagtgagccgagatcgcgccattgctctccagcctgggggacaagagtgaaacttcgtctcaaaaaaaaaaaaaaaaatctagtgagaagtgaaaatcttttaataatgtggtaaatttattctttgcttgctttttaagtgtgtgtgtgtgtgtgtgtgtgtgtgtgtgtgtgtgtgtgtgtccaggatttcactgtgttgcccaggctagtcctgagctcaggtgatcctcctgcttcagcctgccaagtagctgagattatggtacatgctactgcgcctggcctgtttgcttactttttaatttttgtctttctggagtgagatgcagtatgaatgaacaaatatatgtttttgttttaaactgacagcatatatttttaaaattctgtattgtgttagaaacctgaaatgttttaaaaaatattttttaaaaattcttttgcgtcaatagagtgggttaaaaatacttgtttgtgcagagtgaccacagttcagttttcaatagtagtagatggacaacactatattttcagaaaagcagactaaagcttaaaagggaactgaatttaatgttccattttttagatgtgtcaaagtcttgcagtcctgggtcattattggggctcaaactagttatttgatgataatagaattgccatccaaactattggagcgctggttaatgaacagtttccagaggggcgggcatggtgctcggtgtgattgggggactggagagatactgtccagctggcctcaactgaagggatccctctccttagtgtgcagtcttatatcttttaatatttctgcttctgacaatgaagttctgacaga

SEQ ID NO: 113091 - DNA, 1732 bp, Homo sapiens
tatttagagaccttccttggctagcagtcagtccttctcaccttattttcttatttcttactttattctcatttatcagcttctgacatacatttacttttatgtttatcacgttttccacaattaaaatgtagggtttatgaagataaggacgtctgttaatggctctattcacattggttaaaatgatgtaccatagtagatgtttaataaatatttgttatgtgaagtgagtgtgaaaatagtgattacagggcaagagagaaaaagatctttggattgtgtgcttgcataaatttttggagaagggagttaagctgggctttggcattacagagtacattagtgtatgaaataattgtaggatattgggcagagcctatattatggtaagactttgaagtttaatttataaatgaattatagtatttgtttatatagcctttcatcacaaaagcataataagaggaaaattttgttattgtttctttggttttggcattggaggagaaatggtatcaggattaaatgagtttgttgtgaggagcctgctgctgtattagaatcttcagatagtagggctcagccatacgtcatttcataaagctttacaaccgattctgacacgaagtcagggttgatgaccactatatatgatattaagaaatagacctgttataaaatttaaaatataaaatgttagaagagctgggcgcaggggtgcatgccagttactcaggagtctgaggcagcaagattggttgagctcaggagttgaaggctatagtttgtgattattgcgcctgtgaattgctactgcactccagcctgggcaccatagcgagactctatctctttaaaaaaaaaatttgagggaaagtaatcgtagtgttagagttgctttgtgtttttcagaaaatttaaaaatcaagtttaattcttggtatgctgggaagctgatgtggaagagagaacaagtcacataacagtgagcttagccagcaatcagcattcatatctaaatacaattttgctctctatttacaggcaatatcctgttgaggagacaaacttaagattcttagtgagaaatagttctgaaaagaatgtcagttgccaattctgatagtaagaagggtgagtgaagaggcttaaattcagtaatagttctcagtgtaaatgttagggtgtggaaggaattttatgctgtggttgtattcttgacttttggaaatttccctgaaatgccagctgtaggcttaaacatctaagttgttttatgatacatgctgtacaaacttgtattaaagttgtaactttaagaacactagtctaacttgttgcctgtggtttttttcctcctaggtaagataggaaattatattgttcactacttaatatggcattaaaataatcccttacacttttaactaaagcaatcttttctttccttgttatttagaagtaaaatagcttgtaatcccatcgctttgggaggccaatgtggaaaatctcttgaagtcgggagtttgagaccagcctgggcaacatagcaaggctctgtctctgtaaaaaatgaaaaagttacttggatgtggtggtggtgcaaacctgtagtcctagctacttgggaggctgaggtggaggaccgcttgagcctaggagttcaagactgcagtgagctatcatcatgccactgcactccagcctgggtgacagaatgagaccttgt

SEQ ID NO: 113092 - DNA, 1022 bp, Homo sapiens
tatctattttgagccagattttatgctagactttttacatgttagctgatataaactttgtgacactcccttaaggaaattgtaagtatagccaatacttaatgactacattgttacagtatatttctttcttttttttttttttgagacggagtttcgcttttgttgccgaagctggagtgtagtggccgcgtgatcttggctcactgcaacctccgcctccctggttcaagtgattctcctgcctcagcctcccgagtagctggggttacaggcatgtgcctccatgcccggctaattttgtaattttagtagagacagggtttctccattggctggcctctaactcctgacctcaggtgatctgcccgcctcggcctaccaaagtgctggcattacaggtgtgagccaccgcgcccggcctgttacagtatatttctaaatgctttatatacaggtaattccactgtatcgggacatggagattcctaaaagtcgctgcgctttgcaaaatcacgcaataaaaaccacagggcttatggggaaaatgagtttgaccacaacattaaaaaacattattagtgacagattaaaaacaaagataagaacttaaaatggtagtactgttttacatatgttaaatggttaacaaatacataatactatgatgtaaatattgcactttaccttgaaaaagacagtgcttgcttgcagaagtgggcatctgaaggattacagtttgtaaattattgtgaagtggagaaagtcaggttatctgaaatctgatggtaagttgtaacatcagatgtagatgggtgtggttcattgtggctcacaacatacaaggggatctgaggtagttgtttgaggtgtgtgtctgggtgctgctgtgcatgcctatgagacttgttttggctaggtgctgttttctgtgttcatctagagtttctaatagatgaaattcatagaagcaaacatgaaatttaaaatgttaaaaatgctccccatgaattgtgttggag

SEQ ID NO: 113093 - DNA, 1070 bp, Homo sapiens
gagttttgctcttgtcacccaggctggagtgcagtggtatgatcttggctcactgtcacctccagctcctgggttcaagcgattctcctgcctcagcctcctgaggagctggaattacaggcgcctgccaccatgcccagctaattgttgtatttttagtagagatgtggtttcactatgttggccaggctggtctcgaactcctgacctcaggtgatgcaccttggccttggcctcccaaaggtctaggattacaggcatgtgccactatgtctggctaatttttgtatttttagtagagacggggttttgccatgttggccagactggttttgaactcctgacctcaagtgatctgccctcctcagcctcccaaagtgctgggattacaggcgtgagccaccgtgtccaactcctgtggcagatttctgaagcctcttctatatatagttctctgtagcaccctgccccataaattccagcagtttctaattctcatatctactcaggtcagtgagactgctaagctctgtttaggtcccccacccacacccctacacctcttacacctattctgcagtctggaagatgcttctagagacaaatagggatttttcttgggatttaccctgcttctcttctgaaacggtagtcctgtattggcttttgtccaacagctgaaaacagctattttatgtttactttccagttttatagttggcaggaacctcatctagtgtcagttattcttatacatttgggagcagaagtctcagagtgtatggtgccagaatttagcacatgcgactttattatctattagaacaattcagtctcttgttttttgaggcaagtcttgctgttgcccaggctatagtgcagcagccttgtcctcccagattcatgcaatcctcccacctcagcctccccagtagctgagactacaggtatgtaccaccaggcccagctaatttttgtattttttgtagagacagggtttcaccatgtttcccagggttgtctggaactcctgctcaagcaatctgcccacctccacctcccaaagtgct

SEQ ID NO: 113094 - DNA, 1044 bp, Homo sapiens
cagcctaggcaacatagtgagtccctgtctctacaaaaaataaaaatattagccaggtatggtggcgtgtgcctgtagtcccagctacttgggaggctgagatagaagtattccttgggcccaggtggatatggtcgctgtgagctgtcatcacgccactgtgccctgcctgggtgacagagtgagtctcagtcttaaaaaaaaataaataaaagaaattctataccatttatttttctgttctctttctgcatcactcagttgttggactttactaatctatattttgttcctttgtcttttacttcctgtatttgaaccttttgtattttttattggcattttaccgagatttagaagcatatggaaatagcattctgttgtatttaacagagtagagaaatttagcgttgaatttaaagttgtttgtattccttgctaaacttaaatttttcttttttgttttgacagaggtgttatgaacataaacagtatagaaatggattgaaattctgtaaacaaatactttctaatcccaaatttgcagagcatggaggtaagtgcaagtagataaagctttactacatacctgtctggcctctcttactggattgtattcttcccagctgccttaactgttttccagagagaacagaccctctcatctttgacttctgtgagaaagtgaaatttaatactgaattttgaatttaatatcaagaaaatgataacacattttacttgagttctgatttattcttagtttgaatattacctctgtaggaaaagagaaataataggatagaatgctaaaatttactttagaactttggttgagctgtataaattgtatgctttataatcttattcagaaagtgaccatttggtcctttgctcataaactatcatattttttatttatgtttttcagtttctcaagaccaagtcatgtttaagacatgatttgtatattgtaatgttctgaaagtttataggcttttgcttgtgtgaaggtagattattggatggtgagatatttgtaga

SEQ ID NO: 113095 - DNA, 2084 bp, Homo sapiens
taatctcaaataatcattttaaaataaatttaggaaaataaaaaatgtaggaaatttatgtgtattttttaaatcactgatgagtttaacccgtatataacctaggttcacagaaataaagtatattttcaagataaagtttttatattttaatgaagtagatatgtaaggttatcccatggaattcccctgaagaatgaattactagattatctttctagtcaaatagcatgcattttgtatcttttatcttaaaaaaaaggagagtctctttccaataatagagtctggaaatctgtgtttacttggattgccaattttaaaaatgttttaaatctgcaagaaagtggaaagtatcttagtaatctccttgacatttttaattcttaaggcagtgtagcatttgtttttgagattatggttctgttgttatttatttttaatatttatttttttaaaatgttccttttcttctttgtttttgaaaatagaaaccttggctatgaaaggattaacattgaactgtttggggaaaaaggaagaagcttatgaattggttcgtagaggtttgagaaatgacttgaagagtcatgtgtgtatcctttttgagatatatttaaggtttgagtggggtgttttgagctaaggcagcaatttgagagtcaaagttttagatctctcttattgtgctattacagaggaaattattttttaaatagggtaacagcaactgccttcattcagggaacatttttatatacctaaccatgttttaacattctcttatttcacagataaatggaacttgcctttaaaaatatctgtgaaagcttttctcactcttaaaaagggggcattgctagggtctgaatatttgtgtggcactccgctaccccatttgttgaaaactaatcaccaatgtgatagtggtaggtggtgggtctcaaaaagaaaaaggatataaaataaggaatattagagcggcattataataccctggtttagagcacaagcttttggagtataggcttagagtgtgcctcacttaggttcaaaacccatttcagcttctttctgtgtgatcttagagctcagtttcttcatgtgtaaaatggggataatcatacccacctcactgtgttggtttaaagacttaatgatgagatatataacatagcccctgataatgctaagtaccatattggataaatagtttattaaggaagagtaagagcaaatagaaatgtctgagggaggatagagaaaaaattgtgggttgctatttttaagatagactttagcaaatatttctataccaactttgtgggctgacacaattttaagtgctgaaacaattagcaatttttcagatgtttaccaggcccttggcttagtacagacaaagaaaagataacagattttgctctcaaagaacttacagtctggtgaaggaagatactgattagaaacatttacagaacatttaggagtattacataagatgttatggtttattcaagtaattgtcactaatccagtaaagcagaagtatgtgaattgagagtgactagaggactagaaagacaagcaaaggcttaactattaagactgtcatagatagatgtctttccatcatttttaatgattgtatagtgttctgccaatgttttattatgatttatttgagttcctcttgatggacataattttctttaaatatttggcaatgttaaactctttgagggtgggatttttaggagatgaagatgagagtcagttgtgtggctgttgcaatatttaagagaggtaaagtcctgaaatacaggatattagtgatagaaatgggagggagtggaaagataggtaatgggagctagattttaatgggtagtgtttcctagtttataaaaccatgatccaaacggctgagaggatttgatccagttgcactttgtcatttgtattacggaaatcaagattatttttcaaataaaatttgtaatattttgacttgctttaaaaatgtgtaatattaaatatgtgtttttagttcatgcatgccatcctaaacattctggggtttt

SEQ ID NO: 113096 - DNA, 1740 bp, Homo sapiens
tttgcctccataaagctacacaatatggatgtttgaagtattttctattattgttcccatcattgtgttgtaaaatgcttggggttgtgggataaattaatgtgtgttttttttttttttttttgagacggcgtcttgctctgttgccaggctgcaacctctgcctcccgggttcaagtgattctcccgcctcagcctcctgagtagctgggaccacaggcgtgcaccaccatgcccagttaatttttgtatttttgatagagacggggtttcaccatgttggccaggatggtctcgatctcttgacctcgtgatccacccgccttagcctcccaaagtgctgggattacaggcgtgagccactgcgcctggcctaatatggagatcttttaaaggagcacttgctgttactaaaagcctaagaaaaagtgtttatttttttccttttaaaggaaacgaggtatcagttacttcagcttcgacctgcgcagagagcatcatggattggttatgctattgcttaccatttattagaagattatgaaatggcagcaaagattttagaagaatttaggaaaacacaacaggtaataactagaagccattttactaagtctgatcctaagtataactaaaaaaataatgtgcatagtctggcttacttttaattttgaaatagtttcaaacttatagaaaagttgcaggaatagcacaaagaactctacataggggttcattcatactaaactaattgttaatatttggtgcatttactttaaaatttgtgtatctatttatctattttaattttcttccttaaatgtttgagagtaattgcaagacatcatgctcctttacccctaaatgctttagtgtgtattttctaaaaataactgtatagttttcagttctctagatagtattatagggatagattataaaaattaggaaatttaacactgatagactgttatctaattaatccccagcccatattcagaatttactaattgtcctagttatagcctttctagcaatttgatttcattgcaggatccaattaagaatcataccttacatttagttatcatttctcttcagcctcttttaatctgaaacagttttgaaaacttcctttgtattttatgacatagacatttctgaagaaggctgtgcttttgtaggatgtccctcaatttggatttttctgatggttcctcattcttagatagagttttataattttggcaggaaaccatataaatgatattgggtccttctgcgttcattacatcaagaggcacatgccatcagttcgttccatttgattacatggtgaaagttgtatttgcagttgtaaacgtatttttctctctttgtgtttaatatgcagtttgagactgaatagcctattgctcatcaaactttcaccatctagttttagcattcattgattatgattcttgcctgaatcagtattactatgatagtcgcaaaatggtgattctcttaactctagtcattccttgtaggtttattatttggcattctactcctgagtaagagctttcccttcttccccatatttattgtgtgtaaggacttatggattattattttattcaacctgttatatcctaatattgtcattatttactcagttgctctgtagatacttaagaattttttaaaaattagttttatcaaccggatgttatcctttgacttcttacatgtttt

SEQ ID NO: 113097 - DNA, 1400 bp, Homo sapiens
catatataatagtgaaaccactgtctctctctcttcatctggcttgtttccttccataagaaaatgtggagcaaataaacagttgggatgatctgggctttaaaattagtaaacaaaagagcctaggttttaagattgatttttgataattggggctgctaatatcattcagggatgatgtgattggtcatgcagtccagggaaggcaacagtgagtcgacaagttgctgataggttgatagttttttctctgaagttgaatagtaggattagtgagacagaaagaaaagacagttaagcttaaaataggatgcttaattgcttcttggaagacattaaaaggtaaagtctagatagtttttaatgtagccagattaagggctgctatggcagaattgttttgtagctgattaagggatcataaggttaggatattgaattgagtcattaattttgatgctgaagttgttccatatgatatcaggaataattgaggagtagaagatggcttggtgacagtgtgttgagtgaatgtgagaatctggccgggcattggacagattttctgaataaattgaggatgtgaagaggatggcatttctaaataatgtgaacttcaaaaaaggaaggagaccataacataacttggtaaatgatcttaagggaactggaaccaggtccatccacttagcagcactgatttataatgagattttaagagaaattttgaggaaaagttaaaattctaattggaaggttttctcagatattaaaattttttttttttctgtttttaatcaggggaacttctgttgcaactatgtcgtttggaagatgctgcagatgtttatagaggattgcaagagagaaatcctgaaaactgggcctattacaaaggcttggaaaaagcactcaagccaggtagtattgtttaaaacttactaagttttattgtttcttttgttaatatatattttatttactcattgaaaagcacaactagaataatagtggttaagaattggttcgaaatctgaatacaggccaagcgcagtggctcgtgcctgtaatcccagcactttgggaggccgaggtggatggattgcctgagctcaggagttcgagaccagcctggacaacatggtgaaaccctgtctctactaaaatacaaaaaattagcctggcatggtgatgtgtgccttgtagtctcagctactccggaggctgaggcacgagaattgcttgaacccaggaggcagaggttgcagtgagccagcatagtgccactgcattccaccctgggcaacagagcgagactgtgtctcaaaaaaaaaaatctgaatacaaaagtacatttgcaaacttctatttaatatgacagattgagcatgttctgaaac

SEQ ID NO: 113098 - DNA, 1150 bp, Homo sapiens
gaatagtaggagaagcaatatatggaaacatgataaccaaggctttttcagaactaaagaagttctcaggttttaaaagcctacctaaagcagaacaggataaagataattatgtacttaagataaaaaaaattgaaaagaaatagtctaaaataattgttgaaatagtagatgtaagattacaaataattccaattttcttttaaatattagaattttaatatactttgagaagttcgtaattttccagaaaaaatatacaatttatgattatatataacaaagaatttttctttgtttgcagctaatatgttagaacggctaaaaatttatgaggaagcctggactaaatatcccaggggactggtgccaagaaggctgccgttaaactttttatctggtaagtgagaataattgcaaaggaatagaaatgcttttatgatttaaagtttcttttcttggttttaagtatgagtatgcatattaagtttaagctatacattgttagagttgtctaacaactctgctaaatgtaagttggtaaatgtaagtaaatactttggtaaatgtaagtaaatacttgataaatataagcgaaaaggatttttctcttccaaggtgagaagtttaaagaatgtttggataagttcctaaggatgaatttcagcaagggttgcccaccagtcttcaatactttaagatcattatacaaagacaaagaaaaggtaaagtgaaatatgatactttcttttggctaccatttctttgctcggtatttggaattattgattcttgattatctctgcacagtagtacgtgttttgtgaatctcatgtcagtcttcccagtttgcagtttaaatgcttctgattcctcttttttccatttcatcctcttttttttctttagcccagtaacttattgcttgttttctgtttcctttctgctataaacttttaatgagtcactgtaggttataaaaagttgataaggtaataatttcttcaccattttctttcatcttgttcatggtcagaagccagagtgtgcttgttttttgttttttttttaacttaagttttagcttagtcttctttctcctttttaaatttggtagacaaaaagttctgtcagaagagtttttttgatg

SEQ ID NO: 113099 - DNA, 1738 bp, Homo sapiens
agccaccacgcctgacaaaaattaatactttcttaataataactattcagtccatgttcacatttccagttatgttataaatgccattttttttttgcctttccttttttgaagtttgttggaatgaagattcagataagatgtgtactttgaatttggttgatgtgtctcttaaactctttttatcttttgggtttctgtcctatcccttttcctgcaatttatttgttgaagaaatttttttattttttttttcagttttcccagtctagagtttgctgactgtaccccatgtgttgcttaacacattattccttgctctctgaatttcctataaactggtagttcagtgtagaagtttgttgctagtatgatagccagtagcacagtggctaattaaaattttaaaaaattaaataaaataaattccattccttggttgcagtagccacattttaagtgctgctcaatagctatatatagctaatgcctaccatgttggaaagggaaaatacaggacacttctgtcatgacagaatcttctaatggacaggtccaactagagatttgatgagattcaatattgttttgatggttttgcttttgttttttaaacagaggagtgagtgagattcttacaggtggtggcatattcttctattagtaggcatacgtgttagttttatatgttagcaactgttaagaattaccaactggtgatactctattattctttattattttaaaagagaaaattttcttcctctattacctgtttacacaatgtttcagtttacataggaaaagcatgataaatggattttttctccccactccctcctttttaaaatttctttaccagttttcaaaataatgaattgttggttcaatagcatccttcaaagacagcaaatacgtttttaaaaagtattatgaattcatggatttaagcatatttgatgttttatatcaaatatttgatgttgcatattcagcatattaaaatatattaagaatataatcaccaaattcaaaataaccacattacaaatctcaaatggtcccattctttacataccatagtagtagttgataacttcttgggtgttaataagacaagatattccagtttattgctgccactgcagatctggaatcaattgtttttcctaggagttctggttcctgtagtgggaaagcccggtatgggaccctgggtgcatattgctattgggttggtcattgtttctaggtctcagattaatttaatagtacttttttccatgatttcattggttaatcatcataatgttcctttgattatcagcattttcctacatattttacaaatgtggaagaggttcaatgacttgcccaagaatatgcagcacttttgttgcagatctgtcagatggggagttggtgagttccactcctattatttgtccactgagccatcctgcttttactaggaaaaattttttaaaaagcaatctgttgctttctttgaaagcacgtatcagttctcagattttagaaatttgtattaaaaaagaattttttaacgtgtgggttgtatatttaacttacacattttcttgtcagtatattaaaattaaatcatgaactaaaatataaaaatttttttacttgtcatctcatttttggggtatagtttttatttgacttaaattatgcatctttgcatattcagcatattaaaatatattaagaatat

SEQ ID NO: 113100 - DNA, 1479 bp, Homo sapiens
gctttttttttttttaacctcacatgaatagagaacatttttaatttcttccccctttataaataacatcctgatcagtatgctctcatagttctagtacagcttgtctcccccctacctgtttcagttttctttctaggtagttagaccttatttatctcccatgtttgtttcataaagttattatatgaaagggattgtgctaggggttataaggatgcagaaaagaaaatatggacctttccaaagatcttataaacttaggaggagttttatagctagatacataaataaactcctttcatagtacctcccttgttaataaacatagggaccattttggggggtgctcttaatatatgtaatgcctcatcttggtttcttctccctcttctcctaagatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataaggtaaaaatctttttttctattttcttataaggtaatgagacttgtcatgaactttttctctgtattttatagattctaaatataggaaaagtgacatttgataactcaaaaaacatgaagtaacaagtatagtacatttctcagtccaattactttgagacttgtggtcatgctaatttggtgatttatctatatccgtatacacacacatacgtacatacattaatgtatatgtattcacacgtatctggtaattctcttgggtttggagagtaagagtatataggtaatccaaaagaaattttatttgctgtgaaatgtgtatttctattaaaatttgagtatgataacatatcagtatctggcaatgttattgagatgaaactgtgaagattctattatgaattctacaggttatctcttttgacttctcaactcctgggccttgcttgagaatttttagtcatatattttagtatcatcttaaaataaagttggcttttctctgtcatattgcaaataaaatttagtaatgaaagctcttgagggactgataataaaccagtaatttgtttagcaagaaaataatgaaattaagtaatatttaagaagtttttttgtttgtttttgtttttgtttttttttttttgagagagagaaagagtctcactgcatcacccaggctggggtgcagtggcgcgatctcagctccctgcaatgtctgccttccgggttgaagcaattctcatgcctcagcctccggagtggtagctgggattataggcatgcaccaccatacccagctaatttttgtattatttgtagagatggagtttcgccatgttggctaggctggtctcgaactcctggcctaaagtgatccacctgttttggcctcccaaagtgct

SEQ ID NO: 113101 - DNA, 2432 bp, Homo sapiens
tagccaagattttaattaaatcactgtatcagaagatactggagtcaacattgatataaaggattttccatttagagggttgtacaatggacttttaaactggtttatattcatgtacgttcagataaattttttaggggtcaagggaactaaaatttattgaatacctgctatgtggtggtgttctttttcttgtattaatccctaccctcaattatgtagacctttgaaactacatttgtgtttcaaagtttcacagtgttgaacacacagtgtgtgttcaaaagtttcacagtttcacctgtgaaactacaaattatttttagtagttagagaatatcagttgttttcccatgttaactattctttaagaatgttttaaaaatttttttgaaagagtcccaatcagcttaacatctttgttttttaaaattctgtggtagaatgatgtctatgataaaaagtgatcttgaaaatatttgatttctgtataggaaggaacatcagcggtagagaatttgaatgaaatgcagtgcatgtggttccaaacagaatgtgcccaggcttataaagcaatgaataaatttggtgaagcacttaagaaatgtcatgagattgagagagtaagtaccttctacataaaagttttcttgttttattctgtcgatggttttggacaaatttcatagtttttttctcttctatttctttataattcatagtaggtgctttttaaaatcagtattcacttttttcagttttcatactggaaatatagactgcattttcagccagggtctctattgtcttgtggtaagaactcttttttaaaaaactttatggaaaatttgtatcttggctatgtttttattgatttttgaaccttccaaattgctgctgccgctttagtagtacatacacagctgattaaagtactcctaggaccctgttcattgtagaatttattgatgatgccatatacccttggtaagatataaatgttggaagacttttcacaatatttcttctgtagcttatctaatttcatgctgtttgataaaattgttttcttaattctcttcacgtctgactcatttccatgactagtggttggtttttcttttttgtgttttacacagataaacatagtttatataactaatttcacatttgcaatattgtcaagtatagaataccaaagcttagttgaaatgcatcaagttcctgattgcttgacttacttgctaattgatttcttttccacataccagcatcacattgcataggattcagatttgtatcctcaaaaaaaaattatcaaatacatcttataatcctttgcaaatgattctaaatataaaaactcaatgtttaacatgtgagtctacttgcactactatgtaaataaattatgtttgatgttgtcacaatagctttaagtataattaaggaagggataatgaataaacatttttaaagcttcctttttcaacaaatgattctgtgcctgcagtatgccatatcctgtgctagacaatggctaactgtatttgcttatttgaaatgcaaaatattcctgttgaataattgtaattgtttttttaaaattttactagtttttttcatgccaaagtaacaagtattccaatgctttgattttatagttttcttagccattgctgtacttcggtataataataaaaagataattttgttagcattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacaggtataatattcagagttcttcttgtgctctgatgtgtttatgtgtatttatgtgtattatgtttttcatttaatagtattgctccatgtcttgagcaccacgaggaaagatattatacaaggttctctaaacaacaaaagaaaaatgtttacttttatgcttccaaagttaaacaagaatttaatttgcagttattcattggcatttaagaagtttgcatgttatgagttttacatttaatatctggtttacccaaaattataaattgctaactattttacaggtactagattgctaattgtataattagtattataattctacattagtgttggctattagtattactagttatttttttgagatggagtctcgctctgtttcccatgctggagtgcagtgcatgatctcggatcactgcaacctcccaggttcaagcgattctcctgccgcagccttctgagtagctgggattacaggtgcccaccaccacgcctggc

SEQ ID NO: 113102 - DNA, 1910 bp, Homo sapiens
catgggtgacagagtgagactccgtctcaaaaaaaaaaaaaaaaaaaaaggctacatacatatggggacatttacatccataccatgtaatatttttttaaatttgttttttgagacagagtttcgctcttgtttcctaggctggagtgtagtggtgtgatcttggttcactgcaacctctgcctcctgggttcaagcaattatgctacctcagcctcctgagtagcagggattacaggtgcataccaccacacccagctaatttttgtatttttagtagagacagggtttcaccatgttggccaggctggtctcgaactcctgacctcaggtcatctgcccaccttggcctcccaaagtgctgggattataggcatgagacgccatgcccagcctcatgcaatattttttaatggaagtttggtaggatcaaataatacttaaaattactaatctgattaacatgcttgttaattttattaattaacttattgcctgcagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggtacttaataatagtgtttagcacaattgagtgacattttatgaccagctcttgtcatttttatactgtcttatttgacagtatataaccttatgtgatataggttttagagccaaaaattattttattttttagtattctttctttaatattttgtttctgatcgtgtttcatgtttaaaacttgaaataatgatcctgttccaaagtcatatagtatagtatggtggaaaaaattttggcttttgagtcattcagatctgggtccagatattagctcttatattttcactgtgtgcccttggacactttgtctaacctctctgatggttttctcatctataaaatggaactaagaaaatccttatttaggactggagaaaatacatatgtaaagcatctaatgtctgttacagtggtaacatgcaagtttttatgtctaggctaaattgagtttgttataaactgaggactatacgtgtatctcccatttacctctgttgtcagtttacattatttcttttctagcctaaggctgtaaatattttccctaggccaaaatctgacctgctggttttaaccattaagctgaaaccaagatactcattgtcacatgaaccattttgattaataacattcctttgtcctttcttttgaccctagacatcttcctgctttgtatgaaaataattgcataatttgttatgttaaagcaatataggaagcagtcgccccagactttaattttagcctcactagtaaggaaaggctcaaaatcatttccctgactgctttataaccaaggaaaattataatgccaaacaaatagagttggagaatatgttttgaattctgtccaccagagcaggtggacagtagtatcacgtagacatagtgatattgctatgagaaatatagccatgtgcctatagttccaactatataggaggctgaggtgggaggatcacttgaatctaggagttcaaggctgcagtacactgtgagctatgatcatgcctgtgaatagccattgtactccagcctgggagacatagcaagactctgtctcttaaaaaaaaaaaaaagaaaagtagcacacacacacacacacacacacacacacacacacacacacacacgaaatatagaaaaatccagttggattctacaaggatttattgacatgtttttacaaataattgtatacctgctagga

SEQ ID NO: 113103 - DNA, 1955 bp, Homo sapiens
acagggaatagtcttgtcttaatattcagtccaggagtagaatagtagcacaattgcattatacctgcctagtaatgattgcaagtatataattactatgacatttatgtaattaataaaaattggtaggaacacagttctataaatattaatattttaaaatgccacctcaccattaatatgtcatttgaataaatacgaattcctgtagaatttatagaacaaagcaagacagaatggatagtgtagtattttgaatagcttgattatacttcactttgtttgaattataaagaacattcactcattctgtcatggtctctgtagtctcctttgtacttctcctgtcctagtttacatctcttctttcttcccccttggctatctgacctgtttctctttctgtctttctttctctggttctgttttatctacttccttctttttggatagtttctatccagcaataataaagtatctagggttaaaaatcagttaagaattctagaattcaaaatccccttttttaggttataggaggttaaaatatgacagtgtttttctgggtgactggtaagtgattttattttttaaaaataagaatttttagtagaataaaatcacattccccaagaaccttagtttcatttgtataatatcttttatttttgttaggttgaaactccattggaagaagctattaaatttttaacaccgttgaagaacttggtgaagaacaagatagagactcatctttttgcctttgagatttactttaggaaaggtaggcaattagggtacagtggccctgacaaaactgatcactgtatttcttaggtatagtcacccaactctgatagccttaccactgtacgattatttagcaaatgccaacgcagctttctcacagaaatgcctgctatgaacagaatgtgtagggagatataatgatataatcacttcttttaggatattagaatcaatgatagatgtacataacataactaggattcaggtcagatgtaattaccatgtatatggttcaaagaattgatcatgtggataaaattagttaatacacagagcttagacctagtacctggtatatagtaagcattaaataaatgttagctattattagctattgttataaatagaagataaaattttgagcctggatcttgaaggatggattatatttctaaaggaaaagatacatagaaggcaagagtatctgttaagaaaacataggagtgtgtaaataatgttgaggttgtctgaattgcctggagcaggtaaaagatgaatgaagggtcttggtttccaggtttagaatgcttagaatatatatgtagtagataataagattttagagtactgagttaatattttccaagtggttaattgaaaaaagagttcgtcacaaaggtgatgcatattaaaggaaagagaaactgtttaataaaatcaaagagaaggttgttgctctaaacagtatatctactaaaggaaattgaataacatggtacttctctatatgagtatccatttaaaaagtcatgtttggccaggcgcagcggctcatgactgtaatcccagcattttgggaggccgaggcaggtggatcacctgaggtcgggagtttgacaccagcctgaccaacatggagaaaccccgtctctactaaaaatacaaaaaattagccgggtgtggtggcacatgcctgtaatcccagctactcaggaggctgaggcaggagaatcgcttgaacccgggaggcagaggttgtggtgagcctagatcacgccattgcactccagcctgggaaacaagaatcaaactccatctcaaaaaaaaaaaggtcatgtttatcaaaagtaaatgatgttggggaaaagttgctatattatattattccaaaataggacacagaactacctataaattgaaatttt

SEQ ID NO: 113104 - DNA, 1050 bp, Homo sapiens
tcacttgagcccaggaatttgaggccagtctgggcaacataatgataccctgtttcaaatcaaaacaaaaccaaacatatatatatataatatatatatatatataatatatattatatatatatgcgcttcctatacattttttaatttcttacggcaaaataatcactacaaatcaaagtcagtggtctcttctggttcagcattggcattacaaagaagcaggtgtaactaaacttaaatgtatatcataaaatgaaggtagagctttcttttatttcttttttcatcattgggctcttaaaattcactcagataggaccatcgtcttccatttctcattcttatgtaggtatcagagttgacagtgctaaacacctgaaattatcttcacagtttgtgagaaatctaagtcaagggtctgtgccaatgagccaaaatctgacctttatgggaccatgtgggtagtacttttcaaatacttggcttaagcccagcagctttgtatacctttgtggaatcctgaattcagcattttggctcacactgttgagataggatagtcccccaacctccacattattctgcttatttcagaaagaagactatcatggtcctaccacaaaaatacaagtattattagaatgcttgtgtttcttcatagtctcctttactgtgcatgtgttgcatatacattctattttattgggtagatatatgtggtatacctctattgttctctttctttggatggttaagctaatccccttagcattattattttttgaataacagtatctcaagtagctgttcccattcttctaataaagtgccacaccctctgcatatatatcttgtttgccttttatatttaaataagtagaggataagatgttggttttaccttgaaataaatttcctatttccctctcatttagctgccaaaatggtatattacttagatccttctagtcagaagcgagctatagagttggcaacaacacttgatgaatctctcactaacagaaacctccaggtaaagagtttttc

SEQ ID NO: 113105 - DNA, 3882 bp, Homo sapiens
gcatgtggaaactaagtagcttttctaagtgaaaatattaagaaagcaaacatgagaaatgcaaatcaacatgaatcaacaaaaaagataagaagcagacttacttaggggtttggttgaaagaattactcattttcatgaactaatttttcttgcaaataatcacttcatgtttgagacactcttttctgcttagttattggatgtgccttaagttgctctttaatttgaacacaatgttgaatacagtgtttgagtttgctggctggctctaagctttcaaaaatattagaaggcatatgtgcagtaattggtattggcattgtaaatctagatgtttatacccagggccaggctaggctgaggtaacattgctgcctaaggtcatacgcttgctgagagtgagtggctttttaaatgtagcactccatataccttgcttgcctcaccatagtcccattcctgtttctgcagtcatccctgtttagccttttgtataaatcctgcaattctggagaaatggttaaattaggccttgaagaacattctaatagaatgcatatgcaggagtaaatagctaaatatgtgtatttatttcttattttagaaatctcttgctgttgaaatgtctaataaattcccagtaagaacctttttttgaccagttacaacatgactttttttctttccttagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtat

SEQ ID NO: 113106 - DNA, 1052 bp, Homo sapiens
aggcaacgactcagcaggcttttaaataaggatcagcggtagatactactctgaaaatacagacatacctaacccccaaatacatattctcttgttatccctacaagactgcattttccataaatgaatgaattactattacaaatcttacatgtgaaaggatccataattctgggacagacagaattcaagccgaacatgttggcctgatagggtagaacctggaaaggagatttatttgctacagaatcgtatgtcaagctaaaatttaccttatgagatttgttgaaataacattctggatagaactcccaaatctgtccaatcttgtttgtttcttaactggttaaagaatatttgataatgagttaggctatgttgatactgttgatcgccattcttgaatttatagacattgatggttttctctaattttacatactgggaggtctacattttttagtctgtcttcacataggtgccttgccttatgctttagttacttttctttgatccttgtgacttagctgttaaatatctggtataaatacttggtgctttggtacaacagtagtataatgtagttaaagcttttaggtcagacagaactaggtttaaatcctggctcaggtcccttagataagatactaagaatttataggtcatacagctgttggaaggataagtaatatactgtatagaaagtgattaccacaacatctgcacaatgtcattatgtttataaaaggttcctttctgtttgtcagtgttatacttgattattcttatttgtcttctgcagcacatttggccagtgtttcgggaagtacttttttttttttttaagacggagtctcgctctttcacctgggctggaatgcagtggtgcgatctccgttcactgcaacctctgcctcctgggttcaagcgattgtccgcctcccgggttcaagcgattctcctacctcagtcttccaagtagttgggactacaggtgcctgccacctcgccctgctaatttttgtatttttagtagagacggggtttcacca

SEQ ID NO: 113107 - DNA, 1628 bp, Homo sapiens
cgtgcactaccacacccagctgatttttgtatttttagtatagatggggtttcaccatgttggccaggatggtctcgatctcttgacctcatgatccacccgcctcagcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaattttgatagattgctgtccttaataattttggaggaaattaagccaaatgattattgtactacagtattttcagaatatgggaaatcaattaaaaatgtaatctaatctagtttaagatttttgtttaatcatcatggtggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggttttttattactattattatggttttaaaaagagtaactttatttctttttgtaaggaattaagtaatatcctttacagttctgtgaaaggacttattttttaactgtaatatttattagttttaaaatatttgtatctcatttgtaacaatttgttttaattttttatatatatgtttttatttttaaaaaacataccagttgaatggggttaaagctttcaatatcttaaaatatttataaaacatttcactgttgcaaaatcacttccaaaatgatagctatctaacaactaattactaatttttaaagaacaaatcacacatttaaaaaatctgtagaatttattttaactat

SEQ ID NO: 113108 - DNA, 1276 bp, Homo sapiens
ttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttgaagaagtagaagccaggggtatgctttcagcatttattgcaaccaaaagttaaccccatcacggttaacgagcatctttggtctcttgtggaatttgaactaaaactatgagccttattcaatatctataattctatgatttttttaaattatgggaaattaatgaaagatgtttacatgaataatgtttgcccttactgtgttatgaatgagttttttgtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatcatctgtcattgtcttcctttggtcatctaggttagaaaagcaataatggttttcttataatgtgtctacctgtatatttaaattactaagtgaactttacattttaagttgttttaaaatattattagccatttatcattttcagagcattctagtaagagcggaggatttgatatgattccacatacacccataaatccagaaggattagccacaccaacagaaagtgtcggattgaatacatacatggtaagggtatggaatgcaaatgagatgatcagggcaaatagctgaaaggaaacttcaattcatgatttaaagaaaatatagaaattttgttagacgttgtggtagattttggcagtctgaggatgagtctgagctgagaaccctggcaatcccttattcctgccctaatcacagtcaacatttccgttttttttttaatctgagatgaagtctcactctgtcacccaggctggagtgcagtggtgcaatcttggctcactgcagcctccacctccgggattcaagcgactctcctgcctcagcctcccaagtagctgggattacaggcgcttaccaccacactcagctc

SEQ ID NO: 113109 - DNA, 1721 bp, Homo sapiens
tgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggactaacaaaaacaactggaaagactgaatttccgacacaaaggaatgatgggatcaaaaagaaagcagtgaggagttcttgagtcttgtagtacctattcttattttaacttgcttcatccttgatctacctgagacactaagaaggaaattagttttccaagagctctttgaacctgtctaggactgtagttaaacctatttgccctatgggggttcttcacactcgaaaaactatttccttatcaccaacgacccacccagaaaggccaatgaggccaaatgtaacaatttttaacatttaaatataactattaaaattgcattaattgtgaacagtgaattaaagggttgtcttctccaggagacagtatgtggcacttttcgtaaatttcatttaatatataaaaatttaaatcactcactgcaacatgcatttaaaatcttccaagaaggtagaggtatcattttctgttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccaga

SEQ ID NO: 113110 - DNA, 1049 bp, Homo sapiens
ctggagagcagctgttgtgctgatctgtagctgtcagctgtgattcctgtcacctgagtcagtttggtctggaaagcgaaggccttccaagctgtagcagatagtgagctccagctgatgagagaaggcttcagtggaagaagagtgaggacataggcagaaggaagtttgctatttcttgtcagttgcacattgctttatgaagactacaacaaaagtgcttaatcccaggctgctcatgactttcatttcaggtggcccttgggcacattgacagagttgcccttcccttctttgcaacaccaggcttcctagagcacccggttgcatgctttgcagctaggtggcagtggtttcagggagatccagttggatccctgcttgaaagcttaagccaatggttcacccatgagaggaagttgtcagtgcttccaggaagattgcccaccaaaggaactgaatagtttttagatttaaaggcaccaggatagggtcactcttactctgtagaaagagaccgttctatacactgtgacggatgggccagggcctctggacttgcattctgataggtgctttaatttaaatgtgcccaaagggagtgactgtcttcaggagaaagatggcttgcattaacctcgatcaagtgggttgtgcagccaggtcagggaatacggtcagggagaggatagtgctggtcatgcccccgatgcagctatgctctgaatgatttcattcctgagagtgatagcattctggtcctggctgcagtggggtacaatttacgtcctaagtgggggctactctaattatcccattcaaatggaatttttttcaacattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttc

SEQ ID NO: 113111 - DNA, 1508 bp, Homo sapiens
tccatgtctaataagctctcgggtgaaactgatgctgggtgaccacactttgggcacataccaggtgtgcccagggaagagtgcctgggggtgattcctgtatcagcccctccctagcctttgcttccaacctcctggtctggcccgggaatgactgtgtgcatcttgatgtttaggtttgtccacccccgttttgggcccatcaaatgcatccgcaccctgagagcagtggaggccgatgaagagctcaccgttgcctatggctatgaccacagcccccccgggaagagtgggcctgaagcccctgagtggtaccaggtggagctgaaggccttccaggccacccagcaaaagtgaaaggcctggctttggggttcagagacctggaatagaaacttggatctatgcactacgtttatctgacaatgggacaaccagggactgctcatgctgtgacgtcacatcctctcaccatgcgttagcaacgactttctcgcatactaactaggtttgactgtattactcataccagatttaaaattagctagccttgcaacaacgtcctactgagaggtattgtcgagcatttgacataagacagcgtgatgttctttggtggttcaagtctaaatctgtaccacattcggagatgccaaatgattagactgaaacagggaaacggggtttttcagtcatttttagtcagtggtttttccatagtgcttttttcctatggccagtgcaaattgtgttagcacacttgcatatgtgccgtattaagggttgacaattactacatctttattctctaaatgtagtataatttgccttttaacctttgatctgtatcttgcaatagaatggctttggtttttttcttagtaaataggagcccacttctaaagtcatttcacccctcagccctattctctttcttagataccctttacaagagaaaacttccaaatggatttttgcatcaatagcagtgtgtaggtctctctggttctttctatatcatcattttattattatgtcctaatataaagtactggctcatagggccagggtattattatagaatattattctcgcatgtaaacaaagatatctttgctttaagatgtgagaagaaatgaatttactttgtttgcattaagttatggaagagttgtaatatatactttaagaaagaagagaagaaaactagtatctctaagcggtaactatggcaattttgcaatattttcagtagtgctagtaattttttcctccttgagtacacattaaatgtacataacatagcgcggtcaggcttgtggcacagtgcattgaattcaaaagtcaaacagcaaatttgaattctaacagaattcaaaaaaaaatttttttagtcagtactactaaggcagacacactgattactaggtacaaatcaaaccttgatgctaaaactcttcatcattgtaatttcaaagcacttacctgcttcaaaacattgtaaacta

SEQ ID NO: 113112 - DNA, 1042 bp, Homo sapiens
aggcttttttccacttttgatcactgctgtatcccctgcacctagaagagtgcccggcacatggtaccgcttagtaaacatcagttgagggactatcacatatgaataaaagcacaattacaatttaatagtgggggaaatggtataccttgagagtcaacagttttgtatgaaaatgtcatcctgttggcttcaaaaggctgggctgctgtcatcaccagctcctggggtgagttcatcaggagtggtttggagaagagaagcctgattgttacactgttagtaacccctgttgtagataagaaggcatgctggtaatcgatggctgcctcctggtcacagtgatttcccacctgtaacaaaggtggaggacttgcctagagtacattcttgcatcccttacatttctggttccatttgtgttcttactttgtttttttttcttttgcctcctcttctttatctacttttaatacaagctatccagttatatttgtgtgtgttttcatcagggactttaaatccttttttttcatatagaacaaggaaaaatgaataaatagttaagtcgagctgcctggcactgaccacacatgtcatttgcactctcagtgtgtggagacatgccttgttttgttttgttttatttcattttgtagtgctcaaaccttgaagttttggctgagtgtggtggcttacacctgtaatcccaacactttgggaggccaaggtgggcagatcatctgaggtcaggagttcgagaccagcctggccaacatggtgaaaccccgtctctacaaaatatacaaaaactagccaggcatggtggtgcacacctgtaattccagctgctcaggaggctgaggcacaagagtcgcttgaacctgggaggcagaggttgtggtgagccaagatcacgctacttgcgctccagcctaggtgacagagtgagaccctgtctcaaaaacaaaaataataataagataaatgagttaatatctctgatgtcctttgacctttggggagaaaggtcctctctaag

SEQ ID NO: 113113 - DNA, 1054 bp, Homo sapiens
gccaggcatggtggctcatgcctgcagtcccagcattttgggaggccaaggcgggcggatcacttgaggtcaggagttcaagaccagcctggccaacatggtgaaaccccatctctactaaaaatacaaaaattagctgggtgtcatggcgtatacctgtaatcccagctactcgggaggctgaggcacaagaattgcttcaacctgggaggcagaggttacagtgagccgagatcatgccactgcactccagcctgagcaacagagcaagactccatctaaaaagaaaaaaaaaaaaaaaaaaaaaaaaagagcagctgggccaggcagccagctgtgtcctggccgagcattcccgttcttagggtctgtgctgcagtcacatgctggccctctaggggaacatttcatgctctttaaagctctagcctgtgcacacaggatgcctccatttcatcttagaccagcggaggtgttctggaacacaagacaatttcttttttcacaaacagaagacaagagtgaaacaaagaaagtataagaggcataaaaacattctagcttataaatgacaagtttctggtttgtaagcccactcccagagggtcacatcctgttctacttcatgtcttatttatgaggatggctaaactctagctcttgagtcttgatgtggctttttctggtaccctctctgggattcttcttattccttagcaacagatctgtttatgaataagcgtactatctgaaattggttttctctttgcctcgtgttttgtaagcatggcttacctcccattcagtttctgttcccatctgagaaataggcctcttcctccattcaactgacagggctgaccccacaatgtcacaatgatgaatggactcttttttgacatgaggctctggcccagttacaaagggaagggtttagcttctttgttagctccgaaacacaagaccatagccatacgtgttagtcttttctgttattattgttgtgatgaggctgcataatgatgccctcagaactttcagtggtttacagaat

SEQ ID NO: 113114 - DNA, 1057 bp, Homo sapiens
tgtgtcaaccagcatctccagcagtggccccatcacctcctgattccatctcccatgaggaaggcccaggctagttccaactaccccagctccagagctccaggagcagcactgtgccctctgtccctccggcctccagtggcagcttcctgctcttgccagtgtctgggctcttcacggctccatctggcttgtcagcattccatcccctgtatgaccaattccctgaactgaattctttttgaaacactcaaatggtccgtttctgtgcggacactgactgatttggattggtttctgacttttagtttcaggtattcattggggttttggttgtacaaaaaaagccactcacaaacaaacagaaagaggacctagtaaccattagtaactactgaagaattgcttaatgggattatgagttttccctcagtgtatataatcatttgttttgcaggagtaagccctctgattctaaatcttgtttctttacctatcagtcttcagagcatctatctttagtgctgtctgtgaggattctctaaagctaatccttcacagagagccagtgttccttctagggtggttgtgtgccttgatttctagagtaaattactaattggcttctgaactaccgtaatagaaaggagattactttgttaatgctttatcaaaagcagtgctgttctccttaattctggtgaggcagaattttattcttagtgaaggagacaactgccagtgttcagttgttggattctgtagactgtatctgtaatgaagaaaaccaccagaaaaatttaaaaccatcatccaatttgatctgagccaagagatctcagaatttcatgacaaagcattttattgattcccaagcatcctttaagtcattttaataaggaaaattcaagagtgaattggaatgttaagagatgcatctgatggctgttcatgaaggcctgaaaataaaactgaagcgtaaatctaaaatgtatccatttaaattgaagaacttcattctagttggtataacttgattaagatttttggtttttta

SEQ ID NO: 113115 - DNA, 1026 bp, Homo sapiens
aactaccagtgaattctggagcactcttgagggaaattagacatgaatggtttgcttgtggaacaggtaacaccagaatttctattgcctgaaaacatactcaagtgaacttgttctcagtttccatcagtagcttttttcttctctattttctccagcagagtaaaaggattcccaggaaccatgagattgggtattaaatctccgtctttcttctcagtcttacccacgtccatgaagcaccttttcctagcagtcgatgataatttaggaggctgcgctgaatccatgtcagggctgacacagctgggcatgcagttccttggatatgatcctttcttctaagagagtcaagtcatggtctgactattcctttttgtttttcctttcctcacagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagtaagccgtgtgactgttcactctgctggaaagtaacatactgtgactcttcacaatgaagagtaaaatgtattctgtgttagaacttgggagctgtgaaacctgagagtcaccacagctgacaccaagagtttatgaggcatgccctctcactgttactcactattggcttagattgttggcccttgaatccgttattaattatttttcagcgttgttttggaaaggagtaattaatcatgattaaaacaaattgagacaaattggttttattgtatcactaataaaggcaaaatatattgcttttaattcttttggcacatagagggagatagtggaaattttcattgttgctattagttttatttcctgtttctcatatgtaaaaaccagtccagcaatttttaatttgggagagcttactgca

SEQ ID NO: 113116 - DNA, 1056 bp, Homo sapiens
ttaacatactaaagaatttgccaagatgttgaaaggaactttaagaaaatacaagttaagcatgttaagaacattatgtatagtatgatcccatttttattaaaataacaaaaacagaaggtaggaaaatgcgtggtatagaaatgaaaagagtggccaggagcggtggctcacacctgtaatcctagcacaggctgaggcgggtggatcacttgaggtcaggagttcgagaccagcttagccaacatggtgaaaggcatctctactaaaaatacaaacattaaccaggtttggtggcacacacctgtaatcccagctactcaggaggctgaggcaggagaatcgcttgaacccaggaggtggaggttgcagcaagccgagattgcaccactgtattccagcctaggcgacagcaagacttcatcttaaaaaaaagaaatgaaaaagtcttaaatactgtatgtgaaattggggaagaggactgagaatttctactttctgcatcttagtattgcttgaattgctttttatgtgtttgttttacaatgaacacatattgcttttttttagaggtatttattttcttccagtcaattggatcactcataaattactgcagataggaatttttcttgcttgttctttaaaaatagatttaatgcagttttataaatttctttatttcagtgtttcataactgtttctttgatgatgcttttttttgatgatgctttttaaacccagttttttagtagaaagcttgccatcatacacatgaatatgcatgtttaataataatagctgctctttatttaagcaatcactatgtgccagaccatattctaagcatttgatatatattaacccatttaaccgttataacaacactctgagtagtccagtttacaaatgaagaaatgaagcataggaagtttaagaaactttcctcacgtacagcctgtatgcatatcgaattcatataagaatgctccctgcacttgaataacactgttatgttccttctcaatcttctcttctcaatgcaaaatgatccca

SEQ ID NO: 113117 - DNA, 1029 bp, Homo sapiens
agaggcccatttcagtatgttggtattggcctgggcatgttggctcacatctgtaatcccagcactttgggaggctgaggcaggaggattgtttgagcccgggaatttgagaactgaccagggcaacatagtgagaccctgtctctgccacgaggtgtagagaccttgggaactgtggtcccagctgctggggagctgaggcaggaagattgcttgagcactccagcctgggtgacagagcaagaccctgtttcaaaaaaaaaaagttggtatcactgcttttctttcctatgactcttttaacctatccagagggaaacttttcctgccccatttccactgcaatttttttatagctcttttttctgaaaagtgtcacttttaaccttattctgcaaatttttttattcgttcaacaagtacatatttatgtaaatgtctccttcatctccaaggacagaggtttccttgagggcagaatctgtgtctattacatcttttatgcttcatagcactttctcttaatttgatactaaaaagaagtccttgctaagtgagagtgggagctgaaagagagggtagaattcacccagaacaccccctccgcctccccctccacacacaaacacacacacacacacacacacacacacacactttaaatctggtagtttgatgatgatagccagtaactgattgactctgggaaaacagtccagcagatttgtttgaatttggtgttggttacctgcttgctttatggggctgatacacagagtactgatgggctagactaaaattctgaaccagtgtgccgagaatgagctacttgttagcttcaagatgctgatcccctcagccctagggtaagatagcaaagtggggcctgagacttcctgggcacctgtcttctcatatccagctagtaacttctagccccaaacagcttcatccgcttaccccagtgtgtcagacaaatgcattaatttgcaggtgtgtcacgatatgaacaagctgaagcaccaggcc

SEQ ID NO: 113118 - DNA, 1005 bp, Homo sapiens
gccctccttcgggtcgccaggccctcgggtgattcagaaattcatcaaatccaaatggcagcgggctctctgtcaggcaggaaacaagccgcaccgaaggctcggcaggttcctccttgctgctgtggtaatggaaaaggagccgccgagtggagctaacgaggaaggaaggaccctccgtctggcgcgcctctttcccgcgcctcccgccctgtacgtgtgatgtccccagctgtctctctgtttctccaagtgccaaccacttcacagattcaggcgtcctcaagtggagaaaaccattgggcacccggcttccggcccggccacttagtgtcgttatggcgctgcctcttacaggtggcggtaaagggcgactgtaaatagccgattaaacagatgtaaatgtacacaatgtaccgtggaattaccgggtgccgctctgggcacccgccaagaacagctactgcatggaggggaggagggagcaaaaaaaaagtaattccattttgttttctgatcaatgaatgagactttggggatttcaaaatacttccagcgcccaggagactactccttgcttttggctctgtgcttaaatggtagatatttttgtcaagtattgccggcttgtttcttaaagtcagcttttcctctatgaaaaagagaacaatgctagggacattagccccacacacttccaggaatttcagcccctttgactgttttagaaaggggagggtcctggaccagaagttaggagacttgagtcctggtgctgctcacctgcagaggtgtcttgggagcccagccagccagcctgaattcctccagattagaggcttagtctacattgacataaggtccttggggcttaggctagagcactctgaggttctttggctcaagcaagacaccctctagcttagtctatacctctctgaagtctcttggcttaggtttgacctccttaaagtcctccagtgcagatactgggagtccaaggct

SEQ ID NO: 113119 - DNA, 1035 bp, Homo sapiens
aatacagaaattagctgggcaacgtggcatgcgcctgtaatctcagctactcaggaggctgaggcaggagactcgcttgaacccaggaggcagaggttgcagtaagccgagactgtgccactgcattccaggctaggtgacagagggagactccatctcaaaaaaaaaaaaaaaaaagtatgataaaaagatctaggctctagttctggatttattactgcagccacgtcttctggacaggtcagttgtctctccacgtttcagttttatcaaatggaaaaaatgaaaactgtcacacttcttacataacttcttttattatctgtattgtaaatacagagtctcaattattgactaatttatactaatagtgggaagcagtgtctagataatcccagatgattactaatttaaaactactttacattttatttagtaatgtgtttggaacagttacattttgtagctacttacaattttactttaactgaaataataagacaaggccataaatattggcctccctggctggggagttgtgtgggtttcctttccaggcagttgaggttttccatggagcctactctacagtgtcagcaggagtataacatagaaggcttccaggtcaggtggcccagagtcaaatcaaagccccatccctttttagcaaatttctcagccttacttagctgtgccggcctgcctctttctaaaatgaggaaaataataatacccacttcactggtttattgagaggattaaatgaggacgtgttatttcacaccattattgcttctgttgttattattttaaaatctaggttggtgattgcatcagtttcttagggctgctctaaagaaagtaccacaagctgagtgacttacatagcggaaaagtgttttcttacaggttaagaggctggaagtctgaaatcaaggtgtcagcagggccatgctcccactgaaacccatagcggggaatcctttcttgcttctaagtttctagtgtttccttggcttgtagatgtgtcacttc

SEQ ID NO: 113120 - DNA, 1046 bp, Homo sapiens
atcacagttcactgcaacctccgcctcctgggttcaagtgattctcctgcctcagcctcctgagtagagtagctgggactacaggcacgtgacaccatgcctggctaatttttctatttttagtagagacagggtttcaccatgttggccaggctggtcctgaactcctgacctcaagtgatccgcccacctcggcttcccaaagagttgggattagaggcgtgagccaccgctcctggccataatattatttttgtgaaaatatgtgttctgaggtctaaacattcagcttacaaatttccttttggaacgtaagtttttgtagagtatgtaagtgtatgagtgtgtgttttgaatgtgtgatgggagtacatgaatgtgaatgtgtgagtgcacaagtgtgtgtgcgtgtgtgtgggtgtttatgagtgtgggtgtgtgtgcgtaggaatgtgtatgaatctggatgtgtgtgtgtgtgactttgtgtgtgtggggagggctgcatgtgctgagagctgtcaagaatggggacttctatttctcctcaccaatctctagatcctgctttattttatcctctcctaagccttatgcaaacttaagacaactcaggttgagaccctctattactgtcaaaagccattttgaagcaattcaaatgttctgtttctattcttctgggaaatctgtgctgtctcagaaattctaatggcattctaaaatcatctgttgctttgtaatatggccttttcaacaaataggcctagtctcttctgctttcgcccagggttggagggcatcaggatggcagagagaatgggcagggtggtgacacctgtggacagccagcatcatgccgggttctgtgctatttgcttccttcacatgacttcctttattcatcagaggaaccctgcaaggtcagtattattatttccctttgaaaacacatgtccaggaagtttagcaactttccaccgtgacacagagataggagcttaaaccttgtactctttttttctacactacattggtaactgatc

SEQ ID NO: 113121 - DNA, 1188 bp, Homo sapiens
ccagaaaaatttaacaggtttatttataattattataaagttgaaccgctgaaacttgttcactgaaacattttaacttgcattaatgctttacgtctccgcatttatattaaaaattcacacacaaatgaaaatggaaaaactgccaatacctgatttctgtcccctatttttccactcgcaatcatatacttaggtaccttttgaccccatggaaaaaaattatctaacgttcagaactaccaataacaggaagaagagaaatttttttttttttgagaatgaaatgtttcccatcatagtggattcttaagcacgttctccacgtatgctgtgtgctagctggatgtcttttggcataattgttacacgtttggcatggatagcacacaggttggtgtcttcaaaaaggccaaccagataggcctcacttgcctcctgcaaagcaccgatagctgcgctctggaagcgcagatctgttttaaagtcctgagcaatttctcgcaccagacgctggaagggaagtttgcgaaccagaagttcagtggacttctgataacgtctaatttcacggagcgccacagtaccaggcctgtaacgatgaggtttcttcacccctccagtagagggcgcactcttgcgagcggcttttgtagccagttgcttcctgggtgctttaccaccggtcgatttgcgggcagtctgctttgtacgagccatggtacagagacctccttacttaccccccttctccttcggctggagctcggcgagcgagaggcggcgctggcgttggagagccaagtatgtgtttcttatagcaatcctgctcccacataaaagctgcatttcaatatgagataaaaagacattttggaaaaagtgcaaggtttttccccctgctggtgtagctgcaagtgacagctttacaaatcactttttctttcttttttcttttcttatcttttcctttcttctttcttcatcttcttttttttttttccactggtccttgcactgaattcatttatcttgcaatggtggtcaaccacagctcacagctgcagacctcaatctatgacacatattaagccattcaattttttcttgtaatatcataacttttctctgctttttgggagcactttcagcaccactagtagcaatctgtatgggtatcatggcatt

SEQ ID NO: 113122 - DNA, 1114 bp, Homo sapiens
attccaaagcccacattctatctatcccacttccctgcctcccatcctgaacttgtgtagctggtttcttgttcacctgaattctagatttacctctgttaagtttgacctgagtttctgctcaactttcagcatcttggaaactccacagggagaatttagctcatcttttcaggtttgtatcattgtatctgctgccttcatctacatcagtgacagtgccttatcactccccgttagagaactctttctagattgacaccaatctgggtaccagtaggaccagactttcagccagcttccaaggaacctactcttgacttctatgcactgttttccattttgtccaaaagttgtcatgagagagtttgccaaataccgtgttgttgagaagtatcacatatgtggcattcccctactataatcagttaacagcagtacagaataatgggaaaggtggcctctttgttttacatattttcagaaatcctgtttaatcttttgtcctaaaactttgcaagaaatcaatatcatgttcgcctttaccccctgtgtgaaagtgggctattgccttgcttctcttcatggttcattccagtattccattatttattcattctcgatattaacagtgtttccataaccacagatgcaaaaaaatatttttatcttaaatcatttttcttttcccaaaaatattaaaataatgcatacttcttatagaaaaatcaaaataggtaaagaaagcacaaaacaaggctgtctaacaatcctagagacagcctctaacatctgcagttcttttaataacctagaaagcaatttgcctaggtgctaaaacaatttatggccagaacctagagttggtcttccacacctagagcaggactacagcctaatagcagctagaaaaattgtaagggagagatgctggttcaaggtgaggagtcaggccgggacctggggcaagggcagggtggatgtggaggggtaggaagcaggagttccctgccacgtgagccccacagacaccagcctgttccagcaggttcattctgtttctgctgcatacttcagtgtgttgatattcaaggcagtatattggagtccccca

SEQ ID NO: 113123 - DNA, 1010 bp, Homo sapiens
cagaaagaaaaataggatggcaaaggatgtccaccgtgcttttcaccctgtcagcagatgatagcaacagtttgacgtgatataccggaaagatagaaacaacaacaatgaaacaaggatgccttggaaaataaaatgcaaacctgaaatcaaacggaatcattctgccccccgaaccactcctctctgctgcaaactgccccctattttcctttccgggcccacagctcatggtttaacctgggagattgtaaactccagtttcgttcctcatccttaatttagctagacagagctttgaaatggcaactaaattaccttttggtgaaatcaaatcttccctactagcctcaagcagagaggaatctagaccgcaagggccagctaatgtgtcccagcagctcccagtcactctcctggaacccacagagggtgcgctctattgaagggttactctcatcctttgtaccccacagtttatcctgtagggggttattttgcacagccttttctcttctgactgcctgcctagcaggaggttgcttagggcagtaaaatgtttattacctgtttattgtgtgagtaactgcagtcaaggaggagaaaatatttcccagtttacctagggcaatgaaaataggattaagagttctgagggctaaggaaggagcagtataaaacccagagaatcatataccatgcagccatgagaagcccaagtacccttgcattatcctttcattctagtcatggtgacttttcctcttattctcagacccgtgtaattcaccattatggatctggggattgctggtgttctaaaaggaagtctttccccggagagagtttggccccatcccaggtgtagctatcaaattgcaccaaaagagagatcatcggcctgattagcgtttacatacacatttatttctctttcctccaaagtaagttacaaacagcttaacttccaccaactttgcagtgtggagattcaataagatatcatatag

SEQ ID NO: 113124 - DNA, 1036 bp, Homo sapiens
tcataatgttgtgtgagggctcgctggccaccatggcagagagagcaacatcctccttaccttcagaaacctctggcaccaccagcattgctgacatatctcacgccctgtcacagcttcttagttcaacaggctgcaaaagctcctccccacctccacctgttcataaggatgtaaggataattagtgcattttctcaagttcaatgatacactcattttgaaaagcaactaccgcattatcctgcccttgcccttgggaactggatcccttcatttgtcgagaataccccttgccaggccttttcatctagccgctgctcacactgcaccggggcttctgtctgggtgattcttgctgggtcatgccaggaggtatttggcatttccctaaagcccatcatgtgaagtaagagtaccaccgaatcacgaagctctgagaagttttgttaagatcagtcatggcttgatcagtccaagcattaggatacctagtttgcaagtccagtgttgtccacctggcctggaatttaccaactgctctgtggagagctctcatcccacttatgaactgtgctgcttatatctgcactttctttttctgtatgcccagtacgtagctatgaagggaggatcccaggggccagaagccaggggaccatgtagtgtcttagtgtggtttatatgtcattgcagtctccatccaggtcttttccagatcctgggatgctgccaagaatttccatgcacaggaagacagagatggtcatggtgatatacagacttatacagaagacgtttttctatctttggggggcttttgacccctttccactcacttgaattcacacagaataattatatgctcttctgagggcttactgctgggtcagaaaagcagggagagttgcttttggatagtaatccccactgctggccaccagcagctgcagcctccacagcagctgcttcccctcgcctccatgccaccatctccccttcatatccactatctccttgtctctctgcaggtcatt

SEQ ID NO: 113125 - DNA, 1105 bp, Homo sapiens
ggggattgtggtaccaatgaaactattctataccattcaccatagatttataaaggagactacaaaagagaaaataagagatgacatcatatgaagtgctttagttcagataaaggaaacatccaaaaatactgagatgagtaaaattttattcaaagtaggttcctgctttgtcttgatctcaatccattctaactcctgatgtcatttaccgtgtgagatcttagtacaatcatgaaaagaatatgagcatttatcaaaactctctgacatctgtatgtttagaaatgaacttacacagcaaaatatgatttccttgcacttatttaatttttctaacttcaatttctacctatgtgtctctgccagtttgacctgattcagacacccagaacttgaataaagaagccctcttctattttcattcttaatgaatataccttttcccatgtccacattgagcctcccttctgtgtactctgtctaatgcagccacatgtctagttccccctctctgtcaccaccctcacttcttctttcccatcttcttacttctttggtgtgacctctctgtaggacaacatgccatttctgattccccacacacataccctatcattgatacctaccctcaggattagattctgtctaagtaatttgtagagccatcaggctttagtaagtattggactgcaagtcaacacccattatctcatcaaaagggatgctgtgttggggcagagggagagagagagagagagacagagagagagacagacagagagagagaaagagaaatagaaagtctcttccaggagaaaaaccatattgatgatatcaaaaggaaaggaaggtgaatagtgtgagccagaataggactaaacaaatggcaggcttttgttcagctctctggcatctggacagcagctctctgcttcttactcaacctgtccccaggctctctgcagtcttgtcttctggtctcattttatgtcatcccactattgatgaacagaaaatttgggcagctgcccaccatccctatatcccacccacactgtcaacaacagcatgtgaagaggagccatgtggctgcagtggtaag

SEQ ID NO: 113126 - DNA, 1037 bp, Homo sapiens
ccccaaaatccagatcttaagtgcagtgcccctgctgatgggtaaaatacctcatttccgtgtacatcctggcatattttggaaactgatattctgtcagagttttagaaatatgaggctaagagaaagcagcagaaaaggaaacattttaggaaaggaatgagctttctagaagaaagaggttttttgtttgttttttttttttcaattttgagatggagtctcactctgtcacccaggctggagtgcagtggcacgatctgggctcactgcaacctctgtcttctgggttcaagcaattctcctgcctcagcctcttgagtagctgggactacaggcacaggccgccacgcccagccaattttttgtattttagtagagatggggtttcactgtgttgcccaggctggtcacaaactcctaagctcaggcaatccacccacctcagcctcccaaagtgctgggattacaggcgtgagccaccacacccagcccgaaagaggttttaattgcactcctatgaaaatactccttaaaggttttaggggatgagaatattcttgtttgctgagagagctgataacccatcgaacagtggttctgaaacatttatgggcctaagaatcacctggggaaagcattcaagatgcaggtaatcaatcagattccactgccaaaggcccagaatctgtagatctgggatgaggcctgggaatgtgcattttaatgaacatccccacccccccgcccacatctcccaaccactatcaccaccacgaccattttctcccaaccactaccaccaccaccattttctttctcttttttcttttcttttcttttctttttttttttttttcagtcagagcctcactttgtcacccaggctggagtgcagtggcacaatcttggctcactgcaacctctgcctcctgggctcaagcgattcttgagcctcatcctcctgagtagctgagattaaaggcatacaccatgatgccccactaatttttgtatttttagtagacatggggttt

SEQ ID NO: 113127 - DNA, 1024 bp, Homo sapiens
tgtaaacttggatgctggctttctggagctgaataagggtagggaggtaagaaatggtggtgatgctgaggggcgtgtcttactaagttctatgtagactttcacttaatctccctgttttcatatggctcctcaacccactctggctaggcctgggatccaggattccagagtcctgtggtttcatctctgcagagtaatccacccgccttcttcttgtctgagggagggtatctggtccgattcttaattatacaggattgcagccagttttcctttttgcactcccatctaccctggcattcagaggtgcctctggttcctaagtcttcacagcgttgtttagcttgaatcatcttgcttgatttttggcttcttctactgcaggattagattcagctttctctaagctgctaagtcgtttaccactcagccagctgattttcatctcccaaaattttgttgacacccctcaattcctattgccatctcccatcttctttgttcttaaatatttatgtcatttttattcctgtattgtgattgtactggagcatcggaggaagccaagattaatgtgggtgttcattctaccagaggctccttcagtgattttcaacacttttctgttgaatatcgaatattgtccaaattgaaatttataattttacagcagaattcacattattgtttctaacacttttggctccaatagagtgggtttcacaaaaccaaaagtgctctcttaacacaaaatttacacatgtcaaatacatgtattgaaaaagacaacagtgtcaacatgatcatcatgctattttggaagaagattttgtgattataactattgagtagttttcagaatcttgaaatactgacttacttcaaggactatgaaaacagtttaggttcatgactctgactaagccagtagtacctggccactcaggggcaaggtggaatatggacagaacactcctcactgactgaatccaggccttccctgctgaggggaaaccagcaa

SEQ ID NO: 113128 - DNA, 1052 bp, Homo sapiens
cagtaagtccaaagtccctaccatgatttcagagccaccatctacctccctgtcaccatagtcctccacagactgtgcttcaatccccctggctactctcctgcctttgtgtgctgccaagcatttcctacttccagcttttgcttgtgttttcttgctcatcttctccacctatcaaaatccaactaatttcatccaatgctctactcaaatgctaccttgtccgtgaagcctgctctaatcctctcagttcaatttaattattgattccttgcatttccacaacactcatttgcagacttctctgacaatagttgtactttgctttgattgcagctcgtgtttctatgtctacctttttcactagatggcaaatatctggaaggcagggactgtatctttcataacccactgacctcatacccagtagttaatgaaaaatcttcatcaaatgctgttgaatattgcccaaggtcagatgttagtggcagatcaaggtctgaaaacttgatttatttatatttctatcaaaattttaggaactccaatatgttacttaacatgtgtctactccatcaggtgcttcaccttggaaacacttttttgtgagtcagtggtgcggaatcgccggtatagtcagggctgccaatgtttatagtggcagcgaggttgaggagatagataggggaggcatgtgtttaggtagagcatgcttttctcatctacagtaggccctatgaatatttgaaggggagtctggaagctgtttcctatgagcgaggttaagttgaaatgcaagaagtaaagattaaggaatattaacataaaatctgtattgtgaattcttttacataaatatgttactattgccagaagtggtgtcagggagcttttcatatgtctacattttaatacccaaatgaaaagtttgctgtaaattatcaaatgtggaaattcttcatgcttataaaggtccttgacaaaagaatgtgctgaaagaagaaagagagagagggtgtgtgtgtgtgttcatttctccaaacatatttttc

SEQ ID NO: 113129 - DNA, 1042 bp, Homo sapiens
gagtagccaaacatggagatacctgaggaaagagcagtctaggcagaggaaacgcatgtgaaaatgcttgaagtgtgcctggtatatgaggaagactctgaggaggctggtgtgggagaggaggacataaggcgacagttgataggggtggaagaagcagatgctgcaaagccttgcaagcccttgcaaggactttggcttttatctgagagagatgggatgctgctggatggctctgagaagagaatggtgtgatctgacttgcaggttaataggatcatgtcaccaagtcgtcatatcacttcccctacttaaatccaccacttgacaacatataatccctttatccacagagacaaatacaaactcatcttccctgtccctaatcaagaatttttccagtcaccctgcacaagccctctgcactcttagtaaacagtgaccacctcctgcccctttcacattctacccgtccttcaagtccaagctgaagtttctttttccagaaaacctttgccacctcaaaattgatctctctcttctctgacctcctatcgtattgattatttatcaataaatacaatataatatatggacttgaccatatattatctggacttcaccatatattatcttggattgttttctacgtaggcattgaaaggtttatagaacttgagacctagaagagtctcgggaatcatctcttctgactccttcattttaccagtgaggaaatagaagcccagcaatgtttaggatattgccaaattcgctcaactagctgtttaatgtgtacactgcctttctcaatgaaattataagtacattaaggaatgataacatgccttatacttctccaaaatctcctataatagtggttaacatagtactcatgtaacagacacttactaagttcaattaaatggccgggcgcggtggcttacacctgtaatcccagcagtttgggaggccgagacgggcagatcacaaggtcaggagatcgagaccatcctggctaacactgtgaaaccctgtctct

SEQ ID NO: 113130 - DNA, 1054 bp, Homo sapiens
atccagtgataatgactaaaagtagttctgtagttctgttaaataaaaagaagcagaaattcagtggctacaccattttctcggctttcttccaaaatgctttatccttggatcttggcaaatatgcctgtccctgatgtttgctaaggaactgtgatactcagcccaagcaagaacataataggaggaggaggaggacagctgaaagaagaagaataaacaaatgactactacgtgtgacagcactctgatgacaagggatgaccctgtccacaacgaaactcggaaaaaacccgtttgtatttatcagtccataggaaacaatgagagccatgggaggcagaaagcacatgctggtctgctcttctgcttatcctgaccctgctttccatagagctggaagaaacataatgagggctagatatctgcaaaagaggatgctcctagtgaacttgggaagccagcaggagtgaagttgagaagagaatgacgaggcatggcctcagagacagcaaagagatctggtctgtttccatagccactcttgaagagattgcattccaaaatttatttaatgaaattgctattagggtctcattggagatctttgtttcctcttctggtgtggtttgcttaaactctccctggtgtctgtagcacatggtagaattctagctaattccccacaggctagggcaaatatggccatgtgtgtggtgcctctgaaggagcctttccatgggcacctcccttcacagggcaatccctaaacagcacagaatcttaatctttgttaagattaatccctaaataaggaatctatgcattccttatttggggctacttagctaaatgacataaacagctggtttaagtgattcacaagttagttgggcaagtttcactgttgcttacaatctattttagctcaaggaaataaatttgcacacctaaaggcactgaccttttgttgtatacagtgagacttcagttgttgcatagattattgtaataatccttctgcttattggccaacatgtgatgtactttatga

SEQ ID NO: 113131 - DNA, 1050 bp, Homo sapiens
agccaaacaaaactggaggaaggattgggatcagtggcaccaggaagcggaggaagaagggaggttggtgagtggattcaggaacgttaaactggataaagaagagaaagaagaaagaaatgagattcccaatgcagttatgacctgagtaggattggagaaaaaggaatcagagagggaagagaaattcttgggtcattgttttaaaaataaggaaaaaaaattaggtaaggaatatgggtagatatttttgccacttttcagcttcaagacgtagatctaattacttagctactttgaaccttataaattgggaataatagtattaaccttgcagggatgtataaagattagaatagtgtatccaaaatgcctggcacacattaggtaggccctcaataaatgatgatatttgttcttacataaaggttatgctgctgaagtacttccagcaaatcattctttttttccagccctagttaatttctattgcttaagtagtccatactcacttctaaaaggtagaaaattaaaaatagttaagtaacttatctaagctcacacagtaatggaatggttaaactgggattcagagcttgcaagtgtaactccagagcccgttctcctaaataacacacatatttgtaagtcccagcaggtacagttgttttatttcatatggctatagctacagaagagaagcagtcttcttttctccacgtattgtctattttcatctctctgtaactccttgggtactttaaaaatgaaaaagtgacctacacctttgtttctctggatcggatgtcatctaggaagtatgtatttggcttcagtttgtttcactggcagttttttgcaactatcagaggatggaattttgctttgtcatctgacccaagcacaaacttaggtaaatttatgagaacgggccaatttctacagaaaagctgactctagtgaaagatttttcttccccaagtcaattttttaatttgtatttgatctgttctgcatggtgtttggccctcctctttgcaagttttgcaa

SEQ ID NO: 113132 - DNA, 1677 bp, Homo sapiens
gcaggtctcatgaaatctagttcagaaaatgaattcaaattgacttgaatgtgtcaaattgattgaaaactgcctgaaggactgaaagtgtaatgataaatggcaatgtattgaatctggacgagtgttcagcatggtcttatttaacatcttcattaattatctgggaaaggatataaacaacacattcattaaatttgtagacgcgaacgagagaggtgtttttaagcactgggtagggcagagggcaacttgaagggaactaccctgctcaagaacagaatgatgttaataatttgatgaaaatctgctaatggcctggcagtgttctgtgcagagcacgatcccaggcactgtaggtgattaaaagatgagttaaagcatctcagcagacagagtgcaaacaactaaagtataccacgggagaaggggaaggaagtgctgcattagaagtgcaagcaaactgcaatggaagcaaagaagtgatgaaattctaaagagaacagtcaggactgcaaattcacattgttacaccatgaggaaaacaactggagcaagaaacatcccagagaagtaactagggttagataaaggataatgccatgggctaccaagaagcaacaagacggggatatttttcttcaagcacgccatgtgagtcacagataatagagtcgggacattgggctcagccagtgcaaactcactgctcaacagaacctgtcttttttttttttcctttttctactatttttctttcttgtgttaaggtaaactactaggtactgtttttaatttagtttttaattatgatctaaggatcagtactatggaaacacacataattatataagaaagtattgcacatataaagcattatttattttataatattaaataaatggcaacaatctaatgttcaatagtaggggaaaatttacaaaactttactgtctgtacttaacaggatattctccagctactaatgggtgtttatgcggaattagaacaggaaaaaatgcccatattttaatgttaggtgagaaaactgggatgcaaaatttaccatagagtgtgatcaaaagcaaaaagctagtgcatttttagcaacaaaatgtatcagtggctgtctttgtgtagggggaaagaggaggctagaaaatagtatttgttgagtccaaccaactaatttgttcaatgtttctttctgtcgtaaaggtttttatttgcattttaatatatgttttgaccagatgtggtggctcagggctgtaatcccagcactttgggaggctgaggcaggtggagtacttgaggtcaggagtttgaaaccagcctggccaacgtggtgaaaccccgtctgtactaaaatacaaaaattagctaggtgtagtggcgcatgcctgtaatcccagctacttgggaggctgaagcatgagaatcgcttgaacctgggaggtggaggttgcagtgagccaagatcacgccactgcactccagcctgggccacagagtgagattccgtctcaaaaatatatataagtaagtaaaataaaaatttaaagatgtatatatgtgtatatgcacacagacacacacacacacatatatatgttttgatgagcctctaataaggcacttaagggaagtttaatgatttagttatatggttatttt

SEQ ID NO: 113133 - DNA, 1040 bp, Homo sapiens
ctggtgtaaagtggtatgctcccaaacagaattacctaattcggatgggaatgggaaagccagatgtgagacattccaaagcagtggtccgaggggcatgctgagtcagtgaaggagatgaaggggagtagtaggagtgccccccatttccaggttggtgttgagagaatgctgctgccatgaagacatgaagaatattggaaggggctgtttggagagacaagtttccaaacagcctatccaacactaaaccaggagcaccagttgtcggtggctgctgttcatattaccgtctgaggaatgtgtaactacccagagtgtatttgtctcttatcatgattgacttaatacacttttaggttttgaatgagggggtttctgtgggcctctttcagctctatatacctcataagtgctgtctgttagggtgatactggatattgggctttatattaaaacagtttctggaaaagaactgattcatggagacaaatttatcaccacttactcactttccctgttaggaggaaatagttgcagatataagaatattttgagggaaggagcttctcatcaaatagaaatatatgggtttttttgccaggcacggtggcttacgcctgtaatcccaagactttgggagggcgagatgggtggatcacctgaggtcaggagttcgagaccagcctgggcaacatggtgaaactctgtctctactaaaaatacaaaaattagccgggtatggtggtgtatgcctgtaatcccagctactcaggaggctgaggcaggagaatcactcgaacctaggaggtagaggttatagtgagccaagatcacaccactgcactccagcttgggcaataaagtgagactccacctcaaaaaaaaaaaaaaaaagaaatatatgggttttttgagggacatttaaggatgccattttgaacacccataccccactgaacagattcctacacggggtctaggtgatccatggcagagtcacacaattacactttgcacaccccacacagatgtgtgtt

SEQ ID NO: 113134 - DNA, 1697 bp, Homo sapiens
gttagtggtaatttctgccaacaccaaatgaagtctaagtaacaagctttggactaaggtgaccgcttctgagagaagcaacagccttcctcatgaaaaccatttccattctgaacatcatattttcttatttttcattaaataggtgaaaactatgtctaggttggcacaaatttttactggccaaggttgtattttagtaactgcatgcaaacttggtcttgttacttgccttgagttgacgtactggaattcttgcatcatggtgaactttgatcattgttttgattacagaaatccttcagaattctttcataccagaacttctaagaacagcattttgtttcctgccaatcttagctgtgctagattgctgtcttcctcctgtatcagaggcagtatgttttttgactagacagtgaatgcagtctcccatatcgtagttaggaggttactttcattaggcagatctctctctctgataaatctccttggtgcactgaactgtttaacttacttagggactgtgttttcttttgagtccgattcctgtaaaaagcgatgactgttcccagggtgttcactgaaaaatgaaatacggctctaggatttggtgctggtggctgagggaacaggaaaaataaagggaagatgagtagagctttgacaatccaattctgcttgtggggaccacgtagaagtccacatcaaacgtgcgtgcctttttgtcactcctgactgtataaaacctgagccatcatatttcttcatggtaacttggaatgaaaacaaagatttctggggctccagttgctgcttttcccttcctatttaacttagcagatgatgctctgctgaatttcagctagaacctgggccctgtgactgaaatccaatggcatatgtatgtagatttccactattatatgtggtcacgctgattgttatattaatatcgtaattaggaataggtcaaacattttacttttatatgaataacaaaatattcaatacctgtatttaaatgaattctagaatatttgagggcatcagaatatcatttataatagtgacattttacttaggcaatggttattcaaacactattttataacattaataaaggatctgacactctttgtaggagaaatccgtaaaataagcaagactgttaactttccttttaatttagtgtctgtctttgaaatggcattctatgcatttgctgtgactagacatgccctgttcaaagatctaatgccctgttcaaagaaattcttataatgtttttcagaactgtgttactgagctgtattggggaagcatattgggggttaaattaagagaacttagcccatcttgattcacaggcctgactttgatttcaggcttgtgacttttttttttttttttttttgagacagagtcttactctgtcgcccaggctggagtgcaacggcacgatctcagctcactgcaacctccccctcccgggttcaagcaattctcctgcctcagcctcctgagtagctgggattacaggcacccgccaccacactcggctaatttttgtatttttaatagagactgggtttcaccgtgttgaccaggcttgtctcgaactcctgacttcaggtgatccacccgcctcagcctcccaaagtgctgggattacaggcgtgagccactgcgcccag

SEQ ID NO: 113135 - DNA, 1211 bp, Homo sapiens
tctcacgtgcatattatcagataatagtaatcattcattcatgcattcatccaataaatacttactgagtgctaagtgatggtgacatattatagatttcagatttctagaaataaccagaactggggagatggggttggccattctctgctggcaggagggtgagttccattattctctctctctctctctctctctctctctctctctctctgtgtgtgtgtgtgtgtgtgtgtgtgtgtgtgtgtgcgcgcgtgtgtgtttcaatctagggtgtttcttttgccgttgggcttttctgtagcctacaggagtcagtgtgttggggcgaacttaaggcctggaggaggagtggagtgggccaaatgcttgtaaactgcctgggagagaggtagagaatggcaagtggatctaaaacaaaataaaatacccagaccctgctgttggcaaaacatcaattggcctagttaatacaggggaaacttaggggaaccttctggttagactgagaggtaaaactaaagaataactggagttgccagaaaagtggatggtagcatgatgtcataaatttgacaggcagacctgcatgttaggaaaagcacacggttcaggaaaggctcaagtgtcaggtctgagaagcccaaatagcatttatgtgcaaacaaggaacatatccatctgtattccttcctgtttttctgactacttaagattccatattagatgctcctgacctccctaaatctggcccagggcaagaagggtgactgtgcattggaatggcatgcatgggagtgctcatttattcagaaatcatttgcagagcagcaaccatgtattagttatatgtgtaaaagtagtgggcattttcttccagcacctaagaggagtgggcaatgtggggaaagataggggaaatgttttacagatgccacaaagatgaagcttctttcagaaggtgagctgtaatgtagtggaaagagacagacaagacctgagctttatttgcggttctttacttactagctaggttctgagccttcgattcttttccataaaatggagataataatttctatccttttccctcctagatttgttgtaaacatgaaactattcatagaaagaatacagagtaaactgttaagcactatatacatgtttgtataatcagacgattgttttcaaaaagtagtaatagcacaccc

SEQ ID NO: 113136 - DNA, 1053 bp, Homo sapiens
gagaggaaggttgctagcctgggtctgccctgctttcttcgaaaggccatttgaaccctgttctgggcataaacagccattaagatgattagtttgggcttgataagtagactaaacaaacccttgaactagttgggagccctttctctcctgtaatctgcctttctactgcattcaaactaatttctcagggtctgaataccttacaagtactatctaatgggtgtattgtttttgtttatgtggtttccttcagcctcagcagcttggtccttggtcctgttttttttttttgttttgtttttgttttgttgttttgttttgttttacactaatcattccctctagttgaaagggttctaaccagcctcttgccttgtgcaaggaattagtcatttcaggaacaggaacttgtctgctttgggacagatttctacccagaggcttaaacctacataaaatagtgaaaatgatttaaagaaaaggtagaccctaactggtggcaggtaggagaagctcagcccctctcttggcttatcttggaaggctttaggaaaaaaatcttgcctgtcagctaaagccagctttgctgcgagcaaggagaatggaataggaaaaagcagttgtacctgattgtgtaaaatagtgtatgtagggctttttgctatgcagacttcatgaaattaccaggcagagatggagatgctggcttttcctaattagaaaaagccctctgtccaatttctttctctgtctttttgttgtttgttgttgttgttttggttttggttttgagacagaatctcgctctgttgcccaggttggagtgcagtggcgcaaccttggcttactgcaacctccgcctcctggattcaagtgattctcctgcctcagccttccaagtagccgaaattacacgcacttgccaccatgcctggctaatttttgtatttaagtagagacggtgtttcaccatgtttgccaggctggtctcaaacttgcaaccttaagttatctgccagcgtcagcctcccaaagtgctgggattatagg

SEQ ID NO: 113137 - DNA, 1113 bp, Homo sapiens
atagcataggtagtgtcagttcatgactataatgtgctgacagctggttaaatgttttatggctgtggtttttaggatttagccataaataaaacatttcgggcccattctgacaggtgcacaaatactaatctaagaattcattatttatactttctaaaaaattacatcactcttgtcctttcatgggttggtatgtattccatcatatgaaattgcttattttttcttactaggatattttatgctaaccacaaagctaggtaccacttcatgtaactttattggtagttagggagtggataatgggcacgattttgttcctgtggaaatgactgacattcaagaagggtggagcagtcttactaggatttgagctgcctgcacccggagggttatctttctctgtgcccttttgtccattttttgctttttgtagtttgcttttcaagtccatgtgactttgaatgttgcctttaaatttaattactctttcctgtaagtacttttctccacaaggcttttttccacagaaagtgtttgctggtcaaagttcactttttaatactgcatgaatgagactttgctcaaagatggggttgtacccaccaccaggaatatgcagtactgaatgcaaatgccggacagtcaggtagccatcttattattagagcgtatccatcttattattagagcgtgaaggaaaggtgtgaagaatgctggaaaaacgacgataggtaaagtgttcgtgtggaaggcatctgccgtttccccctttccacttgcctgaaccgttgcactgtgcagtgtcgctgtgcctgctgcatgcagtcgtagggggctcattgcccctgtgcaagcgttttgttggtagtaatgaaatgcctttagaataggccaaaaactaggacattttaccgtctgatttccttactcaaattttaaaaaatcttgagatgatcatcgctgaactagagttgttcatgtatccttcttgctggctggtgcattcgttggctgcaaagggacagttcacgcacaggcggctccacttataccagtcacagcctcctctttctcccacccaccccgttttccacttaagattccttt

SEQ ID NO: 113138 - DNA, 1052 bp, Homo sapiens
ttattaaatatgttttagatgtgataatggtattatggctatattgttgaaaataggccataacttttaaaggtacactccacagtattcacagatataagttctggcatgtgctttctataatatggaaagggaatgtgggtttggggtatggatgaaacaagataggccatgagttgaaactggtcgctggcaatttattacattctggcaacgcttgtatgtttgaaattttgaacaatccaaagtttcttaaaagacatacgtgtatacacccggcttattggggagaaatacattgatacttagtcaaaggtacggagggtttcaagagaaagagttgcctaaaaatatcagaggtttgattgcactgcaattatatgcagctatatacagctacgtaatttaaaaacccaataatattgtagttttattttaattaagataagcttctacttaagtgaaaggaaaaagaacacttgccttttggctacagtctttaattcagcaaacattttttcaagcccctctgtgccaggtactgttgagattgcaggaaattcaaggaacagcacagatacaggtaaagtagctggtgagatttctccacatcattccacagcgtgatgtgataagagctataacagacttacacaaaagtatgattggcacacagaagttggaatgattttattctactttcatagggtggagggagcagggaaggggcatatttcgcagggcagagagtgcagggaagactgcacagggagttggcatctgatctgccttgaggaattagcagcatttttctacccagagaagatgggaaggactttaaaggcataggaaacagcatgatcagtagcacgaaggtgggaaaatgagttcagtgaatggtgactgggttcactgagtgtgaagcccaggatggggtaaaacggggtgggagcagatactgagaacatgaaagtaagactcagtatgtgggtttctccctgcctggagagcagcattgcttacacctgtcagcctgagtttctaggtcctgt

SEQ ID NO: 113139 - DNA, 1095 bp, Homo sapiens
aatgagataggtgtatatatatatacagatgaagaaactgaggcgcagagaggctaagtgactggataaaagtcatacagctagtacacggtagggctgtggtttggacccaggcattctggttccagaagactgcactcaggactattaatttttaaaagattgaacacggtagggaaaaaaaaaaaacaaacccacaaatattttaacctgggggttggttgtagctgatatcagagagaacattttttgtggtggttgtctagctgtaggctctgaagaaatgccggctgtgggtgtcatgattctcattttagaagattaaaaaaaataaatttagtgtgttcttttaaggttttatttcttttgtgtatttgcatatattaccatgcgtggttatctgtgaaaatccttaaaaatgtgtaacacaaattacccttagaattactagattaatctttccttcttaatctgaactattgacttctgatattgtctgatgtgcttagagaaactgttgggctcctttgataatctcatgtttttgtaattttattaaggatatacctataatttagaaacattttatttgtatttttatgagacttggaaggtggcatcagattagatcaatttttctattctctattaataattttgagattatatatacacatacgtatatatgtgtatatatatatatacctgtatacacatacatacatacatatatatttatatatttttttagacagggtctcgctctgtcacccaggctagaatgcagtggtgcaatcatggctcactgcaatattttgcagtataaaaaactgatttggaatcccttgctttgtctctgattaagcatttgtatattttcttaaggaaataaatattctgtaagtcatacttttaaagttatatagttagagtatgcttaaaaacataaaaccacattaaagtttaacttatttttggaagttaggttttaatgtggtcagcagcaccaagtaaaagtgtaaatttagaaacagcttttaaaagtcttacttgaaagagaatagtaagtgtgtaagaaaatacgagggagatatt

SEQ ID NO: 113140 - DNA, 1756 bp, Homo sapiens
gaattttcagtaaagttctggatccacagtgagccttctataaatatcagctgttattattagcaaaccaccaagatgcccactattgtgcctcatgatggcaggctcagtgggaagccaacatgttttctccaaaaaagtagagcatgactctaggtttgtggtgcttgttagatggaagagtcgagcttttgctggctctctatacctctcgtgtggaaggtgcttagcatgtttaggccccattgcagtgactatcaatgtgagtccaaattccctccacactttctgtcactccttttggacataccatatactgtctcccatcatttatcactgactggccacatggcaccgcttaggagccagatgctgggctaaacattgaagtgacaaccatctggtttactgcccctcccctgcaagaacctgagggctccatggatggaggatgaaggtacaaaacacagggcatgagcagggaatcatgagtgttttggtgctgttgaaacagaaagctcaggacgtaaagtggtggaagaagaggctggtgagagaggcaaggcattaggacgtggagggccttatctgccacgctcagaagcataagccctatgacataggagaagagaaactatcaaaggattataaacgagggtgtgatgtcatcatgaccatacgaaagataggtttgagaccaagactgggtggagggaggtcggtgaagatgttacagaatactcagcagaagatgttgaagggcttcaagtaggtgagtagtgggtagagatggagataggagaccattttcaaaatatattaaggagtccattgagtagacaggggggactgagagaaatcagggatgacttccagttttctggcttggaaaatggtgttactagccaatttaggttttggagggaagatgtttggttttggacatgcgacgtttaatgggtgtatttatggtccattctgaagggatgtctggtagtcatttggatgtataggactagagtttagccagaggtctgggttgcgggtatagacattgcagatggctgaaatttcagagtggatgaaattggcaaagcacgtatagcaggaaaagagaagaacaatggcaggaactttgggaaacacaagattcagtgtatttctgaaggaggcgatccttcaaaggagatgaaaaaggaacagtccagttggcgaggagcaccaggagagtggtgtagtaaacactaaggagaatatagtcagcataatcacatgcagcgagataaggaccagtctcctgggatttggcaactggaagctcctggctttttgttagagggtttacaataggatggtgtcagtagaggcagtggatgaaacgtatggaagaggaggggctgacttgactaaggaagaaacggcatgtgtatgagggaagagacctcacatttaagaggggcccctttcaagtagttggtaaaccttttgggggttggaatgccttgaatatgtgtggcttccttttttttttttttttttaaacaatgcttattacagtcctttattattattattactcttttaaaagagggtccattaaatggaataatggtattgcctctttaacacctgtaccttggccaggcgcggtggcttacgcctgtaatcccagcactttcagaagccaaggcgggtggatcacgaggtcaggagttcgagaccagcctgaccaacatggtgaaactctgtctctact

SEQ ID NO: 113141 - DNA, 1027 bp, Homo sapiens
aataaatgaaataggaagtttcacgatgtagaccaaaaacctctacagctctcattgaaaggaagggggagggtacagttgcatatgtaaagctatgtctttgtgaaactaaaattaaagcaagaacaatacaagaaaatatgccgcatataggaaataattactagatatgtgtacctagtaatctttgaattacagaacagtgaacaaatgttttcagggatgttcgtgcaaagtgagaagtcttcagcctgctcttcccagggcaccacgaaggcatttgcttgcagacgttgccttcttcggagctcttttaaagtggtcgccaactctcaacagcaattgcttctgagtagtgttcaaacagccctgacatgggtcccttggtatatcattatctagtctcatatttaacctttttctaatagcctccccaaagtccagagtttccagttagtgccagaggaagttagaaaaggcgtttttttccttgtcttgactgcacagctgtgagaagcacaggtatctgagagtcatctttgtttttcctttctttgtctatgagggaccagttatattggaaagtaaagtgacttgttgagataggccaagctttgcaacgagtgtcaacacactaataagaacttccctttttccagttttttactgagctccttgtggattcactcttttcttacaggagagaagggcaagggagcacgagcattcgtggactgtgcctctcctccttttctgtattcttcaacttgccattgcaggagcatgtgtaccagtaagaggtccgtacaagctgcagagtgtgggccgggcctgaggacagtgattgcatgggtgtaggctccaccctggcacctctgtgtggtgaacaagacctgtttatccaattgccgcacatacacactcatgactgcagtgcctttaaatggatgttactttattaggagaagcatatggaaatgatgacatctctgatgtctcaaatagagactggagacagcaatcctga

SEQ ID NO: 113142 - DNA, 1079 bp, Homo sapiens
ttttacagtttaaaaaaaggaaacaaaaaccaccccaaaatctccccccccgtttttttcgccccgtcgggatcgccgtttccatccatgtgcttgcgtctcccccgcgttccacttaaactattttaatccttggacccaaggaggaggctgataggggggtggataaaaaaagttcttccaaaatagtgtgcccggggagcaggatgggggatttcgcagcccccgctgctgccgcgaatggcagtagtatttgcatcaacagtagcctgaacagcagcctcggcggggccgggatcggtgtgaataatactcccaatagtactcccgctgctccgagtagcaatcacccggcagccggtggatgcggcggctccgggggccccggcggcggttcggcggccgttcccaagcacagcaccgtggtggagcggctccgccagcgcatcgagggctgccgtcggcaccacgtcaactgcgagaacaggtaccagcaggctcaggtggagcagctggagctggagcgccgggacaccgtgagcctctaccagcggaccctggagcagagggccaagaaatcgggcgccggcaccggcaaacagcagcacccgagcaaaccccagcaagatgcggaggctgcctcggcggagcagaggaaccacacgctgatcatggtgagggcgcacgggcagcgggcttgcggcgcgcgttgggggtggtggtggtggtggggggcgcgtggagcttcttacatgggggtacaagggtctgatttgcacggtgggtgaggtgggctgaagcctaagggttaacgtcaacttttcttagggaaaaagctgccgtcgtcgctacctgttaatctgtcagggttgtcagatttggggaggagggggcgagaggggagaagccagtcacgactgcgaggggcggagggagcctagaggagcgtcggagtgaggtgctggaaaagtttccccccttccctttcttaagataccgatttgaaagagtgaacccctgagttgaaaccttgctcctcctcttcgccgctccccaccccacctctagccgcgccgcct

SEQ ID NO: 113143 - DNA, 1480 bp, Homo sapiens
gactttgagtgggcagttatgttgtttctgattgacttcattgtaaataaaattgaagtgatttttatgtatataactttctttgcattattgtccttagcctaaatttccaaggtaaaatactcagttaaaaaagatgtaaatgtttttatgaatcttattatcatactgctttccaaaaagattacatatttaaaatttgtgtccagtgtttgtgtatttgtttttccataactctttgctagtattgatcattatctcctttaaaaataataactgtacggtggtatttatgtattttttgattatcaagaagctcaacattttctcaaactatttatatcctttgcttatttacccattaggcatttattttattcttagtaaagcatatgaaaagtcctactatgtcatagttaacaaaatcatcctcctttgaaaaacaggcttatagtttattgctgtatgtgtctatatttctgaatttttcttattgtagaccattcctcaagaattttgtatccaaggcccaaaagtttgttacccaagatgatgaatgctgacatggatggtatgttcttcattttcttttttgtatactcctggttttgtggatgcttttgctttattaagcaatggaaagggcagagaaaccatgtttagaagactttgatcttggctaattacttatttatatctcatctagtgttagaaaggaccaaccaaagcagcttccattccttagctatgagaggttggcaagttgtttttatcttctttaccttggtggtattatctgcaatttggggatacaaaattttatttcacagggctcttgtataagtcaagtaagaatgaatataaaacattttgcagatttttaagtgctaccctacacaaatgtacctaatgctaattaatagtaaatttgaacctttatattacagcagttgatgctgaaaatcaagtggaactggaggaaaaaacaagacttattaatcaagtgttggaactccaacacacacttgaaggttggcttgcattttgtagtttatttgaatgacagccaattaattgaacttgtaaaaatttatattgctaaattttgtttgttaggatgtataatttttaaaagaatgaacttcaaagtacacacatatatatatctatcttcctgctttggtagtttaaagaacagatacacttcagtcaagtcaaatgttgttattgtgcttccctctttgaagcctaacataatgctggctagtatgagacccccttttaagtccccataatgtgttactaagtccgctttaataaagcttattttaaagtaaaaacaatgtattagccttggagattaaaaaggaattcatctgaattttttcattttctaaatcttgcataaaattaatacactgaaacatcttttgagttttaatgaaattaagaggttgtgtttttggtgccacagtgagca

SEQ ID NO: 113144 - DNA, 1995 bp, Homo sapiens
tagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttgtgtgtgttttgatatagttgcctaagtaaatggggtatttaggtatagtggtgtatccagggttattcaatgccacagaatagtgtatcttatttaagtacccagttactgattatttaggggaataatatttttattaatacaactataactggttatcaatataaatatcataggctattatacattaatttggaaaacaaaagcaaagcactcaaaggatccagtatctccagggaaaaaggaagttgtattttttagggtaggctaagctactttagcaagagacccagtgataaagaatataaatatagaagtttctctcccaaccagtggttccaaggtcagcattgcaggctagcagcccttgttcaaacagttattcagggactttggctgaggatggtgctgccat

SEQ ID NO: 113145 - DNA, 1027 bp, Homo sapiens
actttacaaagtataaggtgggaaaatgaaacttcttttacttacgagttcatcactccttaatgtaaaatgcctgagtaaataagtttttttgtatcttgtgttacccagtaaaggtttgtaaaatttgaattgcatttttatgcttatctcgtctatagcctggtgtattaaaacagttaatggcagctgctgaagggcacccatggctttggttgatttatcttgtgacagcaggagtgccaatagcattaattacttcattttgttggccaagaaaagtaaaggtaaagaaaatggatttccttcaacttttttcacccaaatttcttgttgtttaagagttctataaattaagcgattcttaaaagtaataaactaaatgtctcataagttttactgatagttcattatgtatgttatcaattattgcaaaaaaactttcaaaatagcactctgcctttagtaaaaataacttatgttaactaccacagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaaggtaagatgatgagagtgatttataatggagactctgggtaaagctcataaaactgtatatggccttgaaataactagttattatacttgtttattatcaagtttatacatctgaatctcccaagaatatgtgactgtggcaagaaggaataatagtcctctgagcagccaccctgtttatagtttttgcattctaggaagaaggagatttaaatagtgttcagttgcttgagagcctagcagttaatgaatcccataggccatagctttttgcaaggatgtttcttggctctgggagtgtagaagatgagatggagggtgatagagggtgtatatcatggcctctgtagaaaaggaatagatataaaacagat

SEQ ID NO: 113146 - DNA, 1035 bp, Homo sapiens
tgaaataattgaaaaaactaggcatttgggggaacaccaagtaaactgtagaaataatgagaaaatattactagaacagaataaattaattttttgttatacttacaacactttaagatggtatcaaaaaaattaaatgctgaaaaagattagcttgtattttgtaactataaaagagtgaagctgactcgttatgagtcccaaaacagagctatttggtattattttttatttgagaagtaatggagcattttattgtaaaaaatgcagtttaaaacaaaattttatctttaggaaatgtatctagtgattttagaatgttttagttcaatacattggttattcctctatttctggttgggaaaaaagctttacccatggagttaagggtagttacattatttagaagattatctttaaagcgtatatcaaaatgataactataatttatttaaattggtcccttagtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactggtaagcaaataattcggtagcaaagcattatctggcataactaggtaatgaaacaacatataagtgaagtttacaacccatgaagtttatttttttaaacatcagaactacttatttttagtattttgggtgaaatattttctaaaatggattttacacttccctccctgtaatttttttttatttctattgataattatgttgcattttttaatatatatttattttttatgttttcaatgctgtggattaaaaatttcataaatccaaaataccagtgctttaattttcattcctagtttgatctttattgtatgtgtgtgagagtccgaggtgggcagatcacctgaggtcaggagttcgaaaccagcttggcc

SEQ ID NO: 113147 - DNA, 1047 bp, Homo sapiens
agtaagaaaagtagctgatgagtattgtgcatttcaaaataaatagactactcattttgtgttatgtgtcatatgcagtttcaaatatgtcattttgaaaatacaatattgacataccctattgagacaaaccacattttataatttcattgattaaaaactctttcatagaaaaaccaaactaattcagctttaagagtgacttaattagacactatagtgtttgctattagttttcacaactttagttaagaagatgaaatcattctttgatagaaaaaaaaagataaatgagcaggcatacatatatagttgaagatatttcctgatttaaaatttttatttttcccaagtcaggcttcctggataaaaattattgttcacaactgctgataaataattcttaggtcaatgttttctgttttagtttaatttgctttgctttattttttaggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcagtaagtgttgctatgtttttgaatactttttctgaattttgtattagctttggcttctgaatatagcttgtattttgaaaatggatgtgaaaatctagatcttcctttttcgtttcacttagttaaaacacaaatgtgcatatacacacaaacatatccatgctttcaataaaaagcaggtaaatgataaaattatacaaagatcaaccattcttatggcctagtactaatatttatatttgtttatttcaaggagttgtatgtgggctattaagcagcatatttcctttggtctgagtgcttgtattgactaaatgaggaataaatagtttggctctcttaaaaaaatttaaaaattatgtgatatatactgtaatatatacaattctgctgtcataaactatataatgcatagtaaaaatcaccatttttgttttactcttaaaattac

SEQ ID NO: 113148 - DNA, 1036 bp, Homo sapiens
cccgtcttctgcgtcgctcacactgggagctgtagacgggagctgttcctattcggccatcttggctcctccccccatctttagattttgtgccattggctctttgtttttggatgaaggcctgcagctatagaatctgtttcctacaagatttgaagtttgtattttcacttgctcaaagcacaatttaaataattttgtcagtgatttgttttaaaagccatcctagaataaaggagctattatggagaaattatttatttctacatatacttaacacttattttcacaattttgttttattttcactaattacttttaatttcacagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagaggtatggttattgagaaatgggttataaattattcctttacatagtacaatgaagtgattgacctctggtgattcatttcagttcaaataatcttcattttagagctagatagaaaaacattgattttttttctaagtgtcttattactttaatttttagagtgcccatgtaattcagaaatttgttcatggcatctagcacagtttcttaaacaaataaatatgggggaggtttttactatcaaaacaggagtttgtcacggattaaagagaactaagctaatagtaaggtttttattcatacttttgacattgctagatcttttcaaataaaaggctatataatttgcagttccttgagaagtaaagtatttgtctttatttctctgagaaaagaaaatgctaagaaggaggatgaattagaaaaggaagtgagggtgaggggtgggcatttagtaaacctgactcgtgtttctctcagcattgttaaaatgtatattttgaagtagtgattaacaggagtctgagaaattgcagggatttttgtatacctt

SEQ ID NO: 113149 - DNA, 1035 bp, Homo sapiens
aatgacttattcgaatttgaggagtctaattcaatattctgctaagaagtctggcttccatgcaatatatgacaatggagcaaagctccactgtacttacgcatatacaggcatttgaatttctgaaagttagggaggaatactttggcaatctattggtgtttttggtggctgtctttttattgcagctgccgtcttagggtttaaataataatgtagctgttaaatagttgaataataaatacattttacggcattagtttagttttcttttaatgctatagtgatgcacatttgcatttttgggcctctacttttccactacagcctatagtcattcaaagtataataaggggattctatgaacaactttatgccagtaaattgtttgattttacacaaaatggacgaagtccttgaaaaacaacttaccaaactaacacaaaaagagattaaaaatctaaatagtagtatacttacaaaagaaatagaaactgtaatttaaaattttttcacaaatctctaatcttggcttcactagtgaagtgttaaacatttaagggagaagaaataataccactattacattaactcctaggaaatagaatagaaagaaacacactttatggggccagtatcatcttgatactaaagccagatatagacaatataatatatgaaaattacagttcaatgtccttcatgaatataggtgcaaaagtccttaacagaatgctagcaaattgatcctagtaatacataaaaaggataatatgtcatgttgagttgttttttttttttttttgatacagagccttgctctgttgaccaggctggtgtgcagtggcgtgatctcggctcactgcaccctccacctcccgggttcaagcagttctctcacctcagtctttctcgagtagctggggttgcaggtgcacaccaccatgcctggctaatttttgtatttttaatagagacagggttttaccatgtttcccaggctggtctcaaactcctgacatcaggtgatccacc

SEQ ID NO: 113150 - DNA, 1833 bp, Homo sapiens
agcagagatacagcagagagaataaagaattagggcctccttttgggtttctgtgattattgagcataactgatgagagaatgacagtattggtgactagcttttttgtttttaaataacacactttaaaatgccacagtgttatttgaaagcttaaaggcattttctcatcttcagtatttgctttttatcagttgtagaaaagaaccttagtgttttcttctctacctatgtatgcttatgaaaccgctctacctacatatgaaacttctctacctatgtatgtttacgaaaagagatgtatttgccaagaaaatcttgattatataaaagacaaaaagattataaaagacagtttctgtttaagtaaaactgtctttgaaacttaagaaagcttaagttttaaaaaaatctcagttaaacatcattggtttatttgacttactgttaactcttgcttctctttgactccatggtgtttttagataaccatgtatgaactttatgttaatggtttgtgggatactaaaatagcttgaagatgacttgatgactgtgcattttatatagttttattctcctaaaatctcaggagggcagcaagtgctgtcaacgattatatagtgatgagatttttatgggaatgatttcttcttggtgcgttttacacatttgtactgatagcaaaactaaagtttaaagcagcaaagtttaagttctccttaaatcctacagaaaccaaccttttaaggacataatttcatctaaaacatgacgatatttagcacaccttttaatgtgggtatatatcaagtgtttaaggactggctagtatgtgatagagcaagacctgagactttataagtatttgctcgtgtctgttgacagacctctttctttcaaacttgttagaagagtggtaagacatatccaattggaaaataagatgcagtgttgtatagcacatacatttaaagtgcttgcgttaaaattagtttctcaataagataaaattattttaaaaatttggttcactttattacaatagtggcaatttagcttttcagtattacaggaatttaaaaattggtttcttgtaggggacatctcaactttgggaatatcttcacttaatttttaaaaaatattttcatgctttattgtccagctatacaatatgtcgcaaaatcctgacaagttcattgtattaaggtattaactattacatggaaagcaattctgttcatcttttgatgtttgtgttgaaaatgcttatctttgtgttttgatcttccaacagctgagagcttgaactgatttaaacatttgtcaatatacttaagaatgctttaagtaaagaaggggaaaattttaagtaagttttttcccttctaggaagaaaaactatgatgatgttaagaaaatgtcattatagagcttgctcaataatatgttctttaaatccacctccatttgtacattataggtatcattctgtttttgcttaaaataatctgcaaccatttcagatagttttacagcaaattgatctaaaagccactaataaattctagggtttgagtctagaagccaagcaaactgtcaccaatgtcagttgtaaattagaatgcaacatgaggcttcagactcatgacaatgatatacatgaaaacaaaaatataattgtgtctaccttcctactttcccttttgacatatgtagttggaattttacatagtcttaaaatccatatttagaatcttacctgtttctataataattagtaaaatgccaaagtagtgatagaatattgtggcattgaagtagccgaaa

SEQ ID NO: 113151 - DNA, 1575 bp, Homo sapiens
aatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactcagatacagctttttatctttgtgcttgagttcctgcctaaggcaataacattattcttttgacaacttttgcaggggaaattatatcaggcaaccattttgattaagtaaataaattttataggcaaacatagagagagaaatacaatttgtagtatatcaatgactatatttaaaataaggaatataattgttatcagttatctaacttaaaatgcttatccataatgatcagtgatattcagctttttaaaatatgcttgttggttgcatgtctgtcttcaaaaccacaatgagataccatctcaca

SEQ ID NO: 113152 - DNA, 1050 bp, Homo sapiens
ccgggcagatttgattgaacagatgagattcaaacagagactgaaagtgatccagacgctggaggatactacgaaacgcaacgtggtaagtcctttaagaagtagcaggcaacctctgtcatcttccttcttcacactcctgctggctgtggattcctgcctgacagaactgaaaacaatttgaaagggaaaaattagggattttcccagcatggcactttttgagtttgtgaaattcattttgcttaatatttttataggtacgaaccattgtgacagaaacttcctttaccattgatgagctggaagaactttatgctcttttcaaggtgagttgcaaggtaaattcatgcccattcaaaggagtaaaggagttcaccttaataattcagttagttcttgatttttctgttaaattaagggataatataaataggaagctagagctgagagtacaaaactgtagtacttaatatgaaaataaacattcttataaccaatttaagttgatgttttagttaccttgcactccatataatattctagttgtttacttgaacctaaaaaaataggttattgcttcataatacttattaaaaacaatggtgatcaagtttaagttctgcttgaattattgcaaattgtgattgcctatgttaagctataaaaacacccttatgtagttagaataaagttgtttaagtgcccaaggaaaagcataattggttaaatttctgtgattttcctttcctaattcagcccctaccaatctttatttttttatttttattcttttttgagacggagtcttgctctcactctgttgcccaggtacagctgggattacaggcgcacaccaccacacccggctaacttttatatttttcttttttctttttttttttctttttttttagtagagatggggtttcaccatgttggccaggctggtcttgaactcctgacctccacctcgacctcccaaagtgctgggattacaggtgtgagccaccacacctggccccaatcttgattcttaataagaaagta

SEQ ID NO: 113153 - DNA, 1263 bp, Homo sapiens
taaaagaggctgaactcctacttcaacacacaagtgcacgtacatgcacacgttagtctccctctactgcattattttacctctttataacttccaatttaaataaccccccacatagactagttaaccttttcatctttgttttatctaacactagcatttaggacctgcaagatatcaccactctgtcccccatcctccaatacctagtccagagcctgttacaaggtagacccctaaaaaaacctatctccgctaaatgactaaggaactggcagggaccatcatcatgtactaggatcagcaggttaattctcaagtggaatttccatgatgatgtcacttgggaacataatgagtaagacttacaagaaagagcctattaaaccaaaataccttttttgaaattgaattgtagaagcctgatgaacagttaccggtttctgggagatcaaaagaagtacaggaggtagttggcctctaatatgataaagttcatatttaccttttgatcttcctctttttaattaagaagactattaaagtagttgagtctagagtggttatgaggtatctgataatatcttttaataaactacagttactttagaatttaaatcactctcagttatcactaccatctctctccgtatggaaatgttgggtgaggactccaagtctgaaaggtttcgttgttctctcaggagagcctggagccatgtgtacctgattatagaaaccattacggaaagttacaaaggaaatgtttacctcactgaattaaggattaagaacactgagagattttagcaggttaaaagctttgtgaaatagcctttgggcaaatttttggaataggggtttgccagcatgagttcggggctctgtctggtgaatattggtgttaaggaagaccctgcacacttactggttcaaggactcaggtttttatgtttttacagggtcataaaacaaaactcagaagaatatatgacagagactatgtgtaaagcctccaaagcctaaacatatttatctcgcttttcacagaaaaggtttgccagcccttgtgagaataactgagtaattttaatatgctaacagaattgcttatattttcaactgtatttgatgacatcctctttcacttttttaggccatgaatattgtcacttcagtgctgctgctttatgccaaagaggaggaagctttctggctgcttgtggctttgtgtgagcgcatgctcccagattactacaacac

SEQ ID NO: 113154 - DNA, 1036 bp, Homo sapiens
agaagttatttatagctgcattttaagtgaaaatgaaactcaaaacgagtaccaggaaactagtgtatacaacaatagtacacagccctatctcagagataatgttgagagttagacccagtgtttcctttaacggcagatggaccatgtgagaccgcagggtggtctccacacggccctctgttggggtgataactgagcccgtatttccacatccaggaatggggttcgcctgaaggccagcctatcatgaagagagcacagctccaggccagagcccaacttgggtctcacctgcttcctgtgacccttagggtgacggcatcatgacctgaactctgtacccgctgaaatgaaatgcaggtcagatgacaagaaatcacagtacgtctcccacatcaacagagcaaaagccagcgttatgtccctgtcagctgggttggcttttccagggccagcgtgagtggtgaggccagctctctcagtgaccatcagagacaaggccttggccagtccaggggtcttggggctccacttttctgaattatgaaatgttgagtgtttaccctgtcaatatatatatcatttatatattttttgtgatatctttattgagatataattcacaacttactagttaaggtgtacaattcagtggttttttttttttagtatattcacagaattgtgcaatgatcacaattatagaacatttttcatccccccaaaacaccccataccttttatccatttggaaaatagatataggctgggcgcggtggctcacgcctgtaatcccagcactttgggaggccgaggtgggcggatcacgaggtcaggagatcgagaccatcctggctaacaaggtgaaaccctgtctctactaaaaaaaatacaaaaaattagatgggcgcggtggcgggcgcctgtagtcccagctactcgggaggctgaggcaggagaatggcgtgaacccgggaggcggagcttgcagtgagccgagatagcgccactgcactccggcctgggcgaaaga

SEQ ID NO: 113155 - DNA, 1035 bp, Homo sapiens
ggggcttttgtggattttaaaaaataagtattctttaatacatgccttaagtgttatgggaaaattcttttcaggaaaaggaggtatttccctctgttatatagcatttattgcattagaaagaaaatccttatgtacaacttcaggtgtctcagaagattcctttaatatatataaatatatatttttaatattctataatgtatgtttaatatataatgtatattatatgtcatatattaacacatatatttaatatagatattaaaagaatcatatatactctaacacatatattctgaaaacagcagtcagatgctacactttttcccttgatggaccccaggcagacctatttttttagatatgcaagagtttttagacaacttcaataggttacttagtcttgagtagggaaaacatttctaagttgtgctttgaaggaaatatatttcacatgaaaatgctaatgaacaacttaaagtttaacctgtctagactgcttgcagtagaaatgaagaagggaaaaaagatcttagctttaagtatattgtcagagctgctgcaaataaaccatttttctagtgcttgccttgagatttgttttctaatgtgctaaagagaaaagttttaatgcgtttatcctagtttctagttgatgaaaatcctattataaatcacccgtatatgtcttcagtttagagctaaatttccccaatgtggtaggcttcggcacacacacacacacacacacacacacacacacacacacacagtctggtagttcagataatgttgcaattaagctgtttacattctttacatgtctgttcagaatagaacctttaaaactttgcagtggtagaaggtgaaggatgaaaagccctggagtctaaatgaaacatttgaaggattggtggtgttttgaaaaccattccaacattaagcttggtaaaaggaaccagtatcatgggttgttttctgtctcttatggctgatgaagcagcgaggagccctctctcttatagctccatg

SEQ ID NO: 113156 - DNA, 1015 bp, Homo sapiens
aagagtaaatgcagtgacctctttagagtgtattgcatttctttagaaagaggaagagtttcctgttcaggcttatttttgctatgattctttaacatttacagacatggattataagtgactatgcaagggactgaaatataataagataattttattacgcttttgggtcattaggttggggttaacttcaatataaagaaagctgagaagcgggggatgagtctagcaagattgaggaggtggaaaatgggctgggggaacttccgctgctgcataatttagaaggtatggaaacatttttcttatgtgaattgtaattattgctttccagtgatcttgatgccagggcaaagagtgagagataccgtgcacttttccggctgcccaaagatgaaaaattagatggccacacagactgcactctctggactccatttaacaaaatgcacattttggggcagatgtttgtgtccacaaattacatctgttttaccagcaaggaggagaacttatgtagcctcattatcccgctccgtgaggtaagtatctgataaaaattgatattttaagtttcatttgtaatacttttctgggtgaaccaggaataatttttttaccaacaattggcttttgaacacaggtgaatgttcatgcgtctttggtggcacctgcattctttcatttgttgtcactgctgtgactctgggacctgtgagatctcttcttccagaagctgcatgggggttttttaatgtaggttttgtttttattttattttattagagacagtctcgctctgtcacccacgctggagtgcagtggcatgatctcagcttactgcaacctccaccctccaggttcaagcgattctcctgcctcagcctcctgagtagctggaattacaggcgcctgccaccatgcccagctaatttttgtatttttagtagagatggagtttcaccatgttgggcagactggtctcgaactcctggcctcaggtgatccacccacc

SEQ ID NO: 113157 - DNA, 1043 bp, Homo sapiens
tgaatttaattatttttcagttcaaaatggtcactaagtaataaagattcactaaaggtgtaattaattcagtagacatggattaaatctataattctgacctcagaattcacatggcccagatttacctcttaaaatgaacaagcaaaacaaatatggtattataaactcaaaggagttcagtgggatgggggagtggggttgtgagactgcaatatcttgaaagcgttttcaggaatcagatgttgacccaggcttgttccttgtgctcagcgaaactggtcatccggtgggtagacatcactcagcttgagaagaatgccaccctgcttctgcctgatgtgatcaaagtgagcacacggtccagtgagcatttcttctctgtattcctcaacatcaacgagaccttcaagttaatggagcagcttgccaacatagccatgaggcaactcttagacaatgagggatttgaacaagatcgatccctgcccaaactcaaaaggaaatctcctaaaaaagtgtctgctctaaaacggtgggtgatagagaccttgtatcttccagactttagaaatgagaaactcactcattcatttattcagtgtaaccttctctgacgatcttcaagggttctgaacactcttctgtgtatagatacaaaactaaaaaagactagctgaggtgctaccagttcagaaagtgagacagacatgacctgctccaacacaaggcagcaggcactcttctggtcctgtgaacacagtgctgtgggtgcacacatggggagtgatagcctcagcccagatggggaagagtgggtaagaaaggcctctcagtggaggctgctttgagctgggctctgaagaggtgatagaagttacctgtgcaggtacatatccatgcctggatatttcaagcagagggaagatgacgatgggggaaacacaagggaaaacacagagagaagtaactttgtcacatggctagtaggtggcagggcatgggatgaggagaggctgcagagaagcctcaaagtctgaatg

SEQ ID NO: 113158 - DNA, 1053 bp, Homo sapiens
aagttcttaaagtaacactaccaacgcctgcttgtccctagaatagcctgggtccaaaattgagctccctcctggccttcatcgagcttaatgtctttgttctcttggtagagtgatatcagtggtaaatagaggaaaatatccttatgttagatatttttccagggaagcacattgctacttctattgctatccataatgccctccagtatgacagaggaacagaagttagcaacttggtacctaatttctcaggcattgctaactccaaaacaattgtagatttagaaatctgcaactctggattatacaataaagactaagatatggccccttaagatatcttttaatttggaaaaacaacaacatggattcatttagtaatattgaacatcttttaggtgctagatattggtgattaaaatgttcgagacattctttttatctttggaattcatatttagtggtagaaggacatataaacatgctattttctgccagcatgtaaattaagacaacatagacgtgagaatgcttagaacccatttggaattgggctggtttcacagggaaggtggtatttatgctggacctggaaaggttgacttgggaagattgagagcagattttatgggttaagattcagtgcagatttcttttctctttcactgagagcctgtggaagattataaggtgggaatactgtagtcagatctctgtttcagaaagtggccatgtgaagtaaattggagtgtggagagtgttgtcaggatgccatttgagaagctattatatagtaattcctggactgtgtagagggactttgggatgcttttgttagaagaataggataaagacttgtcttggggctgtgcttgcatcgtaagcccaccatttgctgttatgattattgtctacatgcttacttttaactagaataggacagtgacagagattatagaagactgaagccctttctcctgccatccactcagcagcatcacaactaccggcaacagggtgaaaggtctgcagtggaaataagactcagga

SEQ ID NO: 113159 - DNA, 1049 bp, Homo sapiens
gagctgatttactgtactctgacaattctgtctctcatggtttaccagtgaattgactattttgcacctggggctcacattggagtaaaaataggtacagatatgctaccagcagctcttgttttggatatggtgttccagaggcagcagagagtccagtccattgtcttccttggccttcagttggcacaggtagaaagccatttggctttctgcccattataaggactagaaggttctaacagtaagaagggttggttatatgatctccatgggaatatgggcacataggaatgcaggtaattccaaggatatgatctaaagaaaggagttctgtgacagctcaggagaattagaaacaaagatacagaaggagctgctggcagttccctctggatgcatctgaccttcaaaaagggctaataaaggaaagcgtggagaggatgtgtttgacggacagctcactgacaacagtgccgaacggtgccttgatttggctgtgtattgattgagtttcccttttctttaccattccagaatgtcatctggtcctagatggtcattgtgtttcagaaatgaaagatagagcagctatcgtcttgcctgcccctcttattgtagtaggatgcagaagcaaggtgaattgtccaagttcacattcctggttataactagttatgtggtgctcagaccaagttctcaggtctccccactcccatcccaggacttcttaagtggcaccatgctggcttttataattaaatattcttttagttagcggctggtaagacccagagtttaattaaagattactaattggttctgctcttattctctactgtagataaagaaaatgttgggtaatttagttgccttctgcatgaggcagacgtaatgtgaaagttgataggtatttttataattatttcttggtctgtgtaactcaaggactattctcgtatctttagaaacacagtgagttaagaaagcaaacaaaaataattgctccttttttcttcaagcaatacatgtttattgcaaaaattaca

SEQ ID NO: 113160 - DNA, 1423 bp, Homo sapiens
acaatattttaaaatgaatgaatcagatttacaagtatattctggataaattttacaaacatattgattgaaaaaaataagctgcagtgtaccttgcagacaaatttgtaaaatactcatcagttttaaattttttatatgaaaaacatggctcagtaaaagtataaggacctggataggaagaatacaaaacaatttaagaatggttaatggagagagggaaatgggattaaaggagtgcaaagggaacctcactgtggctgttaccttttctttctgttaaaaaaaaaaatagatcggaagcaggtaaggcaaagtgttaaaaaagtcagagtagtggtacatgtattttgtaatttcctgtacttttctattgttttgaatgattcattacacaatagtgcttagtgcatactaagcactttctagggtagatactattatttctttatcaggaagcaggggcacagagagattaagggactggctggtatgtgagccaaagctgagcccactcccctgaccactctgccatggatttcctggatctctgcttcattttggaccagcgtcaggactaatggagtcggggaggccaagtgatctttaggatcctgtccagtttaactttagccctgatcatcagtagatggatcgatcatttccatgagcacatttctgcatggcagcacactcctgacatagcccggcctgcagagggctgacgggggtttctctgcagcactgtggacctgccacctgtaccagctcccagctaggctgcagttgtgcagtggtgactgtgcatcacacatcttccagtgcccacaaccaaatgggaagcaaatatggaacaattttgccaagtgttttctgaatctccttgaaaacagcacttttacattataagatgccactgtactaatgtaataggtagatgcagagaagagttattttgagggctgtaatttgatttcgttatcttaggcaatcaagattgtttaacaccagaaatagctgactagaacagctgctaaaacagcgctttgtgtgggaaatgaagaaaaggttcagtattttgacagccatttccaaggtatgagtaatgagacttctaagaaaatcgtaattgttgctgcttttgcagtggggcggggggattctctagaccagatttcccatctcctagtattctacatcaatagaggacaaaggaggagtatttcctttttcccagggtcttgacttcatgtaccaacagagtttagatagcatggtgataatttattatttaggtttaaaacgcacacacacacacacacacacacacacacatgcacacacccctcacttgtccatttatcatcaaccatgtgtttagtgcttactggactccaaagtgcagggcctgtgggtccaaaat

SEQ ID NO: 113161 - DNA, 1049 bp, Homo sapiens
tgtccaacctattatcaatgtttttcaaaacaggtttcaagctatcttcaggccatgactaaactacttagaaaatttcagttgggcctaatatattctgtaagggacttatctacatttacaggtcatttacatttattgaaaacacatcctgttacaatagacatcttgataaaataagggtgttactggttaccgtacccatggttttgcacagtcaaaccatctttggtgagcttctttgttttgtttctctcccttgttggtgccagggtgttttctttattttcaggtcttccgagctcaattttctctttaaggctttatctagactttagctgaagattgctcccacgttatccatcacaaaatgaaatttgtctgtgaggtccctcagtcttatccaggtggataaaggctaagatagaaatggaatgcaggtggagttgcttgccctcaaagtgatgaggttccacgaaactcccaggaatcaagccaggctgctactgtatctctcccttgcaaatagcatgattgttttaattacagtctgtagccactatttttatctgtgttagaatatttggatgcaagactggaaaacattattgctgttaatgcctttgcaccttcttatataacttgctatagtgtggaagggaacatttactcaaagagcctatccagatggagccaaaggggttagttagggtttttgttggtcactttgggttataaggaacaggagtcattcaaggtactatgaattcaacttgctgggctttgttaccaggatgtatgcaaactgcagccagtctgaaagaccagaagcaagataactggagggtataaactgaaaattctaagctcccccaactgattgattggaccccttctgtcagccaaggggattccaaagtaaacctgaaaaactagttcaggccgtgatgagaaaggggggtcagacatgcctcattatactctccttcctttggaattcaggcacaactgaccagtattaatattaaaacagagatcttaagactgac

SEQ ID NO: 113162 - DNA, 1027 bp, Homo sapiens
gcagctggaattacaggcacccaccacagccagctaatgtttgtatttttagtagagactaaaaatacaaattttttttgtgtttttacaaaaataaaaacagccttgccatgttggccaggctggtcttgaactcttgaccttaagtgatccatccaccttggcctcccaaagtgctgggattacgggtgtgagccaccaggccaagactgaatccactttctctgattactttacacaacactaggtaggaatattagggacattcttattgctgtcatagaaataggccagaacaaacatctaaatgtttttccttagactgctgggtgctctttcggatttaagttaaatgagcttagtttttctaggggtttccctggtgatcttctggaaattatttgaaaatagccatgttggtaatttcctaatcatgtggcttgttcgttgtgaaaatgttcagtcattgttgttgcttattcattggactgtctgggaagagctaaggaggtatgaggccctgggtttatgtggggtaattattacatggaggattatatagggtagctctgactctgttttcctcagggttcattcagaggagagagtaatgaagaccagagatcctcacacttttgcaaagaggggattgttctgtcttaataaaaatgttcaaagaactagcataaagatcaggcaaatgtcctgtgagtcacctcccaatgtgcatagctgaatgtactttttttttttttttttctgaaaaaaggaacagaaaaaaaactaggtatatcacatttaaataaaataaagcatatttcatttaactttttaaaagcaaactatggggaaactatatactatttactcaattgaattagtatatactaattactcaattgaatcccatcagtatgcattgaaattaaatgtatagaaatattgtagagtaaagcactattatctaaaatgcttttatgctttatttgttctaatacagagctttctacctattttcatatcatag

SEQ ID NO: 113163 - DNA, 1014 bp, Homo sapiens
ggggctgccttcagccaccgcaatcggtactatttattgaacacctaccaagtgccaggtgctgtgcaaaattggttcatgtgcaatatttcctttaatcctcattacaacctctcaggaagatactattatcttcattaagtgggtgaagaaattgtggtttttatcagttatatagcttgccccaaggtcatgaccctaggaagcagtggaacagggattccacccaggttcttaatgcaaagcctgtggttttgaaaagctaccttccaccaaacccaactccaggaggcagttcaaaacagtctcctgcatgagtatgccagccttgggtaagtaccgtgtaacatcttctgtattacccttgagctatgtacccttgaactgactgagcaaatgaccattctaatgattgctatttgtatgtgctgcttctttcttcgcagccagatcctattctcaaagacatcagtgatagattatatttctagtgcccagcaaagcttcctctccacaggtgctcagtgtctatttcatgatgctaaggatgaaatcacatcatgcctccaggactaaggccatatttttcctttacctcttctagacactaataatcatggtgactacttcctgggattcagaacataactttagcaagcacttccttccagtgcccagcttccttctctgtagaaaaagaagatgcaagtttatgtcttgacgctccttccctgctccaaaattaagcattatttaaagaaaaatcctagttagattacatgagtgagagactctacagtttttgaagcactcccatacacagtatgtcatctgtttctcagcagccctgggagactagcagggaagatgaaatatccctgatgtagtggcaggaaactatgactcagagaagctaagtgacttgtctgaagccacacagcttgtgagtggggaaatgaagacttgaatccactttcttttatttatttatttatttatttatttatttattta

SEQ ID NO: 113164 - DNA, 1043 bp, Homo sapiens
tttttttttaccatttaaagttaaaaattttttaatataacccagaaacacttgactttgagagaattctgtttattttcccctttcattggattatggccaacattcctgactggtgcagaatatggtatcaaaagaatgtctgcagtatgtagccagtgacctttataacaactgtgtgcattgcatttggtggaacagtgtttaccatcttactttctttattaactttgggccagtagaacctgcttgttttagctttagccatggcaacaggccaaatatcagaatgactccctatactacttctgcaaatactttaaaaataaatgtgtccttcctcctataggagctagagttaaaagtaaaaaagtaaaataaaagaaatgtgcatggaaactctactctatttttctggtagactatgatttcttaaagaaaattttatctggagaaagaatttaattagcaaaaggtaatactccttccgtgcaattagagaaactagagatagcaaagagaggccaactgactgctcaggtggagtttaccagcaggtagtactttgatgggtgttatgccattcccacccctttttttttttaacttcctggctaattcgtcactcattcattcattcatttattcacttgttcactcatggaacagatattaggtgcttatcacatgtaggcaccaaggatgcagaaatacatgacaaatttctttgcttaagagactgtattcagcaagaatctgctgaatagcacattctgagtcagaacaatagatttttaatatggaaattagtttcttggtttttgataagacttaatgagaggctttcaaatgcacactgtaatatatgtgccctttatggaaaatagttatttgtgctgaatggggattatagcatcacaaaatgtccacgcttccatcctaggccataggtggtttgggactctgccccaggctgggctttgagagcctgaacgtggccaccagaatggggcctggcctgccccactgctgtgggcagtgat

SEQ ID NO: 113165 - DNA, 1169 bp, Homo sapiens
aataactcttggcatttaaaaaaaaatcacataattattttcaaaggggagtaaggaaagaggcatattgtctgtattgtaaaagtcaaattttcaaaactttaaacaattaggaatattctttattgtgtagatagataccttttcctaaatattttaaaatatgtagttctctttattttttgtttttccaccatggatggagatacagcttatggctatagaggtacatttctatgaacaatgcttgtagttttaattttaagagtacaaggtgataaatggaaactgacactcagctctaacgtcaaggagacagtctgcagtgatgaggactggggaaattggagagttcatgctgtaactgaaatcagtagtcagaagctatttttatagtggcgattgtattgtacagtgtcaccatgatgtatattgttataatttacatatatattatctgttggattgtatcaataggaattttcatttcctgatattcattaagcatccttgaaatttgccccaaagtgttactgattcaaataatcaccctttccaccaaaaaaaaccctggtttcctgttaacagtgaaggaattttagggcttgatggggtgttatgttccttggtacagacagctgtggaagacttgagttctatgttgaaactggttttaacttgtaatggtgtggctgatgttacccgaccaacaccagatttcatttcagttaattaaataagtacttaatgagaggaagaaagaactgagcagtgttttatttaggacttggagaacatgggtgagtaaacagtaacaatgtcctaaatgggaaaggtgttctaatttcccaaaagtcttcttgtaattatatttgagacatcttacaatagtatctggctattaaggcagaatgtatttgcagatttaaatattttgcaactgcccaaagatatccattagtgtttggttttctttctaaataagacctgtgacaggtctctgacaaagacaagcaactgtccatggagacttgatgtcttggaggtcaactggagaagattaaggtataatatctcccatacctctaagtctcattcccatttaataaattaaaaccactgcatattatatgttattcgtatgtttatcaatactcctttgaatttgc

SEQ ID NO: 113166 - DNA, 1254 bp, Homo sapiens
agtggggtcacctctagtttctcaaatatggctctgcttgagtgtagccactgatccttaggaagaggatgccatttgccctttgactttattttatttattcatttattttttgagatacagtctcactctgtcacccagggtggagtacagcggcatgatcttggctcactgcacctctgcctcccgggttcaagcaattctcctgtctcaaacttccaagtagctgggattataggcacgtaccaccatgcctggctaatttttgtatttttagtagagatggggtttcaccatgttggccaggctggtctcaaactcctgacctcaagtgatccacccaccttggcctcccaaagtgctgggattacagatgtgagccatcgtgtccagatgccctttgactttaatctgtttatctgatctcacctgttcctctgagcccactgtctccttccccctcactctctccttccccctcactctctccctaataaaacccaattttccttcctgacaacctcagcttcatggtatattctagggaggtatcatgtagctttctttttgtaaatgactcataaatttgtggatcattatttttcagaagcctgataatcttgtcagtatcattccagtttcagggtgtgtttgcccagaaaagcactcggtaacttttttacaacataagtaggttaggttgtatccttgctagaaatatgtataatgagctgtgatccatccccgctttcttagtgccagtaaacactctggttgtctagcaaaagacagctcttatctcttgttgttgttgtcatttcagtttgtcacagggactgtgctcaattggatgttattgtacgccacagtaggtcttgctattcactgtgcaataactgtactaaactttgacatgtacacttttatttttatttacttatttaagacagggttttgctctgtcatctgggctggagtgcagtggtgcaattatagctcactgcagccttgaactcctgggctcaagtgattctcctgcctcagtccacaggtagctgggagtacagacacatacatgatgcccggctaattttttgtgatttttagtagagatgggtctcactatgttgcccaggctagtctccaactcttgtgcttaagtgatcctcctgcctcaatgtcccaaagtattggaattacaggcgtgagctaccatgcccagctgacatatatgcttataaaagtcacttgcag

SEQ ID NO: 113167 - DNA, 1047 bp, Homo sapiens
gagtaaagggggagttcattatgtagaccctctctgggtaggtggaggaaatgaaccttgtctttctcctgcacccaggaagatgagattgtaattgggtattactggtgtggaaaacactttagttttaggagctagacttagattgttgacctcaagttaaaattgtctgtccctgtttttggaaatccagaaaagaatttacttattaaagatcttttagagcagtccttcagcagatgcctgaggccttttacctttccatgggaacttggctaatacatagtgttaggaacagctattcatttggaagaggcctgttgtatgactcagcctctggactgaagttcaggggtctagagattattaatcaggggcctaaaatcaactcttttactttatatctgggtgcaaggagcacaaagctagatgaagttccatgaggtgatgtcagaaatgcacacccataactgtacctccactcctaccttttcagctccattattctaaggcatgctggacagatacttgctagagtgaagatcaagcagaacattaaggatttggtctctgtttacactgaacaaacaaaagggaactcttgtttatctaattctgtttcttctagattacttttaatgcttctgtttaaaaaaaattttttttttcaatatgatagggtcttgttattgcctaggctggtcttgaactcctggccccaagcgatcctcccacttcagcttccctagtagctgggactataggcatgtaccgctgtgcccagctttaatgcctcttaataaggaaaattctacattttggtaatatgtacaaatgaatttttaaaaattcattttataattagcatagacaatatatagacagaagagctaaaatttgccgaaaatctgtgattcaggcatcctgctgagaactttttcattctttaattgattgtcataataaccttgtaggttagatattattcccctttatatatgaggaaactgagttctcagagaagtatttacctgaggaaaccctggt

SEQ ID NO: 113168 - DNA, 1940 bp, Homo sapiens
ggaagaaggttaatttttgctccactttctttactggcaacagcaggatcaggtataaaatgctcttttgtttccagggaagcgataagtaaggaactgatgtggtcatttcctatatgagttatgaccgaagagaatgaatacggaaacaggaatttttttgtttcacctaattagacataaagcaaagcaaattgtctggttctagttgtaaaaataattggctgtataactgcattttaactatttttgctcaatcacttcttccctaaaccccctcccttcaaggtattattgtaattgttgctgaagccatgtcatatcattcaggataataagatcagtcagacccatatccaaagtagtgccatattagaaataatctcgaactcataccatactagagaaattggaccttctccatctctgtgttatttagaatgaacagaactggaatactttttacagtgaaaaagttagcagaagaaatagtagaggtttcactagaaaggagactgcaaaaaagagatgaactttgaccctcctcagagttgagcttatatcaacctcatatatcacctggagtttgcacaataggtaaattgttgctttcaaatgctgtgctatgaaataaagattcttgatatatgtatttacttatgattatatttataaactaattttcttaagattaaaattcaggtgtcatgtggtacaatgtatactggtatgtttgaaggatcttgattctaccagaaaagataaatctgcagagctccagaccccattctggaaatacttactagtgatctgataccaggattttccaggtcattttgtagaagttatctaactctaaatgttaatatgtaatttacatatctaatattggaatcagcccacattgtcctttttttttttttttttttttttttttttgagacagagtcctgctttgtcgcccaggctggagtgcagtggcgtgatctcggctcactgcaacctccttctcctgggttcaagtgattctcctgcctcagcctcctgagtagctgggactacaggcatgcaccaacccgcccggctaattttttttgtatttttaatagatggggtttcaccatgttggccaggctggtcttgaactcctgatctcaaataatccgcccactttggcctcccgaagtgctgggattaaaggcgtgagccacctcacccggcccatgtagtcctttaagcctaggacaacaacacagagtagataatttattgtagtaaaaagagaacatttccttctgcaattaaccctcctacaccttgtaagcattaagtattcatttacctgtgtcatttgtaataggatgtgaaaaattcagggattcagagccttctttttctgcttaacatttgtattgtgttcctactggttcttagagctataactgactacggtccacttgaaatctcatcttgtcatcaatgacttctttcacttaggtaaaattacatcttgtaaattgagaaatcacagtgattgcacttattaatggaataattgaaatcattgtcatgagtaaaagtatttatgacaacaaaggctattttcaagcaagagaggtaaaatgtttggtctaataccttggtgccatgtcaaatgtagcaggaacattttagaaatgttacacaatgtgtagtatattctgattctaatgtaagttcattcattcactaactcactaaatcatttaacaaatatttgttggcaacttctagaagtgctaatgttgtgaagctcaagcctagtagaagacaggtattgatgaaataatcacataaattaaagtaaaattgccactctacagagtcccagcagaaaacagaatccaaatgaagagagatgagtgaaaagacaacttcgaaaaatagaggcatggttattt

SEQ ID NO: 113169 - DNA, 1019 bp, Homo sapiens
acagataaaatccccttttttacagagtccatgtggaatgggagcattgtcagatgatgtagcagacctcatgacaacttgcatgtatcatctttgttgcccgagcaccattatgtacaaaaggaaaggaaactaacatctatcagtaattcattttgggtcaggcattgtgctaccttgtcatattatttagatatagactatatggtttagtggttaaaagccagactagacccagactgcccagacacaaatcacagcttggcctcataatagctttgctaccttgaacaagtcacccagcctctctgcttctgtttccgtgtatgtaaaatgcaaataatagtaataataggaccaatatttttaataggattctagtgagatgtaaatgggttatgtatatgaagcatttacacacatatataaaaaatgctataaaagcatttgctaataaagcaaagcaataggtagcactagaattcacacttattttaatccaaagtctatgttctttataatgtgattctctataactgtgattctgcatgctaactaatagttaatatgatgtggtagagatcactttaaattgatgtcatcctttatttctaggaacattagaatgtaagataaagtgtttatttttcattgtgtttatatttatcctcaatttggacattggccttagaatcttaaccttggatatttttcaagtgaaagaatagagatttaaagattatactctaagattatactaaatatagcagtctatatttgacatagtgctttcctctacctgatttcatttgattcttagactagaacattgtaggtggaaaagaacattgtagatggaaagactagaacattgtagactagaatattgtagatggaataatatatatatattattttttttgagatggaatttcgctcttttcacccacactggagtgcaatggcacgatgtcagctcactgcaatttccgcctcccgggttcaagcaattctcctgc

SEQ ID NO: 113170 - DNA, 3130 bp, Homo sapiens
cgtttcataaggcttagaatgtacttaactatcaaaaggatagttcttgtgttcattctgtggtattttattccttacaaacaattgaaaaagaaactaccaatgtatttagcctcctttgtgataatgccacttcttcagggaatcatatacccggagtatcactctcgcatacctttgttattttaagcatgggtaggtgcttgtatacatgggtggagttggggctttggtgtagtgtcacttaaattttaacctgaaaagcaggttattctttgtaatacaagtaaatttgcagttttcagtcagcagaaaaattaatgtgatatttttatatgttacaggaatgtgacaagtgtcagaggtaaattttatttctttttctatctacctttaataaaattgtccctctgactttttatctgacattgaccataatttaaaattttattttacatgacaaggcggcagaagaatagagcattttgctacttttgtaattctgtacagaagttaccaatttgtgcacagtgtggtaagtttgtaataattaaggacatatgctttttatcaactggtagttcaacaatttgaacttgggtgggtttgttgctattggttacagtgcttacaattgttgataatattatgccttaccattaacaaaataacaaaacatgttattttgcctaccaaaaaactatcaagccttggttttgtctctttgatgtaatgctggaaaataattaaggtacaatttagatacaggttaccaataagtgtttttaaacagtgaaagatcagatttcagacataacatttggtgatcctgaacttttagttatactaccttagtcttgtcagtatctgtttgtttacttatctacattttgattcctgctgatattacctgcagtgtgttagaccattgggaataattttattccacatttacctggtacttattttgtgatcagtagtttttgtgtttgatgcttaccatatgattcatgagtttcctcacatgtattcccaggtgatttaaatagagttcttaagtcatgtgcccggttcttaagtataggtggagacttgtaccccaaaatgattatacaaaataaaactaaatgttagcaagatgggtgtttcccaaatagtcttccacagacttcctgaaatattaatggatatttcttgaaaaatatatatcgatatacatttgagaaatactgcatgcatcctcctttcattctcatctgggagatttctattatatatttatatgttagaagttctgaagacttgcaacaaagaaacccaattaactttattactctagatttacatccccccccaacttttgatgaacaagtattgcttttatttatgagataataataataatttcaggtagaacaatttggggtatgctcatttaagtgtgtttatatgtaataatattccagaaagttagtagtgtttagggctatatccctgaatatttctaatgtagttctagctttcaaagaagatcttttcaattccacaattaatgaaaaagagaaaactggcctatatggaacactcatatggtagttttcatagccttgttttgcaaaaagtaatgaatgtagagtgaggaaacagagtttgtggaagattaataggtaagttcttgctaggacttacccctattttcagtgtctctgggcttaaattttgtagtgttgttagatggatacatttctcatttactgattcttagtgttggacatggaacagttgggtagctgctgcctctcatttccagtttctcttcccatttcctactaactttgttccttaggaaatcaagataacggaaaattgtttcttttgtgttccattttgtggagtctcagatggatgattaatgtcatcattaactctcacataatatctgataagcaaatttcctgatagtgttttgagttggtaatttaatttgcttctagatcagaggtttagtggctgtgtggtgatttgtagctgtatcaccgtattgtttattgtgcttatttgggcactatttcaaaattttgttgggaaaatgtttaactgggggcttcgttgtaaatttttatgtttggataaaattacattaactcgataagttacataatcattatttggtttggtttgaggtattattctgtggaaagaaataacttcaaaccacagtttttattgtgaattataaaatgtaaaatttgttataaaaagcattcctttaaaaattgttttgaataatctgaagattgataagtttttaaactgttaaaatgatcattagattacaaagcataacctgcaatttctgatttagtacaaattagcatatatattgtatagttcattttacagatttattagtaaatgtataatctgaaaagtctgattcgagtaatgaagtctcagttatatccattttctctttctagttatgtaagcagtaaatactgattcaatttcattagtttttaaattatttcctcaggaacttgggctggataaaaggaggaattcgtgagtactggtatgtattcctttgcaagactaacagtgcaaatgtttttcttcattagggaaaacaaagtgcatgatgaagtcttcagactgtgtcataaagcatgctggtgtatacagtactggccttgcaatggtggtaagcttcttattatctcttagactagtacgttttcaaggataagaaaatgtcattctgatcagtggttatttttttctaaatatcattgctttgtcccttgtttcaatcaatctgtagttatctggattatgagtggcatgctttttgtatgattttcccttagtacccacttgtttctagctgcttctttctttcttattagggaacatacaaggcatggaaacttttcatgctgatctaaacagaatttcatttctcagtggtacctttttttttttaaattttattattattattatactttaagttttagggtacatgtgcacaacatgcaggtttgttacatatgtatacatgtgccatgttggtgtggtgcacccattaactcgtcatttagcattaggtatatctcctaatgctatc

SEQ ID NO: 113171 - DNA, 1306 bp, Homo sapiens
tactattataggaaaaagaccgaaattccccaggtattctcttcctttaatttggttcttgttctggtatgaaatcctaattattatacttatttataaatttaaagtagataagtcatctctgtgatatacatacaacatacatactacacacacatagacacacaatgtgtatgcatgtgtatataattcttgcaatatttatatataaaattctcagattaaaagagcatctcgaagtatatagcatttttgagcctttcgtcgccttttgcagaatgtataataataaatttaattattttatttgcagcatgggagctttgtgtgttttatagcatttgaacccaaaagacaggcagctgtctataaggctatattccattgcaagcttttagtgatttgataaaagacaaaagaaaattctaagaaccaaataacgggattttaaaattaatctatttcccacaggtgtttcatgcaatcggcttggtcagcactcatgtctccgttgtaaggtataccaatgcgtttttttctttttagattttgtttttaatctctatacccctccaccagtccttggcttatatgcagctataattaatttataagggaccttaaaattatgtagtctaattcttttatttttgagactgtggaattgaagttgagaaagcttacatgactttccaatggtcatccagtcaccttttagtagagctgtggctagtgcacatttctctggaatcctggctctgtgtttttagtggagaacattctgaccaagatgatgagagtctattttaattaatgtcaaaatatacctgcttagaagagtttgggtaaagatttccaaatttttctgtgtccttaggcctagtctctagcattcgttcgtcaaagattactaaacagatgcagccaatgcccttcctctcagaagcgtttctctagttcttatattcctaaccctatgtcttatttatcttccaactctgttctagttttaccaaatggtgttcaggcattatctgtgttttctttgtctggaatacttttccatcttggcttaccctattgccctcccattcttcatatggctattaagacttcgtgtctctaagatgcctttcccaaatcccatgtctgctttagtgcccttccctctgcacttcccgttcagtgcttagtgtcttgtaattgccttttcactgtctccatccctagttagaccatacactgtgtgagagtaaataggctgttcaccattatttcatttcatcagggaccttatgagtactga

SEQ ID NO: 113172 - DNA, 1472 bp, Homo sapiens
gatgattttgctgatcttctgcactgaactttgtgtcactattaaggcagaagaaatgacaggctttgtttttaagggcatctgcattgtaaaatagctgtcttaagaaaaatgtactgatacgaaatcagctgtattctgtgatttatgtgatttgaaaataaactgtcagtggccaaacggaaggtatttttgttttaaacatgccttaatacctttggagtggtctgttggtctaatttgttttctagatttaatgaaattacactgtaatttttattttttatggtgttgtatatagactcaggtgaaaaaattaggaaaatgtgacctattttttcatttgggattgaagcagccaatgaaatccatgaaattttatagaggaagatgagaatgtagagaactggaactaacaaaatgccttgtacttgtctgtcttctatagcacgctccctgaaatttggcaggcagactggaggtgaagagggagatggagcttctgggtatgatgcttattggaagaacctttcatctgataagtatggtgataccagctaccacgatgaggaggaggatgagtatgaagcagaggatgatgaagaggaagaagatgaaggcagaaaggattcagatactgagtcatcagatttgtttactaatttgaatttaggaaggacctatgctagtggctatgctcactatgaggaacaagagaactaggggagctgctctggtggccgtgtgtgagaggagcaggagtgagtgtgtgtgcttgatgaattgtgtgtggttgttcaaaagtaccttagccacttagccttgtgcagaagactagttacacttaatgggccaagcaatagggtgtagcgtttttatagaactgataatcaggcttatggcataagaaaaatgagtttcaaatttaagatgtttattgatcgaagcaattgaagtatcatggattggattgttactgatttcagtaaagtatgttttgccaattagatacatatatacaagataaaggaataggatggtaatatatttgtttgaaattaaattactgtttttattaaaaaatactgcttcattgggctgattttgtaaaatgtaatgagtaaaatgaattactgtatttttccttttatgtccacagaatgagagtcatatgttgttatattctaaattttcattaaatattcatgtcaccttgagttgtcatgataagtatgttttagtatttgacttattcttctctttcttcacaatgtatgtcctcagtggtacctattattgatgccttaaatgtattgataaggtgactagttagccatttttcagagatacagtatcagaaatagtattattacagaagctttacccaggacattttatttctctttgaataaatctattatttcacttaaatacttttgacattatatttaattttttgttctgtattttca

SEQ ID NO: 113173 - DNA, 1132 bp, Homo sapiens
gtatacacttaaagataagcagcccagaccccatcattgataggtggaggacagtcctgtcacaagtcccagttgttacaacttaacactggcatttaatagggattgggtagttgtacaaggagagacaatatctgattgcctcacattttagatgtatggagaaaattgtagctatgaggataacagggttgaatggccattgttaagccatttttgttctatagaagcatacttaacagccaaggacaataacaggcaatggaaagccaggtgtcaaagttagagggcctctggtggcatgtgaaaaagcttttcaccttttgcagtaggacggcttgaaaaaactgaggagcaagcccgagacttaatagtttcaaaggataaaatttaaagacagttgccagccaaggcaagtctattatgccagcatcggcaaactgcttgggaaaacctgtgaccctgacaaattagatggagacatctgaatcgatggtgctggagatttttactccccagactcctgcatttctgagtttgcagtcatagcccacccctccatgttaagggcaagcactccccacttcattctcaggctggatgacaatgcagaggcttctttcctcgggaaacatgctctcttcaagacttgccctatctctaggccattatagttagtatctccaggcctaaaattagggttaagtgacgataaagttaagcaaaactcagttgaggtgctggaactgaagtgggaggaaacaagactatgccccaaaagaactgcaagaattacgaagagttggaggaatatgcttgagattggaatcagtgcttaagagggtcaaaacataaaattagggaggagtttgatggcagccctgacactggatctttggattgctaagagttaaattagagggttttaataacctggctaggatcctgtgagatggtgcgaactcattaccaggatggcttcttgaaatatggaaaaagtaatggtcctttctgagcaaagtcgaaacactgggattactgtgacatggtggaagaatggatttaaatggttaagggaattgggtatgctggaatggattggaagatgagatgattatgttccatgggaagg

SEQ ID NO: 113174 - DNA, 1043 bp, Homo sapiens
tagtaaatttttaccttacttatcgtgaacctcattttaatggccatatagcagtctatcatattaatataatacagtttctaagtctttttttctattgttgcaccttagtcattttatacttccattgttataaactcttttcaatgagtatcctcaagataaatcattttatttatgtccaattaatcctgtaagatagttgcctctcaatcaaaggatatggatatttttaaggacacattattgttgagtgggtcttttatcccctctcacatttccacttcacccacaggaaagactgaacacaccccaagcctctacatttagggaagtgttgggggagatacatctgacttttctacatcccattctctatcctattctgggagaaagagtggctaattgaagtggccacagagcactttagcagggcttctgttcattagtagttaaggtctttaatttaaaagttggatctaagtgcatcctggcctcctgccttgtcttatacatctggtgttctgtatttcagtctgacctgacctgactcagaaggatagccttctatctagctttctccagactagccatactcctggccttctttgttctggttgtgactgagtacatggataagttgaaagtacaaatctgtctcttggctccaggttcttgtggttgggtggataagccaactcacattcaaagattagagaataggatctaagaagtcttacccaagattcctggcctattctcagcctggttccagtgtgtcagtgtttatgtaggaggatggaggcaggaaggatattaagcactggccaatattaaatagaccagcactttacctttactttttcatcatttcttttgtgcatcctctcctatcagttcctgaaacctagagtagagtacttccttcaaaaagggctgtgaacatgaaaatgactcagaggatattatcaagtacatttgtcatgtcttgacaggaagtgttttaatgtccatgccgtagtggtggtcaaatctatcaaatg

SEQ ID NO: 113175 - DNA, 1184 bp, Homo sapiens
atttctactttaagagattttttcaaaatcttccttagagggatgtaatgatcaataagtttaaagttattttggagggtctgaagtggaagttgaaatgatactttatgtttctttatatttcctttctgattagtgatttacaagttaatattttagctcaacaataactcgataaattatgaaaaattaaagtaacttatggactaaccatatcaatatatttcagtattctgtctatagtatgagtgatcattgctgttcactcctaatctttcattcctgtaatttaacattccttgtaaattaagagtctacccatgagggtgtagcataataatccttcctagttaacacctttgctgcaatgactttttttttttgtaaagtgttgttctttttaaatacttgaacctacttgccatgttcccttttctttttaattgaaaaaacagatgcatcatttgaaccttctgtagcattggcaagccttgtgcagcatattcctcttcagatgattacagttctcatcaggagccttactacggatccaaatgtaaaagatgcaagtatgacccaagccctttgcaggtacttcttcatgacactattaatggtaattgtagatttggggaagaggaagtattttgtattttgtgagtaatgaaaaacttacgaatgtttaaaactaaaatcatggaatgacatatgtaaagattctccaaatagattggaattgtttatagcgttgacaggcatcccaataattcacaaatctattttcaattcaactttttttaattaccaaaatatacacacatatacacatattatacactcagatgttgattggattatcagtatacagtatttcactgcccattattgtttcctgcaacctatttctttcttctgcgtttttttttctttcttccttagtaagtatatactttactttctctttcaaccaggctcaatgtgtaatacactctttgcctttgcctgtttgaattttttttctttctcagttttaaatagatgatttggcaagatacagaattctaatttgatagccattttctcttagcattttaaaaataatactgtattacctttgggcatctgttgttgctcgtgggaagtcagctgtcaatctgactgtcattcctttgtgagtagtcagc

SEQ ID NO: 113176 - DNA, 1086 bp, Homo sapiens
gcatttattgaacgctatataaaacagcagatttttttgctacacagcattccctattcatcataccctgctttaaatttcttaataacactaaccaccatgtgttactttttattgtttctacctgccctctagatggtaaaccctgtaagagagagatggttttttgtttttttaatccactgttgtagcactagttcctagaactaggacaagtaatagtatgtgcttaacaaatatttgttgagtgaactgaatgaatagtggactagggagctattgccttgtaaacatagtttgacaaatttttatttaattggggagttttaacagttggttaggccagttacattacccttgatctctgtcacgttatttcctaacttcatccttctcccaaagtttaataatataagttatgttagaactttccagaagggggacattcatataaataaattctagctctaggaaaataaccactgttggattaatgattttcctgcaaattcttaagaaggtgtcttgtcttattttgaaggtttttaatcgactttggtttcctcttgtgagacctggtgctcttgcagttctttctcacatgctgcttagctttcagcattctccagaggcgttccatttggtaagttatgacataaacgttctactttgaaaaagcctcaatttgaaaatttagtttaatattgagtcacatttttatgtagtgaaaatattgcaagttagtcccaaatctgttttcatatagctttatgatttcctagaaaattgagattgtgagatttccctcctaggaatatattttcgtgtctcattcaaactactccacttgcaacaactaccagcagttgagagttactgttcacatgggagatgtcactgatggatgtctgttgcacaaatgaacagtatagaaggattaaaatgattgaaaaccactgctttagaattttgaaagcatgaaaacacaccagtctttgcaggcttttcattcactctcagcctacatcctacaaatcctgttgaccccacctttaaaatacatctagaatcctaccacgttaagcc

SEQ ID NO: 113177 - DNA, 1080 bp, Homo sapiens
tctctgtgcttatctaaaagtaatcccattacctgagctgcaattttagttactcatgtaaagattttcttgaagtagactttaatgtgcaatgtacttttaattctttcaagtaaaaaattttagattcacactagatggagctctttagctaattccaggattatttttcaaaagtttattcccattgaatgacctggtaaatataataaccctaacaatttcaacctacagcatttttcagaatggtggcaatgactaagattcctattttataccttagtttatgttttagatggtgtgtaaggatgaggagaggggtcatatatgagattacagtcatatgcgacttcgaaaactagatttaccttgatattttagaaatgtttaacttaataacaagaaaaactctgtgactgcacatacagaaaagtatctgctgatcatatatcgtttgtgttctgtttgtaggctagagaatgtgttaccaatttgtataaattcagcattgtttatccttttttcttttcagattgttcctcatgtggttaatttggttcattctttcaaaaatgatggtctgccttcaagtacagccttcttagtacaattaacagaattgatacactgtatgatgtatcattattctggatttccagatctctatgaacctattctggaggcaataaaggtatgatgatagttgtaccaatatttgtggagttgtgttatattaataaggtgaaacattcttataaccagctactcaatttactattttatggtaatatgctttttatttgaaaaatgcagttagaatcaggtttcatttagggagtaacagctttcttgctggagtcaccattctaaattaataaccatatttctttatttctgcagtgtcatcaattataaggcatatctttaaatttataatagctttttgggaaatttgtttaaaaagaaatgctacgttaagttaatgcatacatcagatttgcaccccaatattagaagtgttaaagtatatgtagagtacatcttagaatacaggaaatggagtttaataaaatatttgac

SEQ ID NO: 113178 - DNA, 2336 bp, Homo sapiens
caggctgaagtgcaatggcatgatcacggctcactgcagcctctacatcttgagctcaagtgaccctcctgcctcagcctcccaagtagctgggactccaggtgcacaccaccacgccaggctaactttttattttttgtagagtcggggcctcactatgttgctcaggctggtcttgaattcctaggctcaagtgatcctcatcctcccaaagtgctgggattacaggcatgagccactgtgcctagcctaaaaagcacttctgtttgtgttgaagactggatcacaataaacatactttcctctcagtaaacttactgcataatcagtgtatagcaaaagaataggagaactgaactcagccaaactcaatcagaaattattagaaatcaattctattgatggtttttttgagatctgaatttcaacataaaggtcttattatctttacttctgtatctgaggtggattaaaaacagttctttttactgtatcattaactaaatcaaacttattttggttgagctcagaacacaaagactgttaagcaattaatgtatattgctggggtgacactttgacacttcagaagtagattatgttcaggagcattgtgaagtggatttgatggtaatattaatctctttctacattgtccctggatccatagatgatagttgctgcacttgttaattgattgccattgtttagttcatcagagtttttcatgttgaaaattctgataactcatataggctcagaagaaacaatgggctcgctctaagcccaaagaaagcactttttcttagctgtcaacaacaacaaaaatgagaagattgaaactccttcagaaaatgtttgtttgttaaggtctaagtgccagatgctaatagcaatccagataagccctaatgattttaccaacttcccttactctccagtgctctattcatgcttgaaataatttacacttgaaatgttatctcatacttcacaaagttgataagaaaaatccatatgttgtaataattttctatatgggtaacatgagattaagttttatttttcttaaaggtcattgtgcatagatgctttcatttctcatttcttaattactttgggattttatttctaagggttaatactgagtaaatattagtatttaatgaaaaggagacatttttattacaaaatttgaaaacaaattgtttacttatgtttaactgtgtgctaaaatttaagtcttcattctactgcctttgaatagcactgcagtgtattctctgaccccaaagttttattttataaacattttgctggcatatagagaacataaagagttcaaatgtgacttgaatttccagcttttgagtattccttaacttgataaaatctgttattagacaatatttatttttgccatacagtgaaatttgatattttcatgactagccaagtactgccagttacttcaaaactaagtgggggaaaagaaagttcaaatgtcggtgtaagaatcttcttaatggtgttaattaatttaacaacaaaaataatttttactttacttttaaactgtttttcttctttatgacctataggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagagtaagtttaaacttgaatcttttcattttaactgtagaagttgatgcatgctgatgaaatataagatgatagaattgtctacacattattccttataaatggcataaatgttaactttgattgccttattcagaaatgaaactgcttttagtgctcagaaactatgaaaatgttaacattaggctgggtgtggtggctcacgcctgtaatcccagcactttgggaggccaagacgggtggatagcttgaggtcaggagtttgagagcagcctggccgtcatggcaaaatcccatcactactaaaaataccaaaattagccaggcgtggtggtgggcacctgtaatcccagctactcgggaggctgaggcaggagaatcacttgaacccaggaggcagaggttgcagtgagccaagatcgtgctgttgcactccagcctgggttacagagtgagagtcagtctcaaaaaaagaaaagttaacattaattctgcttattattcattgcatttaaatgccactttaaagaaattactattccaa

SEQ ID NO: 113179 - DNA, 1077 bp, Homo sapiens
ctaacttgcttttagcttttaagaaatgcttttaaatggccaggcacagtggcttatgcctgtaattccagcactttgggaggccgaggtgggtggatcatttgaggtttcggtgagctgagattgtgccactgccctccagcctgggcaacaaaaggaaactctgtctcaaaaaaaaaaaaagcttttaataaatgcatgtgtttgtacgcacatatatataaatcattatattctctttcagtttcaggagacaagtattatctttaaatctaaatgggtgcaattcattaatgaaaaaattacagcatctttttgcctttctggcccatacacaggtgagtgtgtatgtgtatatagtacgtttatgttaactgcgtggtaatattcattaaactttaccttatacctaacctttttaactgatgaaataatataatagatatctcacccagtataacaaatccacttagaaatgctaaagagatcctgcctaaaatatctagattttttttattttcaggatatgccctaagtttttatatttttctcttgcttcccattattgtagctgaatattacgctgacccattgatctagaaatttttacaaagaaaatatgatttcctatccaataaataagttccttcatgaagaattatttttaagtgcatctttgtttcctgatattaaattagtagatttgtacaataatgagcaaataaaataatattgtggtgcctgggcttttttctcttttcttatgtatacctattcattataactaaagatctctgcagttctgtttatctgttaagttctagagcttaaaatttcgtggtgatcttttatgtccacacattaatccggggtcattaatttatgttaatggcaccaaggtggtcatatatagtaaatattcactcaacagacatttattaagagacgctatatgcagtcagtgataagcattaaaagaagagtcttggccaggcgcagtggctcacgcctgtaatcctaacacttggaggccaaggcaggcagattacttgaggtcaggagtttgagaccagcctg

SEQ ID NO: 113180 - DNA, 1048 bp, Homo sapiens
aacgatccattgtatttagcattttaatttcataaaagttatttttaattttaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaa

SEQ ID NO: 113181 - DNA, 1046 bp, Homo sapiens
aagcaattatacttgtgcagctttatctatgaatatcaggtctctcaaggattttatgtatcaagataatatgtattgacttttttaaatgataaaatgaattctagttagagtctttccttggtatctgcagtggattggttccagaacaccatcccccaatattaaaatccacagatactcaagtcccttatttatataaaatagcacagtatttgcatataacctgtgcacatcctcccatatactttaatctccagatgattagatatgattgcatagcacttacgttgtgctatgtagttgttatattgttttttcatttgtactattttttatgatatttattggttttttaaattttctatccaaagttgtttgaatctaaggatacagagcctgaggatatggaaagctgactaaatatagtaacactgaagagtattcaaatgataactcataccagtaccaaaaacttgaagacttccttttaacattaaaaatacagtaactttttacgtgatttgttgaattcaacatatttggaaccagaataatcagaaacttcattcaaaacctatgcatctgaacttttttagtaaggtaatactcaggactgttctgattctaacagatccctgttaattacagatttatttgtcatattaggtcttttctttctcccatattcctaacccgtgtactagctccaactgttgtgaggtttgactctgaagactgagtagagtactattgttgtttttctttccttagtcagagtaatcagtttaaatgaagttgctcattgctgctaagaagcattaggcttcactgctagcaaaaatgaaaaactacaaatctgagtctttctttcaaagatgtttattgacataattaaagtaaaaaattgtttagagatatgcaaagaaggaaatatatatgatgtcacacaagctccagtaagctatccactaagcaggtgcctgtgcaactctgatttatggcattaacatatcaaattgaaggaaggattctagctcattttc

SEQ ID NO: 113182 - DNA, 1034 bp, Homo sapiens
gacatctggatcaaatatttttctagtaaaatgtgtttgcaaaagcaaaatttatgcccccttaaatataatataaatttaatgcctgtacgaagggaacccgtttgtcgttgaggaatatctacacccagtattagagctcaggttaatcctgttagtcactgtttgcttgtatagaacagagtgaagtacacagagtgaagtatttaacttcactgacaactcaccagtgaatttctgatttactttctgccagaatttattatagacaagtaattttattgaaagactcgatgccacaaatcataagaaagctctccagagatgtgtaatgcctccaaatcctgtccatctatcagttttcctgaatatcctagtaaaaatgctaactttattccaaaaatatgaacgaggcagtgtttttttttccagctgttctaaagagaaaggtaggggtgtgtgtgtgtgtgtgtatgtgacagagaaggaagggagaaaggggtagggagataaatatatttgttttgagaaggcccaatttaggaaaaacagattcttggaggaattaaagaataacatatttgctgaacgtgaaagtgataatataggtttaattcattctttcacatggttagttcatggctcactcaaaagacgccaggcactgtattagacaccaaccataaggtcacaaaatacagtaggaaaaaggaaaaaagccctgcctcttgggcttagaattcaattgaactattaaccaggaaagaaatcagccaaaaagattatgtcttaacaagaaaaacaaaaaggaaagtataatttgatcattacaactgttttctgaggtaggtgtcatctctattttacagaaaacagtcctgcatttgaacccagatctgcctgattgattggactgtaaaaggttaacgactctcacctagttcatttcaaatgtggagcttagactaggttatctctaaaggtccttcaggctcacacctgtaatcccagcactttgggaggccgaggccagt

SEQ ID NO: 113183 - DNA, 1064 bp, Homo sapiens
gtgctaaagaaatgtaagacctagtctttgcctttaagtagctctttgagtctttgggaccacgagacaagtatatgtgaaaaagccaacagtgcaaagtggtatatgactgtgtgtctaagttgagtggtatgggtattttttggctgttctgaggaacaagttcaatgtagactgaaactatgggaacatttgagagagacagtgggctgcctacattgtgttttccacaggaggatgaatgtgcctaatagcttgggagaaactaggattttctttgcctggtgtagcactggtgttttctttacccacgaataaagtagatggagatagtcctggaagacagtagacagggcggctgtcagaatagaggaaaccagcatggagtgtaatgagttaaataaggcttatttaactgtcaggttaaataaggcttgtattttacctgtcaggttggtggcccagaagattttgacattcccagattattgatcttttggctttgctgtccagtttagatggtttttgctaaagtagctttgaccatcaaagatatagacatgtatacgtgcatttcctatgcttgttttttttatgtagaatgtttatttttctggataaaggaaacattgttggccacccagtaggcaaaatgtttgtggataatgatttgtaatgaatggatttgctatgaaaagatatcttggatgcttgatactataattattaaatgagacttcagggagtttgagcatcatgattctgtttggaaatatttggcccatgggactttgacagttgtctcactgtttacagcatttatagggtagtccgaacactgattaagatgatccataagggcttttaagtgacaaaaaaattgttttagttttttttaattaatttttttttgagatggagtcttgctctgtcacccagactggagtgcagtggcactatctcggctcactgcaacctctgcctcccagatacaagcagttcttctgcctcagcctccccagtagctgggattataggcatccccctccacacccagctaattt

SEQ ID NO: 113184 - DNA, 1847 bp, Homo sapiens
ctcccaaagtgctgggattacaggtgtgagccaccgtgcccagccagaggtgatagattcaaaacatgtgttaggtactcagcagtcctaattttcttacagagactgacagccagaaggagcattgtagtagatgggctactactttacttttgaagaattttgtattaaaatgtaatttgatgcacccactgatgcttttagtggggatgttttgctatagtggaaggaaactcagactgagtgtcaggacccggattctacttggttttgccattacccacccacaggagcatttgaccattctgatcctcagtttccttacctgtaaaatgggggagggaggagctgtagatcttcagcagaagccctgttgcagtttagcgttcctcttctcagacattttcttgggtggaagggacaaatggggagctcttcaataagctgcaacataaatttttgggggacataaatcttccttgtggggaaatctttactatttatcttaaatagtttagtgactgcttaagcagtattctttggggactcttggtttttaactgaaggcagacctgcatgcagggcctttggctgctgtgctcctgggctgggtgctgtgtcttgagcccctgtgcaatgcctggctcagagtaggagctcaacagatgcctgttgactgaataataaacaggtatcgcaggagcttttgttatgtgccatgtgtggaatgcaaggaaggaaaggcccactctctgcccttaaggagtttctaatctgtttgtgaagacaagctgtcagtcattttataggagctatgatatatgattagttgccaaatgaaagtttagagtgagaacaggggatgcaggggtacgagatgccagggaagactccgcaaatgaattttacactttgcttttagaagagctggtgtactgctggcagcaacagcaaaatcttaagggagggctggttttaaaggaagaacaaagatttgtgttgagtttagatgtcctcatgaaaaaaactgcttcccagcaccccagtttcatgtgaggagtttggctgtcagctgtatcttctagtttgagaagtttttgtttctgctaagatctaatgttcctcatgggttcctgagcacaagtgaattttctgcatcaaactagaaatgaacaaaacaacttgtttggtcacctgaacttattaaaattccaagggacatgagttgtttaagatttctttatgtctgttttaagctaagtaattcattctggcaagcagttagtttacaacagagagggagcatgttctggtgggagggagaataaaagagcctttgattcatttgcttctgagttccagcagcaggaccagggctgccttgggctagcgtcttatttcggactttggaagccatcttagcccagctgtgtgagtgccagctcgtgttgggggggagagaataacaccaacggatcacatgaaaccccctctccctgtggatggaggggtttctctcatttcacattcctcgcatcaacatggcgcctaatttccaccaagttagagctccatctgaatttgccatttgaacttggattgaagtcacgatctttctgtgactccttttatctcagtctgccaactaatacagaaaacttatcaagtcacagttctctttattctcccctcttggggtataacacacataaaattagcattctttcttttttatattacccctggcaaaaagtggcccattgtactgtggatttccatatttattaaataactaggctcttccgttgccagtgggatggctataggagcctcaataaattgtagat

SEQ ID NO: 113185 - DNA, 1052 bp, Homo sapiens
ccaaagttatgtaggattatttactttacatgttcttgacagtttcaggtttaaatgtttgaagtgttgagaaaaggtaaaaggaaatattgaactcctaataatgtaaaatatttgggaaggtactttgttcctagtgatgctgttacataaaaccaaagccttctgagtaatctttgctgggtatgtaggtcatttacctccaaagaaaaaggcacacaattaaactggtgctgttgaacggtattatttttctttctattcctttaagcagtcaaatagttgagagtcaaatttataaatgttgactgtttcaaatgggaaaagcaagcgtaatatatttttctagttgattttcatagtgacccacagtatacagagaaaaaggtatatacacaggaatctgtgaaaattatggcttcatttatcattcttcggtgtttgtaataggatattaatttccagaggacagagatggcatttgttctcttgtctcaaatatacagtatggtgccttgcatatactcttgaacagcacaatcaaataattgtagaattttgagcctaaaattgtaaattctcttgtccaatgtttcttaaccttttctaacccactcctctctcatgtattgtttgagtgtcctttggcttttaatccagttttactttctatgatttgcattacaaaaacaatagctatattgaaacttttttctaattacacatatctccttctccaccagtcaagaatccaacccactccttttacagggaatgaaaataagcctaagggaggtgaattgattagtccaaagtcatattacttaaccagttgttctgttggggtccatctctcccctcccagataaaatcctttccgtcagagtgaatgcccacatgaacagggcactgtgaagaatgcaaaagaagaggaccaagtgaacactgttttcacctttgagagctgtgtgctgctaggggacataggttgcacttagttctacaaattacatcatgatcagtgatgtgtgagacattctggtagaagaatc

SEQ ID NO: 113186 - DNA, 1571 bp, Homo sapiens
ttcatcccaattgctgcctttttaatttttattttcaattgtgtttaaaacaaaacaacaacaacaacaacacataacataaacttgaccatcttaatcatttttaagtgcacggcacagtaggttaagtattcagattgttgtgccagcccaatctctcctgcttcaccgttcaatctcagtagcattggaaacaacagaagggtctttatgcaaatacctttcaggaaggcgtgcgcctcacctgtgtttgctccttcacagtagtaggaagttaattatgtgggatttgctcacctgatccacacagctgatcctactgtagtgcacatttggaaatcccacacccctttcttcccctgaggaaaaaattctttcctcatcctagattcagtgctctgtttaatcttgagcatatgagaatgagtcaccatgggtaagagtgtaatctcatttatacctttcttccaaccctcctttaattttttaagtttatgatactggatcctgctttcctacataagggctggtgatttggagactaattttgggagtgcgaggtgttgagattttttttgggaaccagtgctttctgttctgctgaacatgaagctgcatggcctaagttctgaaattcaggctatgtatggaatgtctgtgtggatgaagaaacaagccaatgcctttttttgggtcggggccggggggagactgggagaaagatgaatgaaaatgttaagatagtctgattttgtgggggaaatattcaaattttgagaatttgtgcaaatcaaagacaagcagttagttgctttgtgattttattttacccacaaaagaaatacttgatattgtgctgaagatgttgttgaataggtatattaactcagataaaataactgagttctacttttgattccagttatccctatctatgcaatgtgtaaatgctatttccatttcttcatttgtggaatgaaaaacatttcactggaaaattgtttttaaaaaagtacttgtaaagtacattggaatctttaggatactttgaacatggtgcttaaagaatgtaaatggttaatgcttgctttcatacccatagaggaatatgggagtgggagtcacttgaatatcaaaatgaaactctgtatccatttttaaatacagtatgcatttgagcaaagcccttctccctaactgcttattttaaattggcagttgctcagccaacagtcagtaatctcagttagcaagtgtttggcacgcctgttttaacctgcacaggttcagttcacacaaagaaagggagggttgggttatgtgatgcaaacaccacgttagcctcattaacatattttgaataactgtatttgaatatttgccagctaagctaggccatctgaaggcctgccaaacaaaatgggggtttctgcgaggagtgcagagatttgagcttgtaaactttttactttttcttcttgaggggaaagattttagatgatgctatttagaatactttccataccctctcaaaagaacaaccttttttgtgtgtgttttaattctgcaga

SEQ ID NO: 113187 - DNA, 1001 bp, Homo sapiens
atgtcaatttgttgtatttgacacaataggaatactcatgcagtgttaccagtttcgtgatatgcgttcaacatctctgaaggtggtgaatataaaatctgtttttcaaacaagtacacacatgaaactaaaacaatttattcaagtcctaaaacaacgttagtgaaacttcagttctgccactgtgcccacatttaagctgacagcatgtgtgtgtgagaagaagatacacattactgataatctctttagaatgcattaatattttcaggcccaaatatgagtattcagtaggttcatcagattaaaaaagctaaatgaaatttaaatattgacttgtatgtttcctttaattaattttggtgacttactaattggtatttgtggggatacgtagaattttttgaattggtgtttgtattctccatgttttagttataaagcactatgaagagaaagtgaatgaagaggctgccttcaggtgtagtaaggtttaacttctatcccggttccaacttgtcctgctgtcagcttgctccttagctccctggcttatttacatattgtataatccagactggcttgtcccgtttggtaggttggttataaactgcagagctaagtaaatgtgtgataacattttaaatggtatgagaagttaaacagtacttaaggagtgatgtcgtaaagaaccccagctgtcaggtgccccagggttggcctcctttggggccatttccgttttctctgagtaacaggaaataaatgtgaaactatagtaaattctggtcagatgatgaccccctcatccagatgagatgtagcatgctggatctgatactgaaaatgtttgatactgaaagtagattattaactatttccattaatgagttttgtacacaggcagaacaaatcaacaaaaaacccacggaagcatttttatctgtctttacccaatatgaaaacagtaaaggctagacaagtcctgttctcctcctccc

SEQ ID NO: 113188 - DNA, 1021 bp, Homo sapiens
tgtgcttgatagttctttgttttataattttatctctgattcatacagcagccttgaaaagtagacattattgtccccattttgtaaaggaactgatgctcagagtaacttcccaaaatcacacagtgcatatggcagtgctgaaattcaaacccgcatgtatctgcttcaacacctctcttcctgctatcataccagcattcctcctcatagaaattttgtgaaaaagcacagataacctccttgatttaaactagaaatttttgagagtcctgcattgtttctcttaataatccactacttatcatttatcatgagttgtgagatcctgctaggttcaggagagtgactgggaccagagctacagactcaggagtcataagaccttaagagctcctgggtgctgtgggcattggtgaggtggtcctgggaagaacttgcagagtaagagaagtagtactataggacctaatgaaacatgagctggaggtgggttagaaagagacagagtggtttttatttggtagaaggaaaacctgaataggaacctgttaggggagcccaagagcatagttgaagaaggaaagtgtggttgggagccaggaaccaaaataggataaggtggaaaataagccattggagtggatggccaagcgggaagttatgctcgcctctgtagtttgaaatcaaatttgcagaatctttaccttctctgtgagtatgccatgaggtgcggtgatagaacccctgcactgttttaggttcatatactcagtggacacatgcaattttgtgtttgaatttttagtttcttgttttttaatgctgcctttgctctggtggtccttggggccacacccaggcagtgagcagcctaggtggactaggatgttccccacatcccaccctagagttacatctgttgctttagaggccatcatccctcgagaatgacttaaattcgtgctggccgtggtggctcaggcctgtaatcctagcactttgggaggctgagttgggc

SEQ ID NO: 113189 - DNA, 1051 bp, Homo sapiens
ccgggttcaaataattctcatgcctcagccccccaagtagctgggactacaggtgcccaccaccatgcctggctaattttttgtattttagtagagatggagtttcaccgtgttgcccaggctggtctcaaactcctgacctcagtcagtccatccgcctcagcctcccaaagtgctaggattccaggcgtgagccactgctgctcggccagggtccttaagttcaaatcatggagcagtccacagagcactcttctcaggtgcagagtggaaaggactttgatcgtggactagtatttttagtcacatccacaggcctttgaaagggaaaaaatatattattgataggtcctgttttttgaggaaaaaaaaaaaacaagcattcctaactacctggcaaataatttcttctattctaatgataattaatttatgtggtcaaagatcagagaaagggagccataggcaggacagcagcccagtattggtaccacactcttagggatctcttaatttttgttttcttcataacaattgtcagttttcttacactgtgctgtatttggagtggatgatgctggtggtgattgtctaaaacttagatatttaaacagtttgaaaacttgttggagtaggaattataaaagctttatagttttcattatcttctccattcccactcttccaagttactacaaatatgcctaatttttataaatatatgcaatttaaaatgttttaattgtaatatacaagtagttcttggcagtagattccttcggagatttttcttcatattttatagagttcttcagattttttcctctttgcttataatacttataaagttatatttattttcttttgtctaaactcattcaatgtgcatttttctcacctgctcttttgtttgcttgctgcgatacaaggctgtataaagaaatacttggtgctttctgtgacagcaggccatataaagaaatacgaactcttttttttctttttgagatagaggctggagcactatggcgccatcttgacttactgcaac

SEQ ID NO: 113190 - DNA, 1036 bp, Homo sapiens
attgaatgcttgctgtaggccaggacttgttcttggtgctgggtattcagctgtgaacaagacaaagcttctgccttacatgaaacttacattgtagtaggtagagacagacattaagcaaatacataatatggtctctgtaggtgataactactgagattaacagcagttaaccatggtcacaagagaaaactgtggcttaaattgggtctgaagtcattctgagtcaactgtgtaatgcagtggccaaaaagcctaaattcatcttagactatttgaatcaaatggccatgttagagaggtcatgtttgctttcttattgtcaagctgagcctggtgtatagcatttactttttgaagagatattggcaagtggaaacttgttcaggggtatccccatgatagccttgtaaacagctgaagaaagccatcatatttgcatggagtgttccctaggccaaacctttctggttttgccaacagtttctcaaatggtatgatgtctatactctttaactgtcctggtcttcctccagataattaatttcctcttaaaatgatgctcccagaattcaactcatctttccagatgtggtttcaacttaggtaatgcttattagactatttcttcccttgatctggttatttaattttagtaacgcatctgaggattgaatttcctttaaaaacacacacacacacacacacacacacacacacacatctgtgttacttgactctcagtgttgagctaggctgtaaagccaggtctccagcacttctgttcgtacaatttatgtacataaatatgttacccagcatctctattaaaatgtcatctcatcgctgtctgtgcagtattctacattaagatcctttggaatattgtctttcatctaacttggtgttgtctacataattaacaagcatattctcaaacttcatctaggtgtttaatataattgtttaattaaaaaagaataatagcaccagacctttccttcagattatagcagctcaataattaatcctgttt

SEQ ID NO: 113191 - DNA, 1123 bp, Homo sapiens
attttgtgtcttactaagaaatctcacataaaagtaagaacaccaaattaaatattagctcttgtggttattttaagactcatctcaataaccaagagaatttggttctcacactttgtaccttttgattgtaaacagctttaaacaggtttatgttgtacttcatcaaaaattatagaggatctgcagactgagacgcattgggactgaaattaggcaattcagagtttctcatgcatgtaagctgcttttattttgatccctatcattcttagtctgtcttttcaaatattctactggaaggactgttgtgagttgagggcaaaggagaaaatggcagggtctcgagccaccaggcctcataatacctgctctttgaggtagagtaaaagctaactgatgaatgttttccagaataatatttagatttagtctggtggtttttttttttttcttgttttgtttgctttggtttaagctcaatacagtcacatctgaatttacacaacaaaaatgtttccgaaaagttgtggatgaatccatttttaataagccaagtactataaaaagcatcagaagaacttgttaactgaacttatcctaatgttctgatcacctgtttcttttaatagacatagtggttgcaacaatgctttgattagttcctttttggaagctggcttttgttggggggagggtttttgtttcttgtatcttaaacttgacaccttgattctcattgaaaaaactttcaaccatgtatggttggtgatttgttgaaatttataactgaaaatctgccactctgcttttagtatttgaaatgccttggcagggagacgtttttctcagaacagatcttttggaggacctcaggaagttaattattctggcaagaagttctttttgaacttttttggatcattatgatattatgctaatttatctaaaaaatggattctaagttgaataactgtatagtcctggcagataagagcatgtcagatgtcttggcacagtttggggacagaggggactttcccacttctttatgtaatccaccatcataatgtgggagttttatgaaatttcttctgttatacagaaatacttagctttttag

SEQ ID NO: 113192 - DNA, 3019 bp, Homo sapiens
aataatttgaattattatatattcccatagttctgcctcaaataaaatataactgtttttgaaaattcaaagacttagaaagtaaattagaggattgtttattataaaagaactttggaccctacaaaggaatttaaccacagttttcttttctttgttaatagagtctcactgtgttgcccagattggtcttgaactcctggcctcaagtgatcctctttccttgccctcccaaagtgctgggattacaggcttgagccaccactcccagccaacagaattcttttcaacagtgagttcctctagtgcactgaaaatgtaatatgatttgcagatgtttagtttatgtacaccagaaagaaatagttacgtatatttacagttcatggttctctgcagcagcgctgagtgtatgccagatatgctttccgttaactaattgtagggattttctgtgggttgagagtttttttgctgttgtgttggaattttactgacctatctttcctccctctccatgttcttcccagtagttcaaatagcattcatatgtaaaatgactggttaaaatatgggagatcatctctggctgttggagaagtcacccatttaggggatcaacctgtgactgaggaggcaggacactttctgtagtgggaggaacatgggccacatacaaacagatttagttcaaatgccagtgctacctctcccttgcattaagcaagttactgaaaccttcagaatctagttttcatctgtaatataggaataatgatgataatgcttatatcaccagggaatttgtctttctgaaagggctagcacacagtaggtattcaatgcaagttagcttttgcccttgccttcaaatccagggaacacatggcagcaacaagactgtagccctgggagttgctatgtctgcagcctctttaaggtgttaggcagacaggatgtaagcactagaaagattcagtatggtatcaccggctgtagtggttcagcccttggcctctgtagcccaagagccagtgttcgggtctactaactctgtgctcttgaaatgtctcctacttttaagtcagtttccttatctgtaaactgagactaatggcatttacctaattgggtcgttggagatcaagtaccttaattgatataaagtgcttagaacagtccctgggaggtggtattttgctccagtctgttatagggaggatcattttgttgttagagttcagtgaagaccgttttttaaaatcgtgtggaatgactataggcattataaagacaactgaagaagctcttgtttctgaacagtacttggccagtttctttaacaggagatggctttgcttttagaagcctgccccagagtcttccatctcttccactctccctgcacgtccgctctgtatggcttttgttattaatgtggagcagttgaagtcactgacttgggtgcaggccaggccagcattactgaggtcatatattactttcctagactctagtcatgaacaggatgttggaagtcagaggtacagagaagctgcctttttaggccgctcacatgaaaggtgtgtttgctttcctcaatcatttttatactaatagattggaatcttattcagtatcttggtagcatttttttcttttactctacaacctttatgccgccaggctgtcatttggcttattctttggttagacagactaatgctgttttgttatgcactttcttcattgttatttcattgttgaaacatctcttcctcggttaactaaatatttatttaaggcaggtagaatttctcagtgaagctgtatatttgtttaggtattatagatatattctaaaacatttagggattattcagtctatatatttttttctcttggaaatgaaataatactgtggagaaagtattcattgaaataacaagtgaaagtgtgtttccctcaggaatagtgtaaaaagaacttgcttttattttctgctttgcttttgtatttgggacttggggaaactatgcttttgttattttggaaaagcaatggaattttatcagacattttcctgaaactccctactttctctttttcctgaaatactaccttcaaagtcctgttttgctctgttaggaggttccatcattcaaaaagtgaaagagcttggttagttgaggttattttgttgatctgttggctttaaagaaagaagagactgtcagagaaagtctgagaaacaacacttggaggatcatatgaccaatagtgtgaaactgaggacgctgatttgttagcttgagcagttaagactttttttttttcaatgtctgcaagtaaatacgtggcctcagaccctgttatgctttatgatgggtgagagtgcagagaaagtaacgttctccaggtttaaactttattctgactctgttccctaatcgtgaggatttttatgttttttgtaactgttgttgtgaagtagaaactgatttctagttgactttggctattactaaattgtgacatgcatgcacttctttttaatttaacagttgttttctgctgttttctcagtttgaaagtagtaattatgaataagaattcctagaaatattcttcttccataatgatatgtcacagatgtttgagtgctacacacacactcctctccatttttaagtcaatttagtggagataaaatgtagataatagctgtgtgttgtaatgactctggcccactccccagaggctctgtatttccataagttatgggacccctctgatctttctgaaatggccaccatcagatcattgagacttgacatgcagtttaaaatgtgtgtttctgagatttctatatatgatttggacacagaataacttgtgctgtttccaaaaccacattctttgtcctcttatagaacccaatgaaaggaggaagctgtgccttaaatgtcatgttctttatgcttagttcctttaaaaatgtatacttttatcatttgtt

SEQ ID NO: 113193 - DNA, 1128 bp, Homo sapiens
tgaaataattttgaaacatttctttcctttaaatttgaagtaaggttaaagttttttgcaaccaaatttggggttcatctaccatggtaagttggtgctattggctgtgctataatttcagggtgaacttgactttccttgagtttccaggctgtacaggacaggaaaggctgtggccgtcagggaaatggagccagatggtcctcatgatcgatgccaagctcccaacagagacaaatgctacacccgacagactaggggcaacagcacatgttagggtgattgctcaccctttcctggagaggggagagctcttcccttctgctggtgtattttgcagctagtttttgcaggctctgttcagtctggtgtagcaagtgtccaggcagttaacttctaatgggcagtgaaggaggaggtgatggcagtagctggggccgagttggcagctagtagggctgtctgatgaaatccacattttggcatccttgaagtctttcaaaggaatctgactaagtcacttaaccttgtgtcattttggtttacttggcttttaaagggtagtggtaattaaaccaatgggagccattagttagtagatcttagtggcagttttcagtttaaaaatggaaacctacagtcacagagccattgactcgtaataacacagtggcttgtccttgacccaagggagttgatttggggaaatgaacatatctgagagtcctgtgtcctgagtttatatatcagcatagctacttaggagcagtatcactttgggcatatttcttaacctctctgaatctcctctgtaaaaataatcataattcttcaaaacataagtgagagcttatattttatataagtatgtggcacagttattagttcctcactagatattaattagttcctatgaaaatgatagattagtgccaagtcatctgacctccctgtgtaggcttattattgatcactgggggtctgtagccctggaacagtgttttcttttctgaattaattacagcctcatgtactgagctaaactcgaatatgcaaatctttatgaaaagatgcccaaaatacagtgacttaaacaagttaagaggttgttggtgctttcctcctctc

SEQ ID NO: 113194 - DNA, 1116 bp, Homo sapiens
atcactcacattatactcacagaaggtggtattttcacagcttcatctttccgcagttggtaatcaaatgtaagaagagcttttatttttataggaatgatttagcttatggagtaccaatctcatccttttccttcctctgtctttttaaccaagcatagaatgaggagaccaatgtatataatcaaatacttgcgtatgctggaaaagaatttatgtcattcactcatctccttttaattaaaacctagtgagattggtggcaatgttgggaagcagatggatgagcatgaatttcaaatgtgtatttagaaaaattgaaaggattggtaggaaagatattaagtaggcagtgtggtcgggagttgaacctgtgagttcaacagcaggcgcttgtagcataaaatatagtagtgcttccagacccctctgacctagggatgtctaagagataaggagggaaagtgcaggggtctcttttcttgtggtttatgcattttgaagttattaaagcataagacaatttgttctggaatttttactcaagataaaaactatgaccattgtgtgaacattactgcttcacctccctctcctaactctacttttgtttactattccatatccagtgtctagcagtgtactcatcaaacagtaagtgctcagtacatatttgttgaatgactaaataagtggattctggcacttaattataagagctttttggaagatgaaaagattcttaagcaaaatgattttttaaagatgtaaagacaaaagaagcttatcttccagtccccttcctcacttgactctgccagcccccttcaatacatgcctcactggcacctctcctggatttagctttaaaagtttgggaggagtgaaggtgtgtgtcctcatattactaaaagaagaaccctagtgttgtgtaacagtgtttcacaggctctttcataataaacataatattagacacagccaaagtaagttcattttgaattaataatccagtatttcatagtgctggttcgaggtacagatctaggccttgtgtgcaacagaatagaattttagaagtagagtaaaaagtttcatccactaagctgtttctca

SEQ ID NO: 113195 - DNA, 1086 bp, Homo sapiens
tacagttagataaatttaaccccttctctgacctggcaaggacaaagtacactggcttctgaagaaactttttcttgggagcaaggtagttatttcaaagcacagaaaaaggcggcggggggcacagagaagcacagagaagcgggggcagttgcacaggtaaaacattcatcttggcttttctttttaaaagataaactttgtcccacgtaaagaggaaaactgcatagatattcattgagattatctgatttgtcactgttgccaaagaaaaaacaaaggtaaaatacacgagtttctgcattcagaagaaagtatttcaggtaaaaattaactattaagcaacttttctcagcagaagaaatgcccaaattcttaaggacagccaagttgtgagttagagagctagtgttataacagatatttttaaatacatatatgaattacctccttacgttactttattcttgtgtttttagcaactgttgaaaacaattataagaaatgaaataatgtcctgagctgccacatggtatgttttaaaatctgcgattttattcttgacaagtaacatacactacatgcttttgtgtgcaagtaatgctcagatgtttgataacggagtgatcttaaagaggaggcatctgtttttgtttttataagtagttcattgcctaactaccaaaaatagctgcagttattttaaacagatggtcccaagttaatagggaagaaagtagaagtgagtctatttccccagtttttatttttaccccacaaaaatggtaaaaataattaacagtatataatttgaacaaattctatcagaatgctttcttctaagttattctttctgagagaggggatttgtcaattgaagtatatgatgtggtggagttgaaagccaatataaattgcttaaatttctactttctgatagcgttcatcaaaatgattgctgcattgttgaaatagagcttttgatttttaaaagacaattaaattgtggtaagatacatgaaacctaccaaaacttacttcaaaagttttgaagtcttaagagggtggtaagtggtggtggtgaca

SEQ ID NO: 113196 - DNA, 1955 bp, Homo sapiens
acaaaatgtagacgatggttaaaaaacaggaaaaaaatttaatgaagtgtaattcattctctctttttccttcttttgtactcaggttgtttattctgttgatggatattggactggagtgatgagtgttctaggatgggtatttgatgatgccaggggactcaagtaatggctttgcatgaagattacacagtaaagctgcacattgattacctcatcttattagctgatggagatgtttgagaggacaagattgcagggctttcaagcctgtacagctaccaggatttgatcctaagagcttgatcattgtcattgcccatagggactgtgttaagaatagtggtggtttactacttaaacgcatgagagtgttataacagttccctatgtcttttgaattgtttagataaggttaggactttcagatcaacttgagttttaatttttagcatttatagaattctaaaattaatcctgtttgtttttgtcttcctccactaaaatttaagtttgctgaggtagacagttttgtttctggaaccactatccctccagcggctagaacagtggaacatgttcaataaatattcaataaatatttttgaataagtgaatgaatgaacaggttaaatgtaatctttattttttaatgaactatcctttccagagacatacaaattgccagttgatggcattttttatttctttttgtaaaaagagtattttaaaatttgaatgagttctatctaacagataacacagttgagtacattaaaagggaccttgaacacaaaatccatgttttcgtggattagtatttttgcagcttaaatggtgaacgataggattgttagatgcaaataactctggaaattaaagacctttagttgtaactctccctaaaatgtttgtgagagcttgtaaaatgttgttcactttattctattataaaagggcattataataaatatgaagttttgaaaccatgttcttttaaatgaggtgaattatagaactctgttattagccattatgctgtgccccttcttttaaagcatatccctccacataccctttctaaggacttgggggtaacaaaatgaggagtaagtgaagaaagaagaaggcacagcttgtcgagattgatggaccgccccccgcccccgggagagcagcgtaggaaattgcaggatgaaatttgtgtgccagtcttgtcagcacccattcctgttgaaggagagggcatatggatgaggtggggaggattccagcagaggggacccaggaaaggggagggggtggggacaacaggaagtgtaatgggaggcttggggaaagttgaagatctgataaaggtagttggtgaggtgaagaaaggagaatccactaaaacttgaccctaggagcattctccgccgaatggcatggggtagtgaccctgactctggacaaggagagaagcaaatgtactcctagccctacttgggaccttaaggaaagactcatccatggccatgatagtgtaaatgctgtttattggttttaagctctttaactcaccctttggagtgaaaaacaatagaaagttaagctggttacagaacagactgtaaatgttataaaccttgaaaatgtaaactatagatacagcagatggaaattaggcagtggaagggcatgaggagagatggggggaaaggatgaaaactgattgttccaaggagctagaagatgcactctaagactgattaaaaatagcagctcgatcgggtggcttaatgtcattctggttgagggactggaatatgtggtgccactatattgggataaagcaggaaagtgagatgtcaagacaggacttcagtagatctaaaagaggtaagtcatatataagcatattatttggaaatatggggtttctctttcagtgtcctgataagagactggattca

SEQ ID NO: 113197 - DNA, 1216 bp, Homo sapiens
atttcccacccctccccctccgcagggcctgacaaataccattctgctttctgtctgtatgaatttgactacttgaactacctcatataagtggaatcatacaatatttgtctttttatgactggcttatttcacttagcataatgtccagcttcattcttttgcgtatggatttctagttttcctaacaccatttgttgaaaccatgactttttcatatttagtaaaaactgaatcctccttgatgtattgcctcaatattatatagtaggagatttaatcgaacatactgaatatatatatacattattaagttaattgagttatgagtaaacgttgcttttcagagtggcagattatcctgtggtaaaaacacacacacaaacacacacatattgtgactttctctaaacaatgcatttgtaaaatcagtttgataaatgtgcatcttcttgaaaacattatctcaagttaatactgaatggatatttttgttttgtttctaggcatggaagaggagatggttcgtgttacgcagtggccgtttaactggagatccagatgttttggaatattacaaaaatgatcatgccaagaagcctattcgtattattgatttaaatttatgtcaacaagtagatgctggattgacatttaacaaaaaagagtttgaaaacagctacatttttgatatcaacactattgaccggattttctacttggtagcagacagcgaggaggagatgaataagtgggttcgttgtatttgtgacatctgtgggtttaatccaacagaagaaggtaagttcaagatattactattcaacttgaattcttcttttctgctacatttccagaaatgtcatacaattctttgttattttagttacacaatataatgttttatttttataataggaacttgacatttggaaaaagcactgaatcctttaattagtttggggagaagctgtttaccagttttagagcgacagacttagacatattggggcagtttttaaatatcctgaagtaaaaggtgacaagaagacattttaagaacatttattgaattccaatataaatattcagtttaaccatataacactgttgatattttactatttttcacctattaaaaaatagcacatttggccgggcgcggtggctcatgcctgcaatcccagcactctgggaggccgaggcgggtggatca

SEQ ID NO: 113198 - DNA, 1028 bp, Homo sapiens
aaatatccaaaataattcattgtaataattgatgagtgcaagtttatatatacatatgtatatataaattatgcattaaaatatatatacagtgcatatatatatgtgtaaaagtataattctatggaagtttatgaatatagttcttgtgctcatagagcttacagtcagtctagtaggagggacaaataatccaggaattatactactgattcataagcgctctgctaaagaagaactagataagcatagttagcagcagcagtgatcttttcagtgcagaactcccaattccttacaaaatagatgagaggtatatttaggttgagtgtaactcttgacttgtgaacttttcatctttacaatatccatggttgggaaagggttgtaagaaaattcacagtatgattaatcagatttcttatatatagtctgtgagttggctaccaagtacagctgtgttaatcacaagtcatttttatgtgttcattaatagataaaacaagtatctaaggactttaatctgccaatacgttctacattgaggtcatgagctatatctaaatgcaactgcatttattttttaaattctatgattgagatttttcacaacttcatcctggttatttccccaaatagccacatttagaagtgtcttaatatactgtgttgaagtatttgttgagtttcttggaataaatctgtaaagcatgaacagttcttcattatgtagtattaagcagccaaaatcatactttattctgtaattttggtttttgatccataatggcgaaactgcaaaaagactctcaaagtttttcagccatttaagttctaaatagcagaatactgctattatcctttgtaatcatattcatacagtttaatatgacaaggtaaacatcaaaatgcctttgttcttccactgacttgactacctgttttatattctcttgtgtccaaatagatgtcaccaccaatcactaaataatagttgtttttgtttttatctagatctgtcccaagcc

SEQ ID NO: 113199 - DNA, 1049 bp, Homo sapiens
ttaaagtatctttctcttctgctaaggttgtagaacagcttccttctcatagcctcaaaactgaagactgttcaagcaaaggttagccatggcttttttagaggatctggaatatatatagagtcctactctttagatctctttgacaagaataaaaaaatacttcctgtataaaggtcgccatttagatagtgtttgttttagctgacattgtcatgatttattctgtttttgtgtgttgaaacaatttgtctccaaagtagctttgtttttccaaaaattgtttaactgtgatagacgtgatagttaaactttggtgttgcagatcctgtgaagccacctggcagctctttacaagcaccagctgatttacctttagctataaatacagcaccaccatccacccaggcagattcatcctctgctactctacctcctccatatcagctaatcaatgttccaccacacctggaaactcttggcattcaggaggatcctcaagactacctgttgctcatcaactgtcaaagcaagaagcccgaacccaccaggtaaattatatatgcccatgtgagagagagacagaggcgtgtgtatgtgtgtacacactgagattcttacctttaaactttttaaatttcgatttgcaggcttgaaagagaccatctgtataggcatatgtttcaggctttatatttcaggtttacattcccctattgatttccgatattcaggagattgtatcgaagagacacaatctctgccatctttggcaaagagcagttttccctacaaggctcttttggaaatctgtctcctattttgtagtctttgttacagactcacagtattacttgcttaacagatttcactgatttataaatggtgatcttgctccatttcttatgtgattgtaaaccagccaagggtcatcttttgtttctgaagaaggagaggaataccttctactagaagattttgaaagcaaaacgattccattgcagtgagtgtgttgtggtggttttggatctgtgtgagaaattaatcat

SEQ ID NO: 113200 - DNA, 1095 bp, Homo sapiens
tttaccaaaggtgtctccatcaagtactgaagcagatggagaactctatgtttttaataccccatctgggacatcgagtgtagagactcaaatgaggcatgtatctattagttatgacattcctccaacacctggtaatacttatcagattccacgaacatttccagaaggaaccttgggacagacatcaaagctagacactattccagatattcctccacctcggccaccgaaaccacatccagctcatgaccgatctcctgtggaaacgtgtagtatcccacgcaccgcctcagacactgacagtagttactgtatccctacagcagggatgtcgccttcacgtagtaataccatttccactgtggatttaaacaaattgcgaaaaggtcagctctagttgacttcttctctattagaggttaatgatagaaaatcgatttttctgaatatttgttcttttaagcgtagttaaatatactatgctacaaaatacagtccatttttttccagctctacagctacctggaagggtatattgcattcatgctctgctggaagggaaaaagagttggagtttctcacccctgaagaagtatggccttagtaatgccttcctgcctcaggaagtgtgcccttctctctcccactttctataatcctgggtggataggccctctgttgggacagaagggcaggaaatggaccagccacaaagcctctccgagtcataccctttcctgtatttgtgtgccattatggccgcttctaagtcacatctgttgggctctatttccttccttcctatataagcagtttttatgttgtgtctaacaggtgatattctgttccagtcaagccattatgctgtttgatttttacttgtgtttaaagagctgaatcttctttccccttatcactacccacttcactcattgctagtgagtatactttcctatactgtctcctagagtctgtatccaaaagttacagaccttgagaggagaagaaaaaaatgagtctgggtgattctctgagattctcaaagtcctacaaatagaaagctaaagtttttaatgcacatatcctaaacag

SEQ ID NO: 113201 - DNA, 1451 bp, Homo sapiens
ttttgtggtagagttttcctcagctatctccaagattttaatgtatctgtgattattacttaaatcagtacttatttcaccattcaataacagtatctaactcctttcttgaagtgactgtataacctggttatcagttagtgagatgtaagttatgcccaaggtggtgcaaacgatgagaaaatagaggtgtttctcttcatctttagataacctatcttatcccagacttagacattcactcacactcaaaattagatattggtattggttagcatatgagtgagtgtctgcattttctagtggtttaatatgccaattcaagacacagttctatgagcatcctttttaaaattctgtgtgtgtgcatgtgtgtatgcatatgtataatgagagaaagataataggtcatcccaatgaccctgagagctggcaaagatgggaataaatgttgatagtttgttctttattttagatgctagttctcaagactgctatgatattccacgagcatttccaagtgatagatctagttcacttgaaggcttccataaccactttgtaagtataattgaccttggcatcatcaagtgtatttcattgtctaaatcttcataattagtgccatgagactaagtgatatcatgaaataaaagtacgctgagatccatatgaatgagtgtgacttacaattgtgttttcatgtgtgacaagagtttttgtttattaaaagaaatatatatgtgttttagaaagtcaaaaatgtgttgacagtgggaagtgtttcaagtgaagaactggatgaaaattacgtcccaatgaatcccaattcaccaccacgacaacattccagcagttttacagaaccaattcaggaagcaaattatgtgccaatgactccaggaacatttgatttttcctcatttggaatgcaagttcctcctcctgctcatatgggcttcaggtccagcccaaaaacccctcccagaaggccagttcctgttgcagactgtgaaccaccccccgtggataggaacctcaagccagacagaaaaggtaaggagagcatggcaaagtaaaaggcttggggagtgccaagttagatctatctttaactgccattaaatccaaaatagaatttggactagaaattctgaaatatttcatagttccatagccatcaagttatttaagcaaagcagtactgccatttataaattaacaattatgatatcacatgttgatgtgaggtgatatttataagtctcctatctctagagcagaggttacaagctgaaatactcacggggtgagcggacaactggggagaattagaagaaactggactgccgtagccccatctaatgggagtaactaacctacactgctacaatcctttgttgacttgtgaaatgatgcacccatgcaggcaaatcttctggtatatcagg

SEQ ID NO: 113202 - DNA, 1070 bp, Homo sapiens
aagaagtctgtaaaagaaactgttcagccaaattgggtaatgcctacccaggttttttaaattggggtttaagttgttaaaacacagacaatttgatttgttgcaccatgctgttagtgtggcttaatcttgacaaccaagtaaattagcataaatgtaaatgtgatgaatgatacaatatctggcttacattagggtgtttcagcacatttgaaaagtctcatgtgctatatgtagctttttaagaccacataatgttggcatcaatttctccttaacctgggcttagatcattaatattagttctaattaagtcctagttgtgaggaaaagagactgaggctcagactatcttaagaaaaaagatttggttttgtttgtaagtaaggataacctcctcgtttcaacaggaggttaacctccttcaacaaggaggttatcaggaactgaagcaattctaggggactgttgctgtgtcctgctctctctgtgcatttctgttttatgggaaatctttgcatctggtttgttctctttcacattcttcccttcttttctgttttcttttctgattcttttttgttttcttactctgtatcctctacttaaatggattctgctttccaagagctttggcctccaatgctccccttctatggcctcagttctgcctcctagctgctttttatgtgcccttgcagcttctgcatcagcttctcattgccttacttattatttactcactttagattgcttagagatgatgtgattggtctatgtgtgtcacacccacgacgacccagtctgccctggcagcagggctgtgattgcggtgtggatctcagaaaggatgtgagcatcagaggctttctatcggataatgcttccttttgtttcctttttctttgtctctaaatctattttagacaactactagtcattttctttgcatataatatgcaaaaatatgtttggacatgtatagctttataattggttcatacagatcactgaaggattgagatataagtgtcatgaactctttgaaatattgaaatatcttttttaat

SEQ ID NO: 113203 - DNA, 1080 bp, Homo sapiens
tagggaattgagaggaatttatgaagttacaaacctatgttgaacatatgttcatgtttcgtgtgtgtgtgtgtgtatatagtttttaaaaaaatagaaattcttaagtcttccattttatatctgtaactttctacttatcaccaagtcactggcagtggtttttttgttttacacaaaatattttgctgtccaaaatacacttttataatacaattataaatattagttatgtgtttgtacacaaaaattacatcattataaatgtgtacaatgaatgattataaacataagggaatatttctgaaagaatgcagactgtctctcatttttatttggggaataattttagatatttttgtcaaggcttatgtttgtgatgataatttctgtaattagctcttccaggtttcccatgtccccccgaccagattcagtgcatagcacaacttcaagcagtgactcacacgacagtgaagagaattatgttcccatgaacccaaacctgtccagtgaagacccagtatgtaaagttttaacttttccctttctgagcagcccttttcagtcattcaagctagaactgttctgtctataaattttatcctcgtatctttatatacttaagaaaaagcagtaaaagacaacttttaaaaagcttattaaaaataatgtcataaactctaaaaccaataaaaggtgaaagtaaactgtaaatgagttaaaaaaaaaaagttgcctggcacagcagcacaaccctgtagtttcagctatttgggaggctgaggtgggaggatcacttgagtccttgagtccagcagtttgaggctagcctgcacaacatgtcaccctgtctctaattagaaaaaaattaagttttcagttatatgtcatttaagagatacttgattttttatactcttcaagaaaatatacgggcagcattttatgatgcaattctctaaggccatgtcacagcactctaatggtgaaatggtcttataagtaagtaatatacctttagataggtgtaaagattaaagaagacctcttataaacataacatgtttgaggttggct

SEQ ID NO: 113204 - DNA, 1532 bp, Homo sapiens
attctctttctgtcacctaggctggaatgcagtagcgcgatctcaactcactgcagcctccacctcctgggtttcaaatgattctcctgactcagcctctcgagtagctgggattacaggtttgcgccaccacacacgactaatttttgtgtttttggtagagacagggtttcatcatgttgcgcaggatggtctcaaactcccgacctcaaatgatctgcctgccttggcttcccagagtgctgggattacaggcgtgagccactgcacctggcctgtgatgaatttatgaagtacttaggtcctatgtattagaaaaaagcaaaaatgacccaggaggacatacctatctaccaagtacaatagaaaagtcaacaatgccaattccatatcctcatgctgccaaatacaaggactcatcatagtccattcaactctcccttagaaaagaatatgagaattatagcaatatttaacaaacttctttaattttggatcaaaaatcatgcattatcaagtgaattctgaatgtgacacctgaaattcaaatgatggtaaaccataactaaaggcatacatactgttatgtgataataacaacaaaaatatgttaaatgattttacataatttttaaagaattttttaaaaatctaggccgggcatagtggctcacacctgtaatcccagcactttaaggaggccgaggcaggcagatcacctgaggtcagtagtgcgagaccagcctggccaacatggataaaccccgtctctattaaaaatacaaaaattagccgggcgtggtggcaggcgcctgtaatcccagttactcgggaggctgaggcaggagaattgcttgagcccaggagacagagattgcagtgagccgagatcaagccactgccctgcagcccaggcaacaaagcaagactccatctcaaaaaaaaaaaaaaaaaaaatctcacactactggtttgttatttaattcaaagaacacttataataccttatagaatcttagagtttctctaaactgttttgggaaaatactgggtgaaaggctagaatacagacaggctgttccagtggagattaaatcaagagcaaatagacttccttgtagacacacaaatgttaaccatacttaaagatggaaaaacattcagttctagtaataacagacataaaataggttaactagccaccctgagaaattctgtttaggagcaacttattggtattatgcatgcaggtcttacaaatttatgcatttcttttatagccttgtaatactgtgaacaattctagatatttctaatcagagaaatggagggtatgggtctttcattgatcacatttgaatatagaacttttcacacactcatggctgattttatgtgacaatgatatatagagtcattcagataaaaaatttcatgatgattccagtttctccatgaattagaaagaagagagggattgctatttatattgaggaccaaaacttgcttatattttttgtgctctacatgtt

SEQ ID NO: 113205 - DNA, 2214 bp, Homo sapiens
agtggctcaggcagcagtgtagcagatgagagagtggattatgttgttgttgaccaacagaagaccttggctctaaagagtacccgggaagcctggacagatgggagacagtccacagaatcagaaacgccagcgaagagtgtgaaatgaaaatattgccttgccatttctgaacaaaagaaaactgaattgtaaagataaatcccttttgaagaatgacttgacacttccactctaggtagatcctcaaatgagtagagttgaagtcaaaggacctttctgacataatcaagcaatttagacttaagtggtgctttgtggtatctgaacaattcataacatgtaaataatgtgggaaaatagtattgtttagctcccagagaaacatttgttccacagttaacacactcgtagtattactgtatttatgcactttttcatctaaaacattgttctgggttttcccaatgtaccttaccataattcctttgggagttcttgttttttgtcacactactttatataacaatactaagtcaactaagctacttttagatttggaaattgctgtttacagtctaacaacattaaaatgagaggtagattcacaagttagctttctacctgaagcttcaggtgataaccattagcttatacttggactcatcatttgttgccttccaaaatgctgaggataatgtatgtactggtgtcaggacctagttctctggttaatgtacatttagtttttaatggtggaactttgttatattttgttaattacagtgtttttggttcattgagtgaagattctgccgggtgggatcttgcacctttgaaagactgaataattacactaccaagtaagcctgcaaatcattgatggcatgcagtgatgatgtgctcttacacttgttaacatgtattaagtgttatttgcaaaaggtagattatgtaaccaatcaggtacgtaccaggcagtgatgtgctaatacactgatcaggtttagacaatgagctttggttgtgttcttgttagtcctaatattggttttcagtttggaattaataaagcagttgacattcactgttagttacagcaacatactgtgatttttaattagatagtaattcagatttattactctatgaaattctgtcttttgacaccatagtgccctttctatgattttttttacttaatattcttcttggccttatatttaattccctatgcaattaatattttatatctgcatttttttaaaaaaaatagatgttatataagtgattctcgtatgtagcacctgttgcttttccactgaaagaattacggattttgtactgtgatttatattcactgccccaattcaagaaatattggagccttgctacaatgtgaaatgttatagtcatggactccttccaaccagatttctgaaaacaccagagggatggtataattctgtctcacctataacatggtcctgtgacatagatattaagaccacaagttgtagtgaggctacaattatattcgtctgtcttggctttgcaacataatttagaaagcacgtatagttgttttttaaccaagttacatacaatctcatgtactgatttgagacttataacaatttttggagggggcatagagaaaggagtgcccacagttgaggcatgaccccctccattcagacctctaactgttgcctgagtacacagatgtgccctgatttctggcccattggccatagtactgtgcctaatcaatgtaataggtttattttcccaatcctcaaactaaaaatgttcataacaagatgaattgtagactagtaacatttgatgcttttaaatatttgcttctttttaaacaaaaactaaaacccagaagtgaatttttaggtggatttttaaataaaaaagattgattgagtttggtgtgcaagctgttttataatgaaacaacaaaatgaaatctaaaatcctgaaatgtgcctaaactatcaaaacacacgatacagctaatgtgtaaagatgctaaattctgttacttggaggatgaatatatttaagatttaaaacacaataataaatacatgattaattcaaaaataaaaatctttacagctgcctatcaagggtctaaagcacttaatgaatgtttttagtctaacttatcattaactttttacaagtcaccatatttga

SEQ ID NO: 113206 - DNA, 3872 bp, Homo sapiens
aaatatttctttaaataccatcacaatcatgatgcagagtagttccatcatccccaaagtttgctcctgctcctttctaatcagttcttgctcccacctccttgccacttctgatctgctttctatcactagttagcatttcatttaagtggaatcatacagcatgtagtcttttgtgtttggcttctttcactttgcatagtgcttttgaaactcatccatgttgcatttatctgtagttctctttttttttttgctgagttcattgtatggaggcatgctgaaactttgatttctgaagttttaattgatactctgataaaatgtatcttaaatttttttttttcagcaaactgaccgggcaaatagattcgagtatttattaaagcagacagaactttttgcacatttcattcaacctgctgctcagaagactccaacttcacctttgaagatgaaaccagggcgcccacgaataaaaaaagatgagaagcagaacttactatccgttggcgagtgagtaatagtttaaacttcatagttcaaccaaacttattttcgatagtcttcagtggaagcataaaatcactatgataaataacttaaaattattttagtgccattatttatttggccctgtttggcttggcatgatttagccataaatgtataagtatataaaaatacgcataatggttagagcacagtggctcttgcctgtaatcgcagcattttgggacgccaaggtgggaggattgcttgagtccgggagtatgagagcagcctgggcaacgtagggagatcccatctctacaaaaaaaaaaaaaaaaaaaaaaaagaataaaactgcataacgccttattttttgtagcattatatagtttatgaattgtaacaatcatgttgagtatggaatttagatgtcacgtcattcctcagagaggaaacaaatgcagaggttaagtggcttgtttaacatcacattgaagaatgatccagacttgaatttgaatctgacttgggtgtgctctaggctcctccatcacatacagatgttgacagtattttatctaaagtgtggtgtgtgggatattgtgatgacttacatcacggcagcctgtttaaaatttttattgcatacttagttgtttttatataaattgaagtgtcacgttgtatgccgtcctttggtggtggttgaaaataattcttacatgttgaatttggaaattctctagaattttcattctggttggataaataagatgtttaattagtaatagtagatttagggcagtcttggctccctgaaatggctttgtgtaattcccaaagtgaaaactgtgattagtaattaaaatacaaaagattgtttaaaagaagaagtatcaacaaggttaaattcactacacagtttgttgaaagagggaagtatgatcttcatcttgaaggggttatcgttgtaagcataataccttttatttggggtattccactcattcattatatcttatttctcatccattgtgaccaaagcactattttaatacttacgaaactttgaagggacaattttgcccttcagctgtatttaaaatatttcagacttcagaagtttgcattagtgtcatggcatgaaactggaaactactgtactgaatattgttatgggatagtcagtatgatgtctcgaaaagaaacacttcttttattcttttctattttattattatcctaatttatcttttttataagataaaaaagattctattggaaatagtaataataaattgttaggcttaatgtattaaatagtgttattagggaaaaaagtcctagttaacagatttctttactcctcaaaccatcttaaatgggaagctaatttacctaaagtaatgagggtcatagtattgtctttgggtatcaggaatacatttttttaaatctttttttgtttgtttgtttttattgagacagagtcttgctctgtggcccaggctggagtgcgtgcagtggtgtgatctcggttcactgcaagttgtgcctctggggttcaagcgattcttggacctcagctgggattacaggctcacgccaccacgcccagctcatttttgtatttttggtagagatggggtttcaccatgttggccaggctagtctcgaacttctgacctcaagtgatccacccacctctgcctcctaaagtgttgggattacaggcgtgagccactgtgcctggccaggaatacgttttttttttaagtcattcacgattatattcaatttttaacaataaatgacatctcagcttttaagttttacaactgtaataatcaaacattttgagagtaactataaaggatattttataaaaagaatttaaaattatctcccagtttatggagaataaataggggatggaagtagatctttgtactcaatttcataggctcagaatgcagagaagtacaaggaataacagactaggatgtactgattatgattagaagcatatataacaaacaagaaggcccttgaatttctgaggaatgcttctatcttggaaggccgcttatccttttagcaagcatgtggttttggtagaaatgaagttacaaattagattcagcggtctcaacagaggcataacgtgcctttttctaaataagatgaaaatatttgttgaaagtgtcagaattggggagtaagtattaatagttttactgaaccaagccctttagagattaattggcagtattaaaactttagaaaatcagtttttaagggggtagtatatctgattctcttaggatgtagaatttagatgtgtatttaaaaatttttttgatgaatccgtggtcactgcttaaatttctgagtccttatgctgcagcttttgctcgaagttacaattttaaacatgtggtttctggaacttttttttccttggcaaaaagatttttaaaaaggtacactttaaaattcaaataatgagattttctgactacatagttcttgaaatttgactatcatatttgagtttattgggttctggttaatgtatcgtactggtgtattttaataactaatgtatattttaaataattatttaaaacattgcagatttaaatgtactcatattttctactgtccactggttgatgcctgttaaaaatttaattttgtggaatcttggtcagccacttgactatgatgtttaaacagtagctgataattaaagccaaaactcaaatcaggttattttattttcatcttaacagttaccgacaccgtagaacagagcaagaggaggatgaagagctattaacagaaagctccaaagcaaccaatgtttgcactcgatttgaagactctccatcgtgtatgttaaacacacttgatttttttaaaaaattgccctttgagatctcctttggttaatgttttggatttgtgttggctactatttgtgaagcaaatttttagtagtcttagatgtttattggttatgaaataaacttcagattttgatggagatgagagcatattacaggatagtagtgctgtatttcaaagttatataaaatgtcattgtgtttgttattgccctgaagtatatgtaaatctaaggatcgttttgctttatatttgtcccacataagaaaactaatttattttaaaaaaggtacttcatgaacacatttgcttacttctgatgtttttatattaatttaattttttgtgaaatgtatttgtttattggttagctttttatcctcaagtgtttttcaaaaggagatggagggctacactgtgtacatattaaaaaagaaaaatcaggtgaccgttatgtatatttggtaatt

SEQ ID NO: 113207 - DNA, 1056 bp, Homo sapiens
gtaggcttagatgaagagattgccttgtatttcttgtcttaaaatgcctattgtgcttttcttttgttcttagatgtaaaatggggtaaactgagagattatcaggtccgaggattaaactggctcatttctttgtatgagaatggcatcaatggtatccttgcagatgaaatggtatgtgttggtagttttttttgaagggtatgttttgtattgaaaatatcttatacgttgataaaagtttcttacagtctacaactgttagcaaatggatcctctcagaaactagtataagcagcttgccttagttgcataagtgtgatctgtattttaattgtgagaaatttccatcgctgaaaatatgataaatttaaaaagaatacatttgagaaacatgtttttggatgacttttatagtacaatgatttatttgcttccagttttgtaaaacaaaagtgaggtcattaattgtttataattgataaatgttttttccaggtggtagcttgtacaattcttagaaaacatttatcttttgttaactactagttatgtaatgaatgtttaaaaaagtttccttattgctataatgctaaaacgtttaattggttggagaaagtatgaagtcaaaagaaatgtgtttcaatgctagctctgctagatgactttgggaatgtcacttaaacggggccttatgcgggtgataataatacctcctttagagacttgtgaaaattatatgacataacacttacaaactttgatatatgttaagtttttgccatttattaactgttataaatatgtagcatttcttttgaacatttctatatgttgggaggtataattgtgaaataatattttcatttttcactgcttcatggttattttgaaatctttcagggcctaggaaagactcttcaaacaatttctcttcttgggtacatgaaacattatagaaacattcctgggcctcatatggttttggttcctaagtctacattacacaactggatgagtgaattcaagagatgggtaccaacacttagatctgtt

SEQ ID NO: 113208 - DNA, 2547 bp, Homo sapiens
atgtagcattgtcttggtggataaaaaacagcactttgggaggccgaggcgggtggatcatgaggtcaggagatcgagaccatcctggctaacacagtgaaaccccgtttctactaaaaactcaaaaaattagctgggtgtggtggcacgcatggcctgtagtcccagctacttggtaggctgaggcaggagaatcgctggaatctgggaggtggaggttgcagtgagccgagatggcgccactgcactccagcctgggcaacaaagcaagaccatcttaaaaaaaaaaaatcatactgggaagaagacattagaaatggtagaaagctgtaagactgtagtttgtttctctcccttttgggagtggttgtataaaatcattggttgtgctctcattagaagttattttcttgtttttaaaagatattttgaaatgtgagttggttggaaatttaaggagccacatttttagatgaatgtgtgtagtggtaatagtcacagaattagagtttttaaagacgggttgagtcatatatagtaatttggtgatttattatgatatttaacaaaataagttaaaatttcgatcagttgacaacatccttgtgggaagaagagatggaaataatgacattagtatataaagctcagatttggaaatttattcagactctactgaatagctgtgtacttgttttttatttcctcttcatttacctgtgagtgataagtctatatttttctctccctttctagttatgttggatattttaagttatcaatttttgtttgtttgtttgggagcccaaagagtggtaattacttaaccagtctttgcttcagtttccttacctttaaaataatactattaggaatgtgttaatacatttataaacctgaaaggaatgcagatgcctactactgctaactatctttccaccctcttcctttctttatgttaaaacctccctcttttttgtctaaacctgcctcctaagaatttcccgatctagtggaattgcagaaagacattttaagtgtctattgaatttttcactggttaactttgtcagttttttaaaacttaatggttctgacatttaaatgattaatgacgttactttagtcttaggaaagctggttctaaacgtttgcataatatagctagctactctactcctttttagtattcccacctctttttatatactagattacttgtcatcagtaaatgtaatgcgtagtttatttctacgtgatgtaatttttttctcttgttacacaggctgcttttgtcagagacgttttattaccgggagaatgggatgtatgtgtaacatcttatgaaatgcttattaaagagaagtctgtgttcaaaaaatttaattggagatacttagtaatagatgaagctcacaggatcaaaaatgaaaaatctaaggtaatttgatacttagatgtgaaaagccttcatgtaagaatttgattaaagtacagatttttttttcttttaactttaagttatgagatacatgtgcagaacgtgcaggtttgttaacataggtatgcatgtgccatggtggtttgctgcaccccatcatctaggttttaagccccgcatgcattaggtatttgtcctaatgctctccctctgctttctccccactccccgacaggtcctggcatgtggtgttcccctccctgtgtccatgtgttctcattgttcaactcccacttatgagtgagaacatgtagtgtttggttttctgttcctgtgttagtttactgagaatgatggcttccagcttcatccatgtccttgcagaggatataaactcattctcttttatggctgcgtactattcgctgatgtatatgtgccatattttctttaaccggtctatcattgttgggcatttgtgttggttccaggtctttgctgttgtagataatgcaatatgcagaatattctaatggtgtatttggttcttttctttcagttgtcagaaatagtgagggaattcaagactacaaatagactattattaactggaacacctcttcagaacaacttgcatgagctgtggtcacttcttaactttctgttgccagatgtgtttaattcagcagatgtaagtatttcctggtgctttctggttaataataatattttgcttaatgctatatatttttgtaataaaagtggcctgccttttagcatggcttgaggttattattaattttttatgcttttatttacatagttagcctggtgttatctcctaggttgtctctgtataatgggaatttacttttgtgcctttggtttcaatcttatttcattattattattattattttattttttttgagacgtagtctcactctgtcacctatgctgaagtgcagtggtgtgatcttggctcactgcagcctccacctccggaattcaggtgattcttgtgcctcagccttccgaatagctgagatcacaggtgtgtgccaccatgcccggctagtttctgtgttttttgtagagatgaggtt

SEQ ID NO: 113209 - DNA, 1089 bp, Homo sapiens
cctggaccagtgtttatttttgaagctttgtttgcatagctggcgtcttatgtgtattggagggatttgaagagctccatgttagtatatttttgtacaattaagttataaaaaggtattaattaattttgttttttttctgttgaagattgttttgaaagaatagattgtgttgtaaaaagatatttaatcagactccaaaagcaattttagcttcgattttatgtattttgatgtttttgagataattcctgtttctcactacattgacactttcatttactttaaagcagtgaattctaagattatgtttactcaaaaacaaagcacatatataatacatatgttcaagagatgaggttagggaaactgcccttgttgaaatcgtaaccaaatattaatgaaatgctggtaatttcaatttcatttagtaagtttgattaaaattgacattgttcgtaaacttgtatttgagtagtgcgaatggtctcagagaacaaactataaaatgttttaattttcaagcttttatgaaacttgaaagatactttacaagaatattaattttctaatcctatagaacttgctctccaactttttactgtgaaacttgttattttgatgtttttgagaagaatgtttagaaggtagtgtgatttctgaactacttgttttaaaattagtaacaatgacacatgaaaaccaggattggactaagtgatttttttttgtgggttacaattcaaattactaattctagaaatcatttctatatctggtattatagggtatttgttaatattatctctgatctgagtatattttttgtttgtttatctaggactttgattcctggtttgatacaaacaactgccttggggatcaaaaactagttgagaggcttcatatggtaagtattttggagtagtgttaaagcatatttatgatgggaaaaaggataaaggtttaaattagtagattattttcctgttaataaaaaacacaatggcttaagaatcagatctgcttgaattctgacacttaactcttacatcttacaatcagtgtagggggtgatgtgtggttgtt

SEQ ID NO: 113210 - DNA, 1089 bp, Homo sapiens
cactgaaccagccaggctgaggctggcctaggtgcccttctgtgtattccatctttaacaatctgagcatcctaatattataggactttgcagaggatattgagatgattcacaagtgttttccatactggattgtaagcacaaaggcaggaagcacagatttatttgtctttgtatacctggcacaatgcctagttagagtggatatttgaacagggaaaaaaatttaagttcatgattgttcaaatatttcattataaagtactttaaaattcttaaatattgagagttttgttaaatatttgaaggtagtaatttcctagctacctttgtttcaattcagatggcattcatgcatctaagcactctctttgtatttacttagaccaaggattgtggagtgtatatgtaatcttgggggtagaaaaggaggcagaagaacatgattttttttcatgcatttttttccccttattcctctgctcttggctttcctttagtaaatacgtaggtacatctaggtaaagcaaatgaacaacccattcagcagtatcaaccagatttggtaactctgttttgttcacagggtattttgaaaatgcttatgaagtcagggagaagaggtcttgtagctacctctctactttctcctgctctttactttgaagtttctacagtagcacctgtggtcttataatgaaaggagggtttagaagtcggtatggatgcgcttaggaatgagataactcttatttgatgtattagttatctaatgctgcaaaagaaccccttattccctccaccccccaaaaacaccttaacccccctttaggggttactaagacccccttatttcccccacctccaaaacacttcatagtttatattttattaacaaccccagaatttatgggttgactggatggtttctttgtggattacacttggggttatccagttacatttatttagctggacaatgctagaagagaaccggtggggctaaaggtcttcacttacacatctggcagttgctgccgcctgttgactagggctgaactagcttttctacgtggtgatgttagagag

SEQ ID NO: 113211 - DNA, 1187 bp, Homo sapiens
cagacatacctccctcccccatgtatttatacgtatgtttaagtcacgttgtattcatattattctcatcatcatgccttaccatttcattattcttcctgtcttctcagatgttagggttcttacctaaatgctacactagctatggggtatatagtaatcgaatagtggcactttctgttgcaaaaaaactgcaaactaaaattatgtttaaaacttacattttttaagttttgctttattacttaaaaatattatgtcttactgctgtaattctacccaagggaactgtttttgtactttaaaaataatatcctcaaggcccaaggcgtaagtatgaacattataatgctatggacagtaaagaaaaatggaagcaaaaagaggttacagatgttaaattcctaaccatacctagaagttgatgagtagtttcttacagatatttgggggttcatgtggggaaggggattaagtatgtaaagtggcagggattgatcaaggaacatttgagctctaaaaatgtttttcttctttgaataggtatactcggatattaatgaaggatatagatatactcaactcagcaggcaagatggacaaaatgaggttattgaacatcctaatgcagttgagaaaatgttgtaatcatccatatctctttgatggagcagaacctggtccaccttatacaacagatatgcatctagtaaccaacagtggcaaaatggtggttttagacaagctgctccctaagttaaaagaacaaggtatcggttacccgtatcaaattatcaaaactgttttaaaatgctcatgttaaaacaaaggagcactgtactttgaaatgactgctctgatgctttccaaggttgacgtgtagaacattaaaaaaacctgttcattatctgagctctaacccccactcctgattttaggccttaagtctcttagaaggtaagcaatagttagagcaaccatactcccttgattttgggaagagttcatactttatatatactttcctagaaattatagctttctgtcataaaatgtgaagaatgcatctccctcccacacatggttaccagatccattgttagacagtggtggtgtgttcatgatattgttttttaattatttatgtggagttttaatttaataaggtaccatgtacatggacctga

SEQ ID NO: 113212 - DNA, 1259 bp, Homo sapiens
agaatggatcttcagaaccaggctgagaccaggattattaggtgtgtgttggaggtttggggagtcatatgcattgaagagttgttgtgaagtagtggaaagttatttttaaatgtatatggggtaacaagataatgattatcttaccctttgggatggcaaagccttccagaccagaggcaaatatgcttttctgtacaaatgttacccttttttatttgtgccatggtgagaaaaaagtgggaaatgactgacttggataataatgtgtagatttttttcccccttgtaaccaagtaggtagctttggaattaaggataattgattagtcttagttttggttacccttaaatttttctacttttgaagccactgataatagattgttatattccccaacaggttcacgagtactaatcttcagtcaaatgacaagggtattggacattttggaagattattgcatgtggagaaattatgagtactgcaggttggatggtcagacaccccatgatgagagacaagtgagtaaaatttggggagggagataaaaaagaatcagataaattttttgacaaccattttgttttatccataggactccatcaatgcatacaatgaaccaaacagcacaaagtttgttttcatgttaagcacgcgtgctggtggtcttggcatcaatcttgcgactgctgatgtagtaattttgtatgattctgattggaatccccaagtagatcttcaggctatggtaagagataacgaataaatatattctgtgcttagtagatggcgttagttaggacaggctaattctacaaatatcagtgacttaacccaatagaattttatttttctctaatctaatggttcagtgagagtatattgaggtgatcttccatctaaataagggtatttccatctcagggatctgccatatcttaggaccctggagtcctctgctatactgcatcctattggcagaagggggaaacgatagagttggggatttcccaggaaattctttatgggtcagaccttgaaagagcctccttgtctctccacccccttgatcaaagaattagacagaactcaaatcatgtagcataactgactgcaagggaattggtaaattatagtatagttatatcacaggaccaaagagaattgggtttgatgagcaactagcctgtcttccactttagttatttaaaagaacacctgtgtgagagtacctggtcagatcaggaagattatt

SEQ ID NO: 113213 - DNA, 1710 bp, Homo sapiens
aattcatattcagattagtttgactacttgtatatagttaattgggtaatatttaaaggttagaatttttgtgttgtttgctaagttgtttcatgtcacttctttgcctgatagcagtgacaatttgggtttgatttagatagaaaaacattttgaatttaaacctaggaaaaaagacttaaaatctttcctcatcagacttaaaaattataatgttgtatattgtttggagacattatgtgttttatctcagtgtaacctagcagaattcatctgattccttacagatgcagtgttattacaaatttttaaaagttttatatttcagaatattttaattttttttctcagtgtacccatttcagtgttatttatgtgacttttaaactaaattcaaaataacatggtaatttatttaggaccgagcacatagaattgggcagactaagacagtcagagtgttccgctttataactgataacactgtagaagaaagaatagtagaacgtgctgagatgaaactcagactggattcaatagtcattcaacaaggtaagccatggaactttaaaactttaccaagttggattgacacaacctgtttttgtttgaaaatcgtcttagaagattcttgttactaagcatccattgagtcaagcttgcagccagtagagatgacttgtattgcaaatacagtaaactttagttttgtcattaaaaagatggatttgggctcaggacagttgaggtttgaataatgagtctgccagttagcagttctctctggttacatgaacccatttcctcatctgttaagtggggataaaaataactacacttaaggattttaaaggattaaaggggataatgtatataaaatatctgacattcagtgtggtggttaatgatttatatgtactaactactcttgattactgtggggaaaactgaagaaataaaaatcaaagagcctgattttattcttttttcttgtctgcaatttactgagtacccaccagatgctaggcaccgttcttggtgctgagaattcagtggtaaatggaacaaacaagtattcttactttcaaagagtttacaatttagttgggagggagagatgaagtaaacaagggtataagtaggagtagggggtgagagtgggattttattttggatcaattgaaggaaacttaagttctcattccagatcagcttttaaggatgacataatttatgttttcatgaagcctactataaagttgatgatgggaaatataaaattcaagaaaaggggtgggaaacttaataatttcaagtgtgcattggtttcctttgtaactgcatttgtgagcatgtatttactatctgtctataaagctgaaaggcatactgttacattgtttactgattatgtaggtatcttgattttgtcagtctctgatgtccatgtaagagagtattgtacatgtctttggtatccctaatgctattcatagtgttagccatatgtctgcatacctgaagacaataaattattgcttatttttacaaatcgtttcccttaataaagtgtttactttgtgccaggcagtgtgctatatacttaacatttcattttctcctttagtcttcatgccaacttgagatgttagcatcagagataaaggcttttgagaggttaaattacttgttcattgtacatacagctgg

SEQ ID NO: 113214 - DNA, 2253 bp, Homo sapiens
tgttacatatttcagttctgtgtaaagtttggcctaggtgaaggattttttactttacttttctaaggagaaaagctgatttggggagtattagttaataacacctttctgctcatcagaaacttgtgtgtataatgcttccatctgttgaaacttgtaggtttttgaaaatttttcatatgcagctttcacaaaagattatatttcgttggcacagtatacagcaggtttcattatataatacataaggtttaggaatgttttgtagcttaccaactgaaaatttggcattaaatttagtgcaaaaatcaaaattattagatgtgaataaacagtaaacagaaatgattgacatttgagataaaattataaagcattaaaccttacatttaaagtttcaagtttccagtaaaataaagtctgttcagttaacattatacaacacaatcttttttcagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaaggtgagatgtagattaaataatgcttttaatatagaatgttttagaccagaaacaggaaatatttgttacattgatgataaataattttatttccttaaagagaagcttttgtgtacgtgaagttaatttattttgactgcagttttcatgctttctttgctgtgaatctaagaagctgattgttttgttctctagactgcagagatgaatgaaaagctctccaagatgggcgaaagttcacttagaaactttacaatggatacagagtcaagtgtttataacttcgaaggagaagactatagagaaaaacaaaaggtaatttagaaataggtttgggttacatgaaagctttattttactggaaacttggaattttaagtgttactgtaatgtcttataattttgcttaaaacagtagtcatttttgcttattcacatctgaatattttcatcattatgtaaaatttaatgccagtttttcagttggtaagctctgaaatatttttaaagtttttgtaatgaagtttgtggtatatgtttacagtgaaatatattcttgtatgggatgaatagtaatttgggatggtaacctgattcattttattttaaacagcagaattggctggtaataaagggaaaaatttcttaacttcataagtaatacttggtaatatagagataaattgaaaaatacccagagattagaagaaaaaaataattctacccagtgtttttcttgttaatatttaggtctatatcttcagaattttttgtaggctaattatgtgtctacatttttctcctagtttagatttataccaaacattctgtagcatttctccctcatttaacagttgttcctttaagcaagaaatactgaatgcttactctgttgactagacactgtctcgtgttaattatatacataatattgagcaaagtatcatagtctccaccctcatagagcttatagcccaggattttgtgaatatctttacatttacaaacatccttcttgatgatgatttgttactgtgtataataaaagttggtgatttgagttgtttcccatgtgctagattgcattcacagagtggattgaaccacctaaacgagaaagaaaagccaactatgccgttgatgcatatttcagggaagctcttcgtgttagtgaacctaaagcacccaaggtgagttgactgacacagcataaaaatatctaaaaattttgaaaatgtaatttttttcatatattcttgcaaaaagattgataattagattttgtgtttcttttttttttttttttttgagacagagtctcactctgttaccaggagttcagtggtgcgatctcagctcactgcaacctccgcctcccgggttcaagcaattctcctgcctcacccttccgagtagctgggactacaggcacccaccaccacccctggctaatttttgtaattttagtagtgatggggtttcaccatgttggccaggatggtcttgatctcttgacctcatgatccgcccaccttggtctcccaaagtattgggattacaggcgtgagccactgcctctttcctacattttgcatttctttagagtgtactctcttctgtttttagttaacatttttcaaaaatta

SEQ ID NO: 113215 - DNA, 1014 bp, Homo sapiens
ttttcttattctgaattatgttgtgattagctaattttgtcacagtgtagttagtaccttcttcattattttttacaaattagaaaatgttctgtttccagaaatggcgtaatggtttcctttttaaaaattttttaaccctagctaactctagcgacagcaaagaaaatcagaataagtcactggataattgcccttgcatttttatcttaatttctctgcataacttcaagtattatgtgttgtgtttcctgaagtcagttgtattattaggttaacatgtgagggtatgctgtggtgagtctgcttagaatagcagaaatttaagaattagaagataaataatccagttgatcccattttttttacattaaagaaataaaaatataaatgatttgtttactttgtccaacttttacagctgtgttttgggaaaggtgcaacgagctccaggacatagagaagattatggctcagattgaaaggggagaggcgagaattcaaagaagaataagcatcaagaaagcacttgacacaaaggtaatttgcttgttaataagttaggtagttaataaaataactcctagctgtgagtatgagagagtgactttttataaaggaaaagaagtaagggtttacaatttaaaatttcttcagagtagcattcaaacatggtattgtcagcagaatttacctatacactagactgatagatctgagtcaaagacactaagattagctttttactaagtagaatcaggaagtcttagtctgtatttctctttataataataaagactataaaggtctttcgggacaaagattatataaagcaattgaagtgctctagatagaaaattctgatttgaaatgcaacattttagctaattatactaaagctgagtttgaaatacagattatataggatttgtattttatataatataaaatctgactttcatagattggacggtacaaagcaccttttcatcagctgagaatatcatatggtac

SEQ ID NO: 113216 - DNA, 2794 bp, Homo sapiens
atgacttttactgttagtctctaagctttgattatttcagtgatgttttagcaatgtgaaggcaaacacttaaagggaaaaaatgttatttaataatagttaatttaataaaaaatggttaatttataaagtcatgaataaatgagtatctctggataatatttggtacttatgtaactgccttttaaaaactcaagtgtttcttactattttgggaagcttgcatttatttgatattgatctactactgttaattgtgcattagttttataacgtcattattaacattaacattttttattctgtaagtaaaataagtaggtaagattatttggaggctttatagtttgctttgaaagatttatatagcctgggggaaaagtctcatacctattactttgtagtagttgttattactaaagtgttataatgtgtctgcaactatatttcatgtttatattagtcttgtgaaaagtaatccttctgtctgtttgtagacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaatttttttatcattaacacttgaagtaataaaataggcttcatttattactaagtgtttcatttgatttatttttctattgtagttccatttgtgaagattgtgactttttgtttattagctataatttctacacttgtaaggcttaaaaacaagttaaaaagaaaattgcaaataacatttgtccctttcagtcttcacctagttgtgtaattattttaattcactttgcctttgcagaaatttgggtattttctttgtagtgctattgagtctcatctggaaagattatataaattgcattctccttgcttatgtgggtagaatgggaaaagaaggcaagacaaagtatacttaaattctatgcatatttctgttatgctttctgttttttttagttgattctgaaatgaatatgccctattcttttgaaagaatggccttttagttgtatagccaaagacatttagtattttccggttccttaaggtattactgtaccattttgtaaaaggaatattattattattatttttaattatttggtaaatattttgtcatatgaccttctgaagcagccacaacttagataatgtcagaactaaggtgattttttttttttaattttgaaagcccagccaaaatgaggtgtgaatttgtcatactgttacattgaaattggtaacaaaatatatcccctcccatttggacttttagggtaaatgaaaattttattgtattttaaagtagtttctaagtgttagcaagactgactataattccagtttctgttttctatggacagacctgataaactggagaccctaaagcaggaatacccaaattatagtgtcaggattttagctgtaccagaggcctttatgtgctacacataatttgtataaaattttatatgtgcagattgggtacataaacagttctccatttttctaagggaatgcaataaatgtagcatcgtgaataaatataacttttataatccgtaaagtggtcttttctttccatttctttaattgttttctcaatttttattcactttttcctttaggacacatttcccttaattggatatctttcccttaaatttctattagtagttgttttcatctgcccacatgtaattgaagatttaaaaaaaaaattttgatacctgcagtattactaatactgcttaatttcttgaaatgtggaattgctgctgttaatgtcaagcaaaacgcagtatttatggcaaattgtaaagtaatttgaatttagtgctacctcaaaattaactttttaaatactatgttagattcttaacagttaaaggtctaatacatgcatgaggaatggttacttatgaaaggaaaaagaatttgtaagagttatcacctcagtttggaagaaattgaaaaaatgtaaggctgaagaaaacttacggaggtcacaaaagtgatgttttcaagaggaggagaaactgggagggagatacacagtggaaatgcaaaatgaatcaagtatagtggtagccctgagagcttagggactcaaatggaaactgtgtgaagggaaactcacttgaaaaaaaagcatgaaccagctaggccctgccaccactgtgtttggccaagttcacaaatctgttttaacctgtcacttccctgtcacttctctggctttcctctcccgctaagcttttgtttcctggcagtaattaaaatcttctgtcagtgccacagctactactgctactggaactgccttaaccactactgctactggaactgccttagccaccttggtatcgtggtttggcaaagtattggcctctaccaccatagggcccagagcttctgcctccaaagtttcctcccttcatgggtccaaaatttgaagactgattgttgtcattgccaaaatcattgtagcttttaccacctccaaaattgcttcaatcattaccaaatctattatagcaatccccactgccaccatatccatcaccaccaccatggctgccaccaaagccaccacgatcacagaacttg

SEQ ID NO: 113217 - DNA, 1052 bp, Homo sapiens
gaacatgtagtaattgtatgtatttatggggtacatagtggtgttttgatatatttatggcacagtgatcaggtcagggtaatgcacatatcccattctttcttctcttaccaagaactttctcctcattattgctaatgggtgtttctgatgcctccacggttgggacaggaaagaaggaggataggcaggagtagcaggaaagttctttcttgaacactttcatggatgtcagtactctttggttttggaagatggaagaaaagctgatcctgtttatcatgggcacttctgcaggttctttgggatctctcactcccacagttgggtatctcttatctgcagttctcttgatgaggatgaaacagatatattctggctgatcacttaatcattcctcaacctatttagcatttggaagtacctctgttcagccctctagatggcacctttggacaagttcattctggctcactcttgtatgcatggctcacatgtggtccatggcaaccttcctgcatcctctgccttgataaactccaggaataccacttaaccccaatgcagtccctctcttttgttcatccaccaaagcagccaaccagtttatctcccacattcagattttccaggcagagccagatcccagttcattgtgttctccacattgcaggtggcacacatcatactgcccaaatggtctccttcgagccccctctcttgatttagcacctctttaaaatgcaaaaatgttaaatttaccattctaacatgctatcctgtgttttttttattattattatactttaagttttagggtacatgtgcacaatgtacaggtttgttacatatgtatacatgtgccatgttggtacgctgtacccattaactcatcatttagcattaggtatatctcctaatgctatccctcccccatccccccaccccacaacaggccccagtgtgtgatgttctccttcctgtgtccatgtgttctcattgttcaattcccacctatgagtgagaacatgcagtgtttggttttttctcct

SEQ ID NO: 113218 - DNA, 1017 bp, Homo sapiens
tactgtttctgcactgggacagagaatgtcaggtccctcggaattttaaaggcataaggtcagctccatcacacatagatccctaatatgaaaaaagtgtctcctttttaatggaatactggcatctcagataccagtagagagtgtaagtatcaaacacagcaatttgcttatcaaagcatggctgaaacatgcatgattgaagagatctgttgggcctgagagtcaagtaaactgtagaaaatattgtatgtttcaaggaaaactgcatcatcaacagtacaggcttccagatgatccaattctagccctgcacattgtctttgagctatttttcagtgctttgtagattttaggtaactaataaatatgtaccttgtggctgttctagtagtgattttaatacaccttctcctcgatgtggaaaaactaattttagtccctctttgcaattcatctcctcatcttttactccttataaatttgtactgttttgactttctctttgaactggttataacatctgcccagttccttcatatcatatgacatgggaaagttttaacacgtgttcatttttatatatgtatcacagtcgtgcttttacatttttgtaaaacttattttttaacaactctctcttctgctatgctctcaaagcattgtttctccactaggggtaacaaggaaaactagtatgtatatatttcataaaatgtttttcatgggaccaaagaaatctctggggcaaatttttcaggatgaaaatgattccactgtagctcaaactctaccatgtctgttatttaccttaaggttctggtgctttctctgtgcctctgctcatccttatcatctacatttttatgtagcttcagggaatctgagcatcaataagatgaagcttgccagttctcgcatcctctggcatgttgtaaattgccctacgttctttctgaaggtggatcatattaatccatacaataattgcttttttcccctcatttcctactattg

SEQ ID NO: 113219 - DNA, 1012 bp, Homo sapiens
gaggggtgatgcaggaaggagacaaaaaattaaaaaatgaaaagaaggccaggctatattgtttcctatttatttggcagataagctcattgcttttcagaaaaaagaggaaggaaggatggagggagagataaaaggatggagaggtggagaggaggagattgatttaatacagagaaaagtattaaattgtatttctgtgacttcttagtgaatattaagacattttgtgactttacaactttgtttagaaaatattaatgtgatttaatctaaactgagccgtgtaaagcatgatgtgtctctttttcccccgtccttcttagagaaattcatgtatctccaaacttcatcttgaactattgaatttacttcatactgaggcttgtgtttaattattttggccttgtgtaagtaactttggctctgaggcacttagacaattaggggtccttcattggattagcaaaaattataaatgaattagtataatctcaattaaaataatatttcatctatccaatttaccattgctgtttacatgtggtctaatctaagtcctactctgataacacccttaataataaaattgactcataagactcagaggcatgagtgtgagcagatgttttgttttgccttcagaatttcacaggtgtccaaaaacattgtaaagatgcaagaaggggccaatctaaggacaaatgccctggggtggccaataaataactctgcttgtatgaatattttgctgatttgtagtgtaaaaatcagctattaaatttaaattggttcttgtggaaaattgtgaatccctcttctacagactttcttagaaagatttaagtatttttagagttctccctgatgccagattttgagctttctgttgtcttattccttgggtagctgctgtcttgctacccctaccccttatgtttatgataagaactagaaaattttattaagaatcttttagaagaccttttgaaagattttaataaaaatttct

SEQ ID NO: 113220 - DNA, 1075 bp, Homo sapiens
gataatattgctgtatatctggaaccagttattaaattttagtcaatagatccaatagtcaatgaatgattcttgctcctcaatttgcttcttattagttgtcttattctctcactgaatccagaatatggaagagattgtcatctaagcaagacatatcttgcatatgccttctagaaggggaagtgaaagcaccaagtccttaatgtgtcagttttctaagggcctacgatgtctgagtttcttgattgccaagaagcctaattcttcacagggcaacctggcatacagccatttccacactgggctgttcgttggtacttgtgaatagaacaaaaacggtctttgctttttctcctcagttatcaatgattatcatttttggaaacaagttaaaacatttttctcaaaatgatgattattcatgtcaagatgaagtcaaacttcatgctatctaagctgtaagtaatagagttagttcagtattttaaaaattcatgtaaaataaaatttgttacttctcactccaaaatattcattttgtaaaatttcaccttaactattgttagacagatgttctagatttagctaaacacttttgaaagtaaattatgaggtgggtttttggctaatttttatacttctataagtaaaatctgttatatatgaattatgggaccactagaagtcatagatcctacaagcaaagtgtttgtgggtcattgggttggggagctacttcagttgttttttttaatataactggaggtgtatattggatttttacctctgcgtagatctgtagtaagaactttgttcccattgtcatgcattatttctgtgcatattaactaataatataaaacaataagtattatgagactttcacccagttgaattagtttcttccttctcagtccccttcaaagttccacatctctttatagcatatgtagaattatggctttttgagttgtcggtatttattcacttgtacttatcttagaatatgttcttttatttttattctaggcatacatacatactttaaggttattacttcggtgatgttcag

SEQ ID NO: 113221 - DNA, 1170 bp, Homo sapiens
caacattgcgaatgaaaaccccagaagaaactgttatgtcctgtaactgtcctggaatgctatgattcagttagcagactgtgggtggaggtgggtcatggtgggtgggagttggggggaaggaaatgcaaaggatagaaaggagaattttggagggaaattaatcagacaaaacgttagagagaaacacacattttttgaaatgattttaaccttcttgaatctctaaaaagtactgtctttaaatttttcatttttttacccttgttctgtatcttaagcccttttgttagatttgatagtcattgttgcattgagctcttttctgaaaggtaagaacgtatttttgtcaaacacattgctataatgagtatgatgtgtggctgccattcttcagtctttcttcatttacatgtatcatcaatataatgcaaatactgtcaagggcagcattatctccttgaatctattttttgttttgttttttagtataggtttgtatttgtgctggtgcaggaggaagggggaaagtgttgggaagaaacatagaaagagagaaagaacatttactttctaacaaattttgacaatttgtttttctctttttttggtaatgatcaaaattatatattaaagaacttcccaaagcaatatatcagcttttattaaagaaagcaagtattttcaaatgctttaagaaacttggtgaactctagtataagggtttggttttcaaagggaaaaaaaagaattttatctggaaacattttaggtaatatggatcctccagttaatctatgggaaattatgcagcagatatcagccttcatttgtaatactgtaggagggtgataactttcctgttgcattttctttttgtaaaagacatcttttactttgtcagaaaacaacagtcaagttgtaaatggtcttcaaaaatagtaataaaaaaagatttataatggaaagaattgatggtatatttcacctaaagtaagaaagacaatgtgtaataagggattttgcggttttacagctcagtgcatgtgtttgaaagctgttctctcagcaacgtgggtggcaggttatgctaccatataatgtattgtagttggctctccacacttgtcagggttagtgttcaaccattcggaaaattttcccattgtt

SEQ ID NO: 113222 - DNA, 1050 bp, Homo sapiens
ttgcacaaatatttttgcagacttttccattaagcagtgaatgaagccctgaaagtcactgtagccaatgtgaaggcagaggatttgagagtagtaatggatttttagaaatgcttagggtgcgctcctgtaacagggcatttgcttttagggcagtttggcccaacaattgaacaaattagttatgtttgaaaatttataaagcaaaagcatagataatcataatataatttttgctagaacatatgttaagttggcttattagatcagatcgttttttaaaattacagtatgaaaaagttattcaacttattttaaaaattcttctttgcaaagaaattgataccttgatacccatggcattaagacagctttttacttctttgtgggctggcataatggacagacagtactttagccttggaaatcaggagtattgacgtgtgacattttagatgagtatgtgtgtatgtgaacaggtacatgtggatgcaagcatgtgtgtagaagatcacgtatacattcatatatgtgagagtgcatttgggttagaagtgatatgaaaaaaagtggagtattgtatcttagtaaacttttacttcattaatctccttcaagttgttgatcattaataattggatattcttttgtagaatggctttggaacttggcagtattctgtaatccagttttacaagatgacatggggagatgaccagggaatttactcatattttttttaggccgagtgatgttgatagaccacagtttggcaaagtagacagatctggtttcagatcttagttttgctacttactagctgtgtgaatcttggagatatatttggctcttttgaaacctcagtttcctcatatatagaataggtgaacaatgtctgtcttattggattccagaaagaattaagtaggataaagtttgcaaagtacttattcacattacctggtcacatagtaaacagtcagttaatgcaaattctctttttgggtgtgtttttaaaaaaataaataatattttacaacttaagccttt

SEQ ID NO: 113223 - DNA, 1942 bp, Homo sapiens
acttgcataagaaataactgagatactgatagtttcagttattcctgtatctttggactattcctccaatggttgaatttcctttttttttttaaattggggctgcttgaaaaacatacatgttctttagcaattttgaatattattctttggcagcattgttttagaaaattgttttcatagaatttcttcttagtatccatggacctatattgagggaggtggttgggggagaaatatgtcagcgctgtcaactaccagtagatggtattagtagttgcttctatagttaaaaatcgacacatgtgattaagtagacttaatgatgaccctttggaaatgaatctgtaagtagaagaatctctatactgtgtcagaaccagtaatgatacccacttcgtgttgactgtcaggaagcttagaaccaaatttgtgacccatgtggtaacaattgtatatatttatttctatacactaatcttggccctcagttatttattttgtcatattatggcatatttcttttcagggcccacaaatctttgatggctttggttagcacaaggacattacctgtcttgatcatcttgatcactcatgtagctgagtacctaccacataggtgctcagttaatatttgtgcaatttatttctgcagtggcctttgatatttattttaaagatagtggaggggcgtccgttttagctttactgaggaaaagaatccaaggcagattagttctaaaattgattcgactctagcagcctactttctgatataagcatgtgatcttagagaagataataatgactaaagggaatgtaatatagctttggggaatatagggcaatcctaatttgcctcttatcatagcccagaggttatgagctctggctaaatatgataagcaaggtactttagggaataaagagagactgaggaatgagaagaaatctctttctgccttcactgttctaccttagtatttaggtagccacttcacatttaagataataaaagggtaaaagttgagtcaaagttactgtcagccagtttgtaaaatctagttgaacaataatctcatcaatttaaaaattttatcatttctctgaggaaatttaatgaaaggcattgagaagtgttcctgactttaagaaacttattgtgaatgaagagttgccttgtgttgagagggaattgtctctgaggaaatttaatgaaaggcattgagaagtgttcctgactttgagaaacttattttgaatgaagatttgccttgtgttgagagggaattgtctaaggcagatatggaattcaaatttgaaacttttctgttgaccaggttcaggattatcggtagcatggaattatcatgactcactgaactccatttaacctgaagttatagtcatttgaaacttgctgatattcccccagagtcatattgtactcgccattgaacgcagagttctctaaccttggcttacagacggaaaaacccagtctgtttcataacctgcaatctgggttttaaatattgttttcagagtaggacagaagggtgagacctaagccaaataaaggaacatgtttctagattgtctttgccacatgctgctttaatcatggggtttggagcctgtcagatcagagttggaatcttggtattatcacttccttgagagagagtacaatttctctgttttttctgagcctctgtttatttactttaaaaaatgaaaattacaatgcctgtcttgtttgggtggttgtgaaaattagataagcagtgtaaaaacatctaccatgaacctaatatgtatagattcttagtcaatataactttacgcccatccatactacttttctctgttagctttgtaatggctgcttgctttatccttactcgtacatgactgtacaaggttggaaagtgctaga

SEQ ID NO: 113224 - DNA, 1319 bp, Homo sapiens
gtgtttatatttctatttagtgaccacatagcctcatgagaccagtaatacaaaatattatcaggtgataatgtgagttgttttcctggaaaacttaatgaacatactacttttctgccatagttctcactcaggaactacaatttttggatgttgctttaaattgttagtgcctagcttttgcagctcgtgatatgaatacttttatcttttaattatacatctttgtatgagatttatactgtttacctttttttctttctaagttaaataggagcctgatagcactttgctttttaaggaaagatgaagcagatcatgattttattttttctgttattctaccacaatatctaaatatataaaaaaaactttgctgcttctgactcatatactaaaacaagttattaaaatagtgtgaatttttatgaggttttcagagtcatcatttcattagttatagtactgatttaactgagtggaaaatccacctaaatcttttttatttttccgtggatgtttgcccactggagggtgtagtgtagtgtgtattgaaatgttttaatagattttcctttttttttcactagaaattatgaatttgtttacttgagatgcttattttttgtaattgttgatttgaagtagtaacttaaaaaatagtctaagttgagaaaagcatatagctgccttatttagcaataaattattctttttctatcctatttattttccttcattttagttatgaagcatgtattgtatctagatctttgttacttctattgataactctctacaaaggcatcagacccttcctttaataccctagaatgtgtattttaaccactatacctgaggacttaaattgaactttctgctgaatagtcacaagatactaaaactggatttggccaaacagaatatttttaatgacaaaattgaaattatttatgcttctcgttctactttcttgtattcaaaatatcctattccacataaattgaaaaccaacaatttaagaacactttataagatgtttgcaatttattgcttctacacaagagactatttctatatagaagtgataatttagcatttctgagtctacactgtctttctttgcagaatgcttcatctcagttgggttacttttgtgcatgaattcatgttattcaagagaaattttcaaatcaagatggtagtttttaaattcttaaatcccttgcgttttagcattatgttttgatttaatgttgttcttttcttttgctctcagaaggaaaaataatgtgtgagattttttttttatcatttag

SEQ ID NO: 113225 - DNA, 1034 bp, Homo sapiens
gaaaggtagttttctctttgctggacccagttcctcacttagctagttattttcaagtatttaatataggaaatgaagtaagtacttagtaaaggaaaccaaacttatgagaataatttctttgtctaaaatacaaatgaagaggatggaaatccttaatgcttgtttgcatgataaagtacctaatttggcttaactgatccttctttgcttgcatctggctcttgaccatgttctacataggtgtctgtataattaacatattatctgggcctatatttaacatactatctggacctatatttttacatttttcatttttgttgaaattaaaagatatgaaaatgttgattcaaatactccttttagcaaactatgatttttaaaatcagaagataagatgcattggaaatcttttcatatgatgaagtgcatgttatttttactttattgcttttagaagaaaaacaacagtgaagacattatgtatttatgcagactacaaatctgatgaaagctatactccaagcaagatctcagtcagagtaggaaataattttcacaaccttcaagaaattcgggtatgtctttcaaatttttaaaaatatgtcatcctttaacttttactcattagaagatagtcacagttgacattacattagacaggttaaaatgttaatatataagagaaaaatattggagaaaacatgtttgagtgtaaaatttttttcttctgaattctgattgttctctttattttttccacaatattttattattgaaattttcagacatacagaaaaactcaaagaattgtacagtgaatgccagtatactcacttcctagattcttcagttgttaatattttgctatatttgctttattacaatctgtccatctaatttttttgtgcatttaaaaataacttgtgcatatttgtccatttcaccccaaataccagtgtgatatattggtagagttatcaacatttgcttaattttcattttttaagataaaatttatgcacaatttt

SEQ ID NO: 113226 - DNA, 2075 bp, Homo sapiens
aaatatggagctcggaaaagattggattcccggccctgaactgaccacacagttgagaggaagttgaggcctagaagagcgcgcaacagtaagccgtgtcggcaccagactctgttggtcctactgacacctccagcgttagaatgactaaggctccactcctgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatggcttgcgcgtgcggcggctgggcaccgccattttggccggtggccgtgagaacacgctgtgtggctgaaaagtgaaggcaagagctgatttggcctctgtgctcccctccgcaaggggatcgttttctccaggtacgtgaatagcccggagaggtttggccgttagctgccatctgccaggttggaaagaatgtagggacgttctccgagagcctttggttaggccttaggtggcggagacagcagcagcgcgtggcagcggttcctgcgggacagctggaactgatggagcgcgggcgacgccgagagcttgggggcgcctcggtcttcccctccagccgacccggctgtcgccgctgttgcctgccacacccgcgagggacttcgagaatggacctagatgccgtagtctccactccccctttaccccactcccgccctgaagctaaacctgctggagaggaaggcacctttagaacttacagcactctctagtacccccacactcctccagcacccaaaatggatatattgtcacatgtgcatatttggttgtgggaagtcgtggcttccacgttttgttgagtggaatgagtcatggcatcttgccgccatgaagtcgaatactcgctgtccactcccaggctttatagaaatgatgcccacatgtcactctgcttttctcagaacagcgtgtacgcagctatgactggggttgtcccaagtagtttcccagtagaaatcctatagtttttttggtacgcttttgtagcactaggcactttctccccttacccgtttttccttttattgtatctaatactcattgagatcaaggttgatgtctttactcagaatacctttattatctcttcagggcttcgtacattgtaggcatttaatacgtattgtgaatgaatgacagccaaagccgaattcccacctcccattaactacataagcttattttctcttttttgatggtaaaaatctataagaggaagaactgtccaaataacatgttttatttttttactctttcccaacaggactgctaactagtcatttatgatagtggcatttatgttgcagtagtttgtcccatattctgagaatattcattgtataccagccacctgacactaatactttgttagtgtaaccaaaggctcagaacctgtatttgaaccaaaagctgtttggggtttgtgagctttttgagaacttagttctcccctattttaaaaaagggagtttttttgtttgtttgtttgttggaagagcatctaacaattgggagagagggggagaaaacaatattaagttagagttcttctaaatgtcttaaacttaaaactctttgaaatcagagccgtgtaccactcctaacttctacgtgttttgtaagactaataaactacaataagcatgggttagactatttcatgtgatactaaacatcattagttaacagcagtctttgaaatgcttttacacagcgttacaattattttggctttagactgtaaatgcttctaagtattcctcacttccttttttcctctcagctgtaagaatgacactgagggtcattgttctagtgtcaattttgaacacttttgtcttcga

SEQ ID NO: 113227 - DNA, 2222 bp, Homo sapiens
aatgataaggtctaggatgtaaccagaaaaaatgaatggctgtggtaaggtagaagacaagctgtttgaggagaggggttaaatgagaggacaggagggtcatctgtgagcatattgaaatcgagaactatgtcaggagttgtaaaagagtgtgtgaaagttaacaggggctgaaatcttcaaagaatgaaagggagtgatctggtggtcactactaactaaagcagttagatagttgagatgcaaaactttttagggaggagggagagataatagtctaggacagcgtcgaggagcaagatctcttatccccatccaagcctaatgatattgatgggtgtgaaaaagacttgagatgtctacaaagggaagcagtctattaaaaaaaataaaataaaatcaagattgattatcacagtaagaaaaagacaacatgatctctttctaaatggataatcttggtttcagattcattcattacatattggaataaacttgagtattaaggcaccttttggaattttttactttaatcaccattctaaggaaattaatttctgaaccactaagcccaatattgtgaaagatttttaagttaactttgatcttaatgctgtgtagttgattaaattggaatatcaagacttataaaagctttaaaagtgagcatagtatatacatatagttatttggtctccttttaatttcattgctattatgattatttgccatttctgtcagtgtcattatagtcagatgtacacgacgtgaagtaatgcttagtttgggggaagagcttgtgggatttcccccatcctgcttcccctttttcagttttcctggctattaataattctttttccattagagctttagatttgctttgtctgggttggttggggtttttttttttttttgagactgggtctgactctcatccaggctggagtgcagtagtgtgatctcagctcactgtaacctccacctcctaggctcaggtaatcctcccacctcagcctccggaatagctgggaccgcaggcgcacaccaccacatgtctggggttcttttgtttgttttttctcatgagattgaattaaatatataaattcaggaagggtttaaatctgtgatattaactattctttattataaaaactgagatagcatgtcatttgttcaggtcatttatatcatttggtgttgttttaaagttttcttgtgtatatatcttgttgagtatattcctagatattttctttttgtcgctattgtaaatgacatttttttctttccttatataaatcttctgattaaagtatatatgtaaaatttgattttcccaaccttactagattatagattattttacaatttttacatttgtcaaaatttatattttttttttgcagataatcatttcatctccatataatgatcatttatgttttcctgtctttcatgtatgcaaattagttcccttaactaatggcattaaatttgttgatttttctttcatagaagagctggatattctttcgcccagttatggcagacaagttaacgagaattgctattgtcaaccatgacaaatgtaaacctaagaaatgtcgacaggaatgcaaaaagagttgtcctgtagttcgaatgggtaagctgttctgtggatcatttaagtataaaagaaaaccatgaaagaaatcaactggtttgataattctttacggacattaacataaactttgtgttcaccattagtttcataaaactgtgaagacaagaaaagtagtttgttctaaatttcttttattgctttgtgactgaaggatcatattttttaaagaaagaccaaattttagaataatacatcaatatttaaaagtgtattggatgtgaactcaaagcagagttcagcttactgatcttgaaatctacaaaatcttataattactttaatattatatatatagtaattaattactataatcaatgggggaagggttacagtaaactttgacagtattttcatatttaaaaaatgaacaaagagcttaataagaatgactattcataaggtttaactatattttgaagattagataaatttccaacaattcagttgaaaaattattggtagtcgttaagggctatgttaagtaattgtgaatatacgaatgaggcatagaattactgactcttagaattactgaaacttagaaact

SEQ ID NO: 113228 - DNA, 2035 bp, Homo sapiens
tttaggagccactgtgtaatgttcttaagttagatatttttatttgtagatattataaaatggagcttcaccagagtgtgaatgccgccctattaattgttcaaataaatcataagtgtattttgcttttcatttctgaatccttgattaagtatccagaaagatatcttggatacctgaaaacattttcacttgttttgaaaatatgagcaggaaacattccttccagcttaacctcttattagatgcccttctatgtcctaggtgctaggaatctgcttttgaataacataatatctgttctgttttctttctttgctgctatagggaaatgagacttttattaattatgttcgcctccaaccttaagttaaaagccacaagtgttctatttgcatatataatctatttcctgtagcattcatcctctttgtcattgtattattaaattcacatgattctgtattttttttttttttttaggatcctcctgactggcaggagattttgacttatttccgtggatctgaattacaaaattactttacaaagattctagaagatgacctaaaagccatcatcaaacctcaatatgtagaccagattcctaaggctgcaaaggtcggtttttgatagagggaacttaacggatattagtagaagtataaaagatatatcaaaataaacttgttttactttgtgattctttttaatattgaaagaaaatagtaactgtttttggtatattgtggcaggggacagtgggatctattttggaccgaaaagatgaaacaaagacacaggcaattgtatgtcagcagcttggtaagtgtttattttttgtttgtgtgaatatatatttatttattttttgagacggagtttcgctcttgttgcccaggctggggtgcaatgatgcaacctctgcttaccacaacctctgcctcccgggttcaagcgatactcctgcctcagcctcccaagtagctgggattacaggcatgtgccaccacgcccagctaattttttgtatttttagtagagaccgggtttctccatgtcagtcaggctggtctcgaactcccacctgcctcagcctcccaaagtgctaggattacaggcgtgagccactgcgcccggccattttgtgtatatatttcaataggccctgaacttaagtgatgaaagtacacatctttatgtggattactgaaaatctccagtaattgttatatttaaacaattttcaactgaaatagcattcaaacttcaaatgatgacatgcagtatactttttacctggaagaggtgaaatacattgagcacaatgcctctatgttctttgtagatttaacccacctaaaagaacgaaatgttgaagatctttcaggaggagagttgcagagatttgcttgtgctgtcgtttgcatacagaaagctgatatgtaggttactttacaatttttgtttatcttcatccgtattgtagagttttcagttgtgatgctgctaatagaggaatggttttgagagaaattaatagaaatagtatctaagttcctaatttcgaggtaagatgttgaagcagttgtgtatccactactcattttccctgttatattcacaggggaaaatatttatttatttagatagtttataactgataggtgccggaactttttatataaagtcagttattcattatctaagctctctttttttgagacggagtctcgctgtgttgcccaggctggagtgcagtggcgcaatcttggctcactacaagctccacctcccgggttcacgccattctcctgcctcagcctcctgagtagctgggactacagacgcccgccaccacacccagctaatttttttttgtatttttagtagagacggggtttcaccatgttagccaggttggtcttgatctcctgacctcaatgatccacccacctcggcctcccaaagtgctgggattacaggcgtgagccaccacgcctggcctaagccctgtttttatgtgaaaagactt

SEQ ID NO: 113229 - DNA, 1068 bp, Homo sapiens
aaataaatttatattgcattataatccttttcataaaaagatattgggagtttttataatttataaaaagtacataaatattaagatgtggggaagaaatggttgtaacttacctacttatacatttgagatagatgcatactttaaagaaaaatttgcagttacctagttttcttgccagtagtcttaagggatgacatcagaacaaatttattaatgttttattcttgtcaattaacaaatatgtattgagtaccttactctataccatatggtagtctttgaatcaagttgataataatatgggtactcggcagtcattcttcacaactccagttataaatgtcatgtctaaaggctgtgccattcagtaaatggtacccagtaaggtttttaatgtgctcgatctattaaaacagcttaagaaactttagtttttctctgttcctttaatatattgaaatcagtgcagcatacttaaaagctttctataaactgtaaaggtgattatggtttgaactcatttttaaattgacaagacaaacattgaagtaggactgtaaagactgacttgctgtgttttttttaaacgaagtcacttagttctttgagcctttattttccaaaataagttaggtatttgaaccaagtggctgctaaggttcctttgagtttatgtttttatgtaattgtttttatttaattttttaacttcacatttataggttttagatagtttaagatcaaaaaacatgctgattttggcaaaataaatgtaatctgttcatttgttctgtcagcaaagatgtattgaacacctgtgttctaggatgaggatacaggctgcatgatgtgtctctcagttccaaataaaatgaataacgtcaagaccttccaagaaacttcagctttctcttcacttaaatataggaaacactgaaatatggattattcattgtttctcaaatacgcttttcatttcagtgtgtctgccattgtagatcttaaaattttattacagagggttcttgtatacaatgtggatttaagttattaaaatctgtttag

SEQ ID NO: 113230 - DNA, 1221 bp, Homo sapiens
ttcctttttacttgttggacatgatgggttttgaatagaaaatctcaaaacatgtcatagatggtggatacacattgatatctgttggtggcaaattgatatacttttattctgaagcttaactttgtcaagattcataaatagaagagttctatagtgaaagtttatcatttaaatacttttttatattaaaaacagggaagtgttcgccagttactacatgaaaagataagagatgcttatactcacccacaatttgtgaccgatgtaatgaagcctctgcaaattgaaaacatcattgatcaagaggtactttaacataattttttttatttttttattattttgaattttggatgcctttacatggtttgctaaactcctccaattaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacggtaaatatcttgctcctagccatattttgattatgtatactgtcctacaagtgtgcttaatataacagtcgaatgttttatgatagaaagctataagatttcaaaatcattgtgttttagtttcatactccatgcaaaaaagacagcctttgttgtggaacatgacttcatcatggccacctatctagcggatcgcgtcatcgtttttgatggtgttccatctaagaacacagttgcaaacaggtaaaattactttttaatatgttcaaagtaattcattttaaattttccagtaaatagtaaagtcactcactttaatttttaaaaaatgaaagctagaaattctagacttgattctgtgactcctgagatcattggtattggggactggatgggaccatgtggaagagtagtgtttaggcttcagtgtggaatccctcaccaggaagataaaaagctgtaggccacagcataaaaagctgtgggcccctcaccttttctcagcttaacttttgtttgctttattatttgaatttcccaaaaaagattgaaaactattgctttcatacatgatagaaaaagaaaacaagattaaagaggttacatgatttgtccaacttatgctgacagtgattgagctcacagtggatcccaaatatctggtattaatctatagcagagttaaa

SEQ ID NO: 113231 - DNA, 2237 bp, Homo sapiens
atcttaagattgtcataccttaatcctaataagagaacagctcaacaagtaggtaggtgagattgttactggccagtattggaaaaaactttatatatatatattttgtgtagtaggcagatctcaaactgacagtatgctgcattttgaatctggagataaaagttgcattgatgaaaatggaatttaatagttttcctagaaataataacacatagcaaaattttatatatgtgaggcatcttatataaagggactttacttgagttggtgcaagtgagtcattctagcattagggatggggcagaggtagttatctttcctttgagcagtggacccaggaatatccagaaacagatggtatgtgcagaacaggttgtacaggcactgttttaagcacagctaagtaataccatgagtgaaagtctacttttacctatagtagaatcgtgttgctgatttttgtggcttctgttttcttttttaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctggattgtcttaaagaaagtacttgtgatataagagcacagttctacttactgctaatgacagaatatgtattaaacgtattttcatgtaaatgaaat

SEQ ID NO: 113232 - DNA, 1434 bp, Homo sapiens
tgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttgattctgcttgtgattctttggttccagggttaaccaggtaatatagcatgtagatcttgagaatttttgtaaactccttaaaataaatgatttccatgacatgtttccagctagaagacaattctcatacatgcaactaaaagccatgtagaatttataatctatgggtactgtgtaattttccctagtttatataacgaaattgaggccaagttacttgcttagggttatgcaactagtaagtggtaggacttgtatttgagtctagttttaagtgattttatagctagtgctaccattttttttctgcaatgactaaatgggaatgtgcagaatatctaagaatatggattaaattgttttttaatggtttttacatttagcattcagtgatatttatgttggctaaaggtgaaagcaaattgagtgttttgaaaacaaagtatacttactttatactctgaaaactcaatttcttaaagcctgtttttctttataaaagttaccaaag

SEQ ID NO: 113233 - DNA, 4187 bp, Homo sapiens
cattttcacgttggttatcacagtgatttagtatttggactatagattatatggtctttgtaggcatgagaaacttattttgaccctagtacttgtagattgatatccacccaaacctctcttttttctcctcttttgtttatttaactgttttttgtctcttcaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttctcagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgc

SEQ ID NO: 113234 - DNA, 4109 bp, Homo sapiens
taatggactgttacgggaggttacccagtataccagtataaaacattaaagccccacacactcaggtgtgtcttctggtctctgtggacttccttagaggcttgaggaggagctcagttgaaaacaggtgatctggaatagcagtttaatctggcacaggcattggagtttaggaattattggaagaagtgccgaatccatttaggaataattgaagtgcccaaatccgtacataaataagcattgtttatgtgcaaagtacatttatctctcatgtcatgtgttattatataaataacaactacaaattgtttaagcttgtattcataccattatgcatttttcagttagtgaattgtaaatgtacaactactgtaatgtgggtacagatggtgaaatttctttcttattaagaatggggtccttcatactcatcattttagactaaggagtttgatactgattgcttttgatagtggctcagatttgttttctagaaaactgttagagagggctgagatcctcctcttagctgtgtggaacatttatttagaatgccaaaacaggaacctagaaccctcagtgataatttagcttaaaaacctcacttatttcagtcccttatctcatgcagagtttaagtgatttgctgacagtaagcatttcagtgataagaatcctagtgcactgtatttgctaatttgcacttaggttctccccaactccccaccaaaaaatatggcgctacaatgatttttttggaaggttggcacagaagatgttgttttttttgaaagaaaaattgtagggtaaaggtttgttcagggtggcttcctgaaatagggatatgaagattaagtctactaatctaagttgaaatctgattgcttaatcctttcaacttagcgataagactattattctagggtgtataattaattatggaccctagattctatcttctttagtttcagttaaaaatacagggctgtgaattttaagattttagaagtatgaagagtgagattaattacagaatttgttcatgtatctgtgggtaaatctttaacacaaaatgttgggttttgttcattttaaagagctcatcagtcaatcagtcagcttctcagagtagcaatccatgtgtccagagaaaatcatcacatgtaggtgatagaaaaggaagcaggcggagaatggatacagaagaacgaaaagacaaaggtaagttatctcatcattagaaagcagatgctagagatctctttagatgactggcttaatgtcatatatttgggaaagaaccctttttaagttgttaagtagtttatctaatgtcacatattttgaatgttgcagagaagtattgactcaagctaaaggatgttaagtgctattctaaaaactacattttcactgactaaacatggttcaaataatacttttggcttcttctatcttcgtattttgttcttctgtgttcagacatgactggtggcttatgctgtcttttttaatcttgatctgctatagactctattcatggacatagtcagttggataaaagacccgaaccaagcacattggaggtaaaagttttaaacactacttgcatcttttctttttccttaatactgtgtagtacagtaggaagaagtggaagaaggtgaaaataatttcgaaattttatagctgtgtattaggaaagtagaaaagcagggaaaagatgatggggattgagaagtcactcacaaattatgacagtttcttcaaggtacattagggtgccctgcctgaattgttagaaagtagcctttattctctgtccctctagagtgatgtttttaaaggagaagagtataatgtttgaagccttgcctccagtgaaaactgcccagtagtttgatgtaataaagatgttcaggcaaagttagcctacctgttgaaaataacatataattggaaaaaatactcagtggtgagagggttctgtcagatacaggtagggtgaattataaaaggaaaccatcaatattccagaatgtgggtctctgaaatacaaaactttgcttcttttttgcttccaaagaatattactgatgataaatatgcaacagtttcatcaccatcaaagtcaaagaagttagagtgcccttctcctgcggaacaagtaagtatattgttgcatttaacattgaatgctccactctctgggtttctgtgctctgtgtatagggtcatttaaaaacagaaaacatcagtatgggaaatgggagaattttttctggcatcacagtttggctgtggttatgatttttaaatgtattctgatgttagtctagaatgttctctatttatggaatgttatagaaataaccaccattttctggtgattgagaccatttttttgaattgactttgaatatatttatatttgttatcgttatatttgatactttgtattactttggtagatttccttgaaaattagatttttgaagggaaactgaatttctactttatttcaaaatttaaaagagttatctgcatcagttatttcacagatgggagggaatgtactgattgaaaaggtttgaaaaatatacattaaaaaaataccaatttacaaatttcatgatgaacctgtgttctagcagacattttagttcttgactaatacaagagtagagaaagttaaatgttaaatgcctttcaaccaacattcttcatattggtaagaaagcatatagttacatgaggagtttttctaaataatcatgaatttcaagatttcaatgattttgctcacttgccttaaaagtattgtgttgtatttaactctgctagtggataggtgcggtggctcacgcctgtaattccagcaccttgggatgccaaggcgggcagatcgcttgagcccaagagttttgagactagcctgggcaacagggtgaaaccctgtctgtattaaaaaatacagtccttgttggtaggcaacccttggttaggatcaaatttgtttgcatattatctttagctactgtgtgtttttcttacatttctaagactataagggctatttgtacttcatttgtataaaaggcaggcaactcaatatgtatctggtggttagaaatagtgttaaagcaaaatgacctcttgtctttttctgtcttcccccactcacccctttcttgaagaagccagcagaacatgtgtctttgtcaaatccagctccccttctagtttctccagaggtacatctaactcctgcggtgccttctttaccagccactgtgccagcctggccaagtgaacctacaacttttggaccaacaggttagagaagggtttagaaaatctagccagccaaaatacctttctagtcagagacttcaaattcttgagtggaagtttgacctctgagcaggattaggtgtgtggagcctcacagagctttctgtgatactctgctttgctctgcttccaatgtggaaagaccatgtacatttggtgttgtattcatctgacatatgccctcatagtctcaggagcatgatgtttgagctggttgctttggttgctcagcactaattagcaccacggtttgatgcttccttcatgggccagctctttatggccccgtaatgaaccccttgaccagccccatgtcctacacgtgcctgcaagagctactattagaagacattgactcagagcttgtatcctggacgtatttccttcttggtgtccaggagggctcttggttgatactaaaaggtactactttagattggctttatcagttatacagcattctttataggttaatgtaagcatatttgtagagattttcatcttttgtcattttgattccttttcttctcttttgtaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccat

SEQ ID NO: 113235 - DNA, 1391 bp, Homo sapiens
tttgtgtctcccttggtggtgtcataaacaagtgggaagatggtcctagtgtctcattggaccattggaccattcccctttacttagaacagaaagtgagaatgcttttgagacctaaactaataactttccctttgagaattaattcttaatgaaaatattggaatatggtataacaagtatatacagtgctcactcatttttgtatcatttggaaataagtttttttttcttttcccctctacctcccattgctgtttgtcttcttgactctctgtaaggtaggctaatgctacaggagcttccatttgcttaaacattcattaaccagactgccaaatgttctaaaatgtcagtgtagctaaattagtaaaatgtttgtgttgcaaaatagatcattttattttaggtactcagtacagttttgtgttttttttttttgacaagaatgttttatttatttatttatttatttatttatgtattttctgacaagaatgttttatttgacagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccgtatgtatgaaaagacagtttaaaagtcattatacagaagtttctcttaatatagtttttagattaagccatagttcccaagggtaaactaataatttttaaactctaaatactttaaagatcacatttttcacatttttcctatttttccttttcacatatttagtaatatctctagacctagagatattactaaaaggttgatgatagagttgaggcaagtaaactggtttgttcacttgtagtgtttcgtgttttcttttgaactaaaatgtgtttaatttgttagcaaaagtactgtgtagtagaggttcatgatttagttaatccattacaagatctatgtgtaaaatcaggaagcccttttgagagctgtctttcagggtgtttgctgttggaggtggtagcacatgtcatcctgtggctttgtcctttctccatgtgtcaggcactgggctgtgatggatgcttctctgataaaagaagtgttctctatcttcaggtttcttaattctttttgggaagtcagaagggaaaactgttctcatgtagaatgaagtatgtgctctgtgaggtgggtttgttggcagcacagaggaggggtacctaattcattctcatgtctgggagcctgtgcctgtggtcttttacatcttggtaagtagtacccaaatgacctatgatccagaatggtggttggacactttctctcttt

SEQ ID NO: 113236 - DNA, 3443 bp, Homo sapiens
ttgatgaagaatgaaataccagcttgaggactttgatttactgctaaaagtgggaggttgcttaaagcattgtcctgtatgttgtacttggcaggtgcacaatttcagtgtgggcagtttataggaagaaaacttaggcttatttactcttttatcatggatttacaactgcgtaatattaattgtatgctagagaacagttaatggatctatttttagggataaaaatcacagttgcacatttttaatataggaaaaatgggaagataataattgtaataatagttgctctcacttgtagagtggttgctgtgtgcaagttggtattctttatgtgtatcctgtgcaccctcattccatctccatgagttctgtgacgtaggtactattattagctccattttgcattatgaggaaactgaagggagagaaaaataacttgcccaaggtcatattgctggcaagtggaagagccagacctggaagcctggggtatgtggggccacagccctgccttcagaaccaggacctgctgcctgttttgtttagagccttaacatattgtgctcctactttttgaacaatttagaaaataagtgttagaaaaaaatttagaaggacaaagaagaaaaggttttctttcttttaggtaggagatatggaggtctgggaggttaaggagatggatttgattgtagacctatttgaacttattttgtttttactgataaactttattttctgtttaattaaagactaaattttaaaagctgggtgtggtggctcacgcctgtaatcccagcacttcgggaggcctaggcgggtggatcacttgaggtcaggagtttgagaccaggctggccaacacggtgaaaccctgtctctactaaaaatacaaaaaaaagaaaaaaaaaaaaagccgagtgtggtgtcacacacctgtgatcccagctacttgggaggctaaggtaggagaatcccaggcttgaaccagggaggtggaggttgcagtgagccaagattgtgcctctgcacttcagcctgggtgacagagtgagaccctgtctcaagaaaaaaaaaaaaagaaccgcaaaaaactgataagtaatgcaaaggaagcaggtgactgattttttttttccttttcatttttggaatttttaacaggttaggttggatcacaatggaaaatttttgaatgcagatgttcaaggaattcattctgagaatggaccagttttggttgaagaactgggaaagaagtatgtactactcttcagctaaggcatttactgcctcctccatttagcctaatcatgagcattttaaaatggccttcagtatttgcaaattcaatgaaagataattgcccatgtatagaaagtatatttgggccagggacggtggctcatgcctgtaatcctagcactttgggaggccgagatgggtggatcatgaggtcaggagatcaagatcatcctggccaacatagtgaaaccccatctctactgaaaatataaaaattagctggacatggcagcgcatgcctgtaaattccagctactcaagaggctgagggaggagaatcgcttgaatcagggaggcagaggttgcagtgagccactgcactccagcctggcgacagagctagacttcgtcttaaaaaaacaaaaagaaagtatatttgttccgacctctagaaaagcactaaatgtgcaaatttagtattttgcacattgtcaaactttaaatgaagattatttgttttgttgcttactgtttaaaatgtaccattgtgcacaaaggcagttcaagaaattgactagatcgtaatatgggaactttggagggattcattttaaattcattcagtactgcattgcatgtagttagtattcagtcagtgtttgtcagatggagtagcaaaatattgttggcttaccttatacagtgttattttagagcatctttgtttcagttgccgctgggctttattagagaaaaaggtagtaagtcacaccttaaactttactgtggaaaaatttaaacatatacaaattaagaatagatccccattataaccagcagcacaatttttgaatcccaatataactcaacacccatttttagcaactaacagcgtttggcaaatttttttcattttttttgagatggagtcttgccctgtcacccaggctatagtgcaatggcgcaattttggctcactgcaacctccgcttcccgggttcaagtgattctcctgcctcagcctccccagtagctgagattacaggcatgtgtcactacgcccggctaattttttctgtttttagtagagatggggtttgaccatgttggtcaggctggtcttgaacccctgaccttgtgatctgcccacctcagcctccctaagtgctgggattacaggcatgagccactgcacctggccttggcaatattttctattctattttccctaatatgtttttaaaaaatgaaaatgaaattggcatattttgaaggaatccaaacatcacaccatttctccagtagatgtttatatgtttctctaacagaacaaagacttccttccccaccttaactacagtaccattatcctaacagaataagtcattctgtatttatttaacttttgcttagattgtgattcaactgtctttttttaaaattagaaaatatgcttttgatttatatcatttttttttattagaattacatctggattggtaaatgcaatttgtaccttaattgtaatttgtttttaatgtaagaaataaaactagaaattcttatataagctgaaaataaatatgcagaatatttaactattcttactagggtattttaagctatcacaagtcttttcccctttgaaggcacacatcaaagaacctcaaggcacctcccccagaaagctggaacacagtgtcagggaagaagatgaaaaaaccttccacttctggacaaaatttccattctggtaggagcacatcaagctatcattcctttgggattgggatgatggtacttgggattgtttataatatgaatattatcatgtacttttgggttcttacaacagatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataaggtaaccttcttgaatgtaagagaagtatagaaatcaagtaagaggcatttgttatatttgccacattatgtgcatttgaataattataactttttactcatatcattgtccctatattagtattaagagcattttgtataaaacttcatgtga

SEQ ID NO: 113237 - DNA, 1442 bp, Homo sapiens
catgtgtatattaaaaggaagtttttacattcttttgtaaattcaattattctacccacccaaatttcacagtttatgttttcttattactgagccagttagaattactgttgtctttgacttctgtcttatatacacacatttacatacatatacccttttatatatagatatacttgtaccaaaacttgtatgagctcactggaatatagctctttttggagcatagttctgactttgaagacgtttagatgaggttagaaggtaattacgtgcaaatacctttttctgccccaattatggttatctttctttgtaggagtaagactgctgctgctgctgctgatgtgaatggatttaaacctttgtcaggcaatgaggtattttttttaaaagtggttttaaatgtagttctttaatataagaaagcatgtacattaaaatcttaatttttttcttttttctggtacatttcagtcaagtcaggatcatctactcagaaattgatttggtggcttcctaattttttgaagtttcttttcttcatttgactttagttttacgtgtatctcaaacaaaaatgttttaaaagcacttatgtgttgattggacttcctgactttgtttagcagctgaagaacaatgggaactctactagcctgcctttgtctagaaaggttcttaagtcactcaatcctgcagtctatagaaatgtggaatatgaaatttggctgaagtctaaacaaggtgagttaaaaatctgcattttccataaatttgctttgtagcacttgaaaataagtcaactttatattatactgacctttttttttttaacagctcagcaaaaacgtgattattccattgctgctggcttacaatatgaagttggagacaaatgtcaagtaagtgacttatgtaaaagaagaagagattttacttgaaactttgctttttctaatacaaacagagaaaacagctgaggtgtgaatgtgttgttaatttgggatttcagaatatatttatcatgtatatacattttaatagtttacaagtatttagctttttgactcatttgaatacgttgctaaaattgtatgtatctaaaaccgtggcatcccatcacatgatctttaaaaacaattcagcctttggtattacttggttcaaagaagtaatgataacatttcagatattgaggtatttttgttaaaatggactgaaattgattcaaaattgactttataggtcatttagttttgtttatgaaaatcatcttgggagatgttgatacgtacacaatatttactgttggactgaggaaagaaagtgagccacagaggagtttttgccaattaatttgaataagcagctgccctggatttgagtagctgattgttaaaggaaaaagttggattaaaatcagtgtttcttaaactagt

SEQ ID NO: 113238 - DNA, 1051 bp, Homo sapiens
aaagtatacattgttgtatgagaatatgaaaggattgtacttggtatgttacactctgtgacactagagatagaaatggaacttaaggcttaggatatctaattctttattataaaaataactttaaaaatatatgtatatctcttgatttgttttttttttgtttttttttgttttgttttgttttgtttttgaatcggagtcttgcactgttgctcaggctggagtgcagtggtgcgatctcggcttactgcaagctctgccttctgggttcacgccattctcctgcctcagcctcccaagtagctgggactacaggcgcccgccaccaagcctggctaattttttgtacttttagtagagatggggtttcaccatgttagccaggatggtctcgatctcctgaccttgtgatcacccgccttggcctcccaaagtgctgggattacaggcgtgagccactgcccagcctgtatatctcttgatttgtaattccaggtatttattgaattaaaattttctgatcctgattgaaaatttggccaccatttctttctaacttgaatcagtgtctgccattgtaaatttaattctagaatagactgactttgcctaggtagaaattttgctttacggttctctctgagcaccatgtcattgagcatgggggacattggaagagagaatgactagcttgttacaacttattacctgtgattggggttgggggacttttagaacatgccctttggttgctgttgctgttaatggtgttagaaacaactgggtcttgtatggcagttggcaggtgaagtatagagtaggggctagtaagctggagaagtttaccagagaaggtagagcaggtgtgtaagaagatgtgttcactattgtgtttttctttttatactgcactgttgttgtccttggaatgtggattacctttctattgcattattaaaatttctttttttttttttttttttttttgagacggagttttgctcttgttgcccaggctggagtgcaatcgtgtgatcttggctcactg

SEQ ID NO: 113239 - DNA, 1019 bp, Homo sapiens
aatgcttcactgtgctggaattaaacgtaaggatatataaagctgcacagtgtgtggaatgtagtagtaataattgctcagtgtgtgtgttttggcttttcctgttgtcctacttgtttcacagttgtgatacctttttgtgatggtgttagttttaaaaatggcactgtcttttgcgattattttaaactacttaactgcacttacagaaattttagctgtaccctaggtaactttctgataaaattatgttattgaccataaggtttagcagatatctagtcaggattttaaaagcctgagcaatagaaagttacaatgtgatggtctgttcctgtttttaaaaaactgcctgtagttaatgttggaaaatctgtctgtcattaattgcagctctcctttatgaattgctgtatgagaaggtatttaaaactgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgttttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttcactttcttttattgttttctttcttaggtagtgcctctttttagataatgaaagttccaagttggggttataagtatgtgaacacctggataatgcctctgtgtaggttgtgagtaaatatgtctgaa

SEQ ID NO: 113240 - DNA, 1230 bp, Homo sapiens
agcctagaaagaaagatcaactgacttattataagagaatttttgtcttaagtagctattttggagtcatgatggccaaattgaagtgacttgtgttccaccatgctggtggtgttaagttagaggggaattgagtgaaatactactgttataagggttttggggtttctgggactttctaagggatctggctttttcaaaacaagttttgaaatatattgttatattctaaacaaaatcaatgtgcatttttctttgtataagtgatgatttagaaaatcacttatacaaagaaatttaactttgattttgcttgttagaaaattttgcatgttagaggttagcattaataaggttttgaaatattttcttacagtgtcttgttctttaagtagttgaaagcatgttttcatatattatttttatttttttgtgatcctataaacatttccagaaatcattttgaattttttgatttaatgtttatataacatttcagcatatggatgtactgtagcttgacaacactgaagctttaggttactcctaaaatactcactgtctgtttggaaatgatctagtaattcagaggcattggagacatacattgctatgtaaatgttatatgtatgaggggctgaaatgtttcttttatttttccctttcaggtgttactgtgtttttcaaatggaaatcattatgatattgtgtatcccataaagtataaagaaagctctgctatgtgtcagtgtaagtatcaccttgtgtttatatgggaaattatattcctaaacttatacagtctttttgttttttgttttgttttttgtttttttttgagacggagtctcgctctgtctcccaggctggagtgcagtggcgtgatctccgctcactgcaagctctgcctccggggttcatgccactcctgcctcagcctcccgagtagctgggactacgggcgcccgccacaacgcctggctaatttttttgtatttttaatagagactaggtttcaccgtgttagccagggtggtctcgatctcctgacctcgtgatccgcccgcctcgacctcccaaagtgctgggattacaggcgtgagctaccgtgcccggccttatacagtcttaatgtaaacaaatcagagcaaataattctattctgttataatataaaagatatgtccaagaaccttaaattaccaagagtattaatattataataaaaac

SEQ ID NO: 113241 - DNA, 1785 bp, Homo sapiens
cacctgaggtcagtagttgagaccagcctgaccaacatagagaaaccccgtctctactaaaaatacaaaattagctgggcatggtggcacatgcctgtaatcccagctacttgggaggctgaggcgggagaatcgcttgaacctcggaggcagaggttgcggtgagccgagatcacgccgctgcactccagcctgagcaacaagagcgaaactccatctcaaaaaaaaaaaagtctcaacttaacagatgccatgctgtggtcttgccacaccaataggaactgtcatttcaccctgttagtatttttttgtgtatgtgtgggagagacttggactgcattttaccacatattgtggtctgttttatataaacgtttttataatattcacaatactactaataataatgagctttaagaactcattacgtatgctgtatgaaggtatgtatagaaatataaagtggaatctaaaaagtgtgagacacttacatgccacctttttttcttcaatacaggaatgggtaggacaagtggaaataagtgccctttctcttatgtacaggtaaacactgtaataacataagtaaaagaaaatgaaaccagtgggaaattatattccattatattaaaaatgttaaaatagcaaagctcttttatactttagttatgaagtatcttttctaagttttttttaattgcatcaattagattttgacatttagatatgtcagtgtttagaaattttaattctcaaaatactttggaaaagggtacagaaatttttccggtctatgttctgtaagatatcacttatcaactttgtagagaaatgattttctactttctcagggtcagtggtattgaatggccactagaaccgtactaaaataccatgttacaaattgggtattccttatctgaaatgattgagtccagaagtttttggatttcattttttttttaaattttggaatatttacattatgcttacccagttgagcatccctaatttgaaaatctgaaatccaaaatgctccaatgagcatttcctttgagtgtcatgttggtgctcaaaaagttttagattttggaacatttgggattttggctttttagatttgggatgctcaacctgtattcaattttgctacttttgcctagtagaggagcaggtaaatactttgttttttcttttcagaatgttgtttaaatttcatcttcaaaatttctttgatttttgaagtgtccctttagaattatatctgaaatttaatatatatacaaataatatttgaaattttacatgttaaaaaggttacttttatatagatattttacaacttagttatctcattattgtcttttgtatctccagtggttgggacagtgcctggcacgtattaggcccttgatgaatgaatgaatgattaaattcaaattcatgaagtatagtccattataaataatttctaattgttattttcaggaaagattttataatttatcgggaaccaaatgtttctccttcacaagtaacagaaaataattttcctgaaaaggtaagaatttttcaaagtgttctaaagtatttaagtaaaagaaccgcttagttgctaccatgacctcataagctataattttaaatgattttttgaaatatttctgtattaaggttatggtattctgatttcttaaaagttcctatagccgggtgcggtggctcatgcctgtaatcccagcactttgggaggccaaggcaggcagatcacttgaggtcaggaat

SEQ ID NO: 113242 - DNA, 1600 bp, Homo sapiens
acaggcgtgagccaccgtgcctggcagaatttttcattttttaaagtgatgtaatacttcttgtataaaaattagaaatgtagctcgtgtgtttgatctaaacagactcatatcagtgaacggtttcctctacaccagagggtatcacttctagcagtttgtgagaagccatgattgttaggctgaggcttattttaagagatctattttaatatatggcacctatttcattttgaaaatcagagctaacttttaagaactattgaaaagtctctgagggaaaagattgtgctggtctaagatcaaaacattgtttaaaatattttccttatttcagtttttctttcctttcaaggaataagtggcagcattcatttaccaaagctcattgtttttggtgacttaatgtattaagtctttaccgacttcacagtactataggaaaatattcttacggtaaaagttttaaaatatagatgtattatagaataaagggtgaaaattcttcatttttcctcatgttaacttccctgtctctattgtcaatttaggatgtatcctccccatcccctttctatgtgtgcacatgtaccaatatatatgcctttttgtttttcacaaatagtattattttcccatgatttacttttaaaacttaatcttgagtgatttttctaggtcatttcatgtggttatacctcattcttttgaatgaatgcatgatattctatagtgtggctgaaacatgaattattttttatgagacatagtttcgctcttgtctcccaggctggagtgcagcagcgcgatctcggcttactcgactgctgcctcccagcttcaagtggttctcctccctcagcccccgagtagctgggattataggcatgtgccaccaggcccgactaatgttttgtatttttagtagagatggggtttcactgtgttggtcaggctggtcttgaactcccaacctcgtgatctgcctgtctcggcctcccaaagtgttgggattacaggcgtgagccaccacatcctgcctgaaacatgaattattttactattctgtaggaatcttagggacttttttttttttttaaacactgttacaaataactcccagtgacatcattattttacatacacttttgtagatgtgaaatatttctttatgatagacgtatagaagttgaattgctgggtcacagggtatatgggacattttaaattttgaaacatactggccatttgcctttcagaaaggctttaagtgacttttctaaggagtgtagaatttctcttgttttcaaaacaattgctaggacactgctctcttttgtaccttcatttaccctgaagagaagagatcttctgcccttttctatacttcccaattttctgcttctattcaatatttctttctttctttttttttttttgagaccgagttttgctcttgttgcccaggctggagtgcaatggtgcaatcttggctcactgcaacctctgcttcctgggttcaagcgattctcctgcctcagcctcttgagtagctaggactataggcatgggccaccacacccggctaagtttgtatttt

SEQ ID NO: 113243 - DNA, 1400 bp, Homo sapiens
ttggcagatatttgatggataaactcagttgcttcatccagttctcagagaaagcatctttatcctcttaatgagtaatagtggagcattttgaaggtacttcaaacttgtgcgagaatatgtttttgtcagctttgaggtaaaattgacatacagtgaaattcatcacttataaatatacaatttgatgagatttgacaagtgtatatgctcatgtaaccaccacagcaaacatcataaaggacatttccatctctccagaaagtttccttttgcctttttgcagttaatcctcttccgcctatcccctgggacctggcaagcactgatttgctttctaagttttgctgtttctagatgcatataagtggaatgatagagtttgtagtcttatgtatttggcttctttcacttagcctattggaaatactaaaattcattcatgcgtttagcagtagttcctttttattgaagaaaaataatctgtgtatgtatctatcacaacctgtgtatacatttaccagctgattgatatttaagttctttacagttctgggttgttaaaattgaagctgctgtgaacaattgcttataaatctttgtgtagacatgtgttttcttttttcttggattaataccttagagcaaaattgcttggtcatctggtaaacatatttttaagaaactgccaaactttttgaagtgactgtaccattttgctttctcatcagcaatattatgagaatttcagtttctccacatatttgccagcactctttgtgatttaacttgaatttctctaatgatgttgagcatcttttcatgtgcttatttgtcatctatctaattttgttggtgaaatgtctgttcataggtttttgcccattttttaattgctgttgttcttactgaattttactagttctttatactggatataagtcctgtattggatatgtgttctacaaatacattcttctagtttgtattttggctttccattttctttttttttttttttaattttttattttatttatttattatttttttttgaggcagagttttgctctgttgcccaggctggagtgcagtggcatgatctcagctcactgaaacctctgcctcccgagttcaagtgattcccctgcctcagcctccagaatagttgggatcacaagcttggcttttcattttcttaacaatgtcttttgaggaacaagagcttaatactgatgactaagaacatttaagttatgtaattttgttatagtatggttaattagttaaaacatattttgaaggaattctttttacaagaaagatatatgtcacacatcataaaaaatgctgattaagtaaaattacagtgttagaagacagtggtagtataatatcga

SEQ ID NO: 113244 - DNA, 1656 bp, Homo sapiens
tggcataggtggacgctttctgctcagaaaggagactctcagagaggatgcaggcttgtgtcagaattctgcagtctctagtaactttaaatggttctgtgttttttttttccttagacctataatcatctaatacagaacagtagccctttattggtgggctctttaatatatatggctcttttattataaatatctttcgaaatttaagatatttttggcaatttgacattatataatctatgaaagaatctcaatcttaaaatccaagggtgcttaaaagattttatagacaagggagtatactttaatgtctttaagtatatctctgctaaatcaactgggactgtaatttaaacgcaattgaatttggtggttcaacaaatgacttttagagatttctcaaatgagtgcgattgctattaaagaaacataaaaaaggttgtgttattacacagcttgaataaactgtttttatgtcaaagtaacaatgaagcgatgaagcaagctgtattagaaaaattttgttgatgcttcaaaatatttttcgccttactagttctcatcgctctttctagtatcacttgagagacaatgagtactcttatctgtattattaagctatactatttcttagcttgtaagtcagtctttgttttattcccttctacacactggtcactaccaagttaaagcactgctttcatcatataatttctcagttcagaatgtcacctgaagtggccttgaatggcctttctcatctagccttcaagtcctgcctgggctcaaggccctctgtaaacaggcccccctttgggttcttctcccactcagttccacaacaggttgtcctgctccagctggccagattgcttgtcttcccaacacagtgttcctcttcctcctcacgccacattggccctctctgtagagtatcagctgcctgttgccatccagatcctgtccagcattcatcttgagtcactcttctttcaggaaacctttcctgacagaatttccttctttaaattcttttgtatgtttatagtctttaatgattgctatatgttttcataattagattatgtacatatttttaaataatactgaggtattttaggtttatgtacaaactcagtaattcacagtgaatgtttacacagcgaagcggttaactgttttggcatatatgttagatgacatttctaatagatttattttttgcagtttatagaaggatcatttgaagaatatttaaagcgtttggaaaatccacaggtatgtcacagtcttctagtatatttctatttttatatatccaaataatgtatttaaaattcattaaaatagaagattactattacagtgtatagaggagttgcagtgacggtgtatcctatttccttataaacgtttcctacacattttatgcagcacttaagttggagctatatgttagaggttgcctcactaaggcagagttgtgatattttatcttggctataatggcatgtaaatgtagtataaaaatctgaaataatactggggtgatgattttcagaatgctacgttggtgtgtgtatggaacttggacagggtgaagtttgatttctttttttttttttttgaggtggaatttaactccattgccag

SEQ ID NO: 113245 - DNA, 1009 bp, Homo sapiens
caatatgtataggatgaagttgagcgtggcgtagcatggattttgttagctcttctttgtgaagagtaaagttattgtggagggaaggccaagggaagagagtgtcctaaatttacaaaaatgtcctaaaggagaaaggctaataaattctttacaaatttggcttaagaagtagtattgtttgtatatgtcatgtcttcgctgtgcttagttagaagaagaggtaggaatgagtaaagatatcgaaattatagaaagggaaatggagaaagactgataatctattggttgtcagattattttgggtgtaaaagaagacattaggttgtaacttttaactaaatgcttaatagtgtgtttgttgccttttctttttaggtattgcactctcagtctcgccatgttgaagtcagaatggcctgtattcactatcttcgagagaacagagagaaatttgaagcggtaacttgtaatttcaaacatgtaatggtgtcttgacttggttttacattttggcttttagaagtgttctagtagaatttcacaggctggatcttaatgcgggttatgaaaataacacttattaaaaaaacttctctattgaacttaatctagttatattcagttatgttgttttctaggctattttatgttttgcatttatttggacatttagaaagctactatgatggataagacgctgagctgtgggggatggaaagatgacctggacaaggcccttgcatactaagagtgggctttgtctgacatggtcagggaattgggggtgttgtgattaatagtggtttctgtgatgggtaactccctataaattaaaagaaaaaaaattcagtctgggcatggtggctcacacctgtaatcccagtactttgggaggtgaagagttcaagaccagcttggccaacatggcaaaactctgtgtctactaaaagtagtggcatggtggcacatgcctgagtcccagctactcttgagtctgaggcacgag

SEQ ID NO: 113246 - DNA, 3686 bp, Homo sapiens
ggggcgcaggccccgcttcacctgagccggcccagcgtgcgcgccaggggcgggggttttctcgcttcacaccggtacggaggaggaaacttgtgggggcggcgacccccggcctgggtcctgagtcaggcagcgaggccgtcgggaagtgactactcactctcggggttttccttaatcccgctccccccgtttgtcgtgggcgcgtgttcgctccgaggaggcggccgcgtgcggacagccatgcattaggcagggcttccctatgcgcccggagagcgcggaccgctgcctcgggccgccgccgcctgccgccgctcgcggagcccgagccccagcccgagccgccgcctgccccaggccggggcgtcgagcagccggcggcctggccatgtggggctagccctcgccgcgcctggcctgcagcaggaccagcaacatggaggctgccgtcggcgtccccgacggcggggaccagggcggcgcggggccccgcgaggacgcgacgcccatggacgcctatctgcggaaactgggcttgtatcggaaactggtcgccaaggacgggtcgtgcctgttccgggccgtggcggagcaggtaattgcgggggggcggggagggcttcgaggggaggcggggacggcccggcgggtctgggtggggaggcagctgcgggctgtccgggccgcccacggccggggctgcgcgtgccctggctgtcgtcacagcgccccattgtaacgccggagtgggacgctgctttgcgtctgaaaggtgcaaattgaaactcgaaagcccgcaaattaacggggtgtctctctcctgatgaagaggtaatgagttgaggacaacttgtgaggcctgctcggagcttgtacagttgatttattgctggggacctggcgacatgatattttttacttttgttccgcattcaccttccttcccttcgtttgagaagcaccacgctcaccccactccagtaaaccaagtgtttactagaagtggtggatcaaactttacttgtggaacatattttggtttgctgctggactttggaatgtagggtaggcaagctcgcccatgtcacttgaatcaaatgggcaaactgccgtttgagaaaaccagccttttacaaatatagaatattttgaaggatttgtcttgagtaggttccaccctttattatgctctgctgggctgtgtaggtatactaaacagaactgacttttttaaaaaagcctgttttgatgttggtagtagaaagggtacgtgtaactggagcttttcaaaaccattttctaacacagttgctcaggaagatttttctgaatttttttttttgagcgagcttattccatgttatataacactgtgtgttgtaggtgtgcagtcaccaaaacccatcctatattgaaaaatagctgccgaagtagctggataaaagtttctgctctggtgtgtctttcagacgattcacatgtgctttcctttgacctaggacctgctccccacaccccattgcacacccctccctacccgcctgtggggtttttatgatgtttctgttttcttttccctcaccttttttgaatgctaaataacttttaaaatttctatttgtgagtaaatgttttacttaacatgtggaggccagtctgttctcatttttaaacattgaaaggcaagccatttatttaccataggtagcgtaaaatctttctttaaaacaagaaattgatttaacggacacaaaccgttgctttatgttgcggacattgtcattgaaaaattcttccaaaagctccccaaaccaggctctgtccgtttctcattttcagtgttgctgtggggtatgttcacagccacccactgcctccggtccttattgttagtaggtaaatagtctgccccatttgtgaattttctgaatctctgtctgtcctgcttccttggactcctcagcacctccagaagcctagggaagaggtggaagtgaattcagcccgtatttataacgtactgttagacctagcaagagtttggtaagcaaggaggtagaaataaatggcggtaagggaagcttggcgcttacttggatttgagttatcttgagtcctagtttatattgaagcagaagggtgtgcctgatttccgtagtgcataccatagatactcggtggccttgattatacagaagcctcttttattatagtgggatctctgtttttaagtagaaaaggggcaagagctagtttacactaagaactctttgttacatcaggtaacacattttattgtattttgtaatggggtttaggttaggcataagggactacccttcccagttatgtgactcagttttagtctgatgagcttagctgaagaccttgaactttgggggaagttcagttattcagtaggctacagttatagccatcatcgccaaaggcaaagtgtgtgtgtgtgggaaaaaggaagtaataccagcgtcaggcttcccttttaaaatgtgtaccaataatttatattttttgccaacaatttctcctataaaatcacaaatactcatcatttctaagaaggaatcaaagtaaataatctaagtggcagtttttaaagacggggaggagactcgagttaggattttggtctttctctccaaattatctgatttagataggccatttcctttttacacttacggatttgggcctgccggaggcctgacctgaatcagctccacagccatggagctaaaaatagggcagtcttggaggacttgctaaaacagtgtctcagcctttcccagtatttatcactatcttgtcccaagtaaaaatgggaaagccttctagtttgctttcatgtatatattaatttgcagagatatttgtcatactactttaattctttcgaagtgttatcaaccttgcacaataatttacattttagacagttgtcatttaaccttgcttttcttgcagtgcttgactttgtgaattaccagcactctcacactttatagaagttgctaagagttttgcttctgagcaacaggttcagatagattgtatgtgccaaaatctttgttaaaagagaagaaccagtagatatgcctaccattgcttttgattgaaaataagctttactaacttatgtttgccacctgttgctaggtaaatggctttaagactagctccacgttgctaatggcagaggaaagccctatcagatgacactgtggtttattcatacgagtaataccttgattcatgatagtgtctaacatagcttctgtgaaagaagtgttgctaaatgtcatttgttgaattggcaaaaaaattctacggtggttatttttatatatagatagtcctttttggtcacatactcttagaatatataagaatatagtttaatagtgtccaagaacagcagtgaaggtagaatcagttaaactgaaaaccagttattacactgaaaacaaactaattgctaacctcaacaggtgcattttcagtgtatctcagcgtaataggacatactaggcgtccaggcagttgtgccggttctgtgggtataaatgagccttggttgtgatccaagagagctgtagaatgcacagctggagcctcccttttcccaaatgctctactcatgctaaacgtaaagggagaaccac

SEQ ID NO: 113247 - DNA, 1026 bp, Homo sapiens
gctgatatggcatattcacaaggtcatcagaaactcaggctgcttctgactttctgttccatcatcttagcacgtggcttatattctcaagtctgggactacaggcacgcaccaccacatccagctgatttttgtatttttagttgagatggggtttcaccatgttggccaggatggtctcaatctcttgatctcgtgatcctcccacctcggcatcccaaagtgttgcgattacaggtgtgagccactgctccctgcctaaatgtgaagttctaagggggaagaggaaaaagaatatttggtaagtacctagtagtttctgccataacatcaatatatcaaagagtcccatattcatatttccagccctgcactcttctccaagcctcaagaccacttactgtgcttggatgcacacttggcaactaaaacttaacatgagcaaagcattgcctttgtaatggagactcaaagatgaatgactgtgagttgagggaagaatgaggagtgagaaagtgaagacagtgaatacagtatagagaactctttcaggagttttgatagaaagaagagcagaggaacagaaaaatgggaagtagctggaggagaatgtaaaatctcaggagaattttgtttcattttataaaaagaataatatttcaacctattagtataataatgggagtggtttaggaaagaagaaatgaatgactcagggaaaggggaataattgtaggagtaaagtcctcaagaagacgggggagacaaaatacaaagcacaaatgagatcagcatttgatgtaaatgacagagaaagcagagtatgggggcacaacttataggcaagacggctcactgagtttaagcttcgataacgcactttgctccaaatacatgacaaaaatagatcaaatgtaaaaaaaagataagtctaggataaaaaataagacaaacatctcctaaatgaaaatagaacaaaaatgtcaaagtggctagactgaagtcacaaagtttatggaaaatcca

SEQ ID NO: 113248 - DNA, 1050 bp, Homo sapiens
ccatgcccagctaattcttttttttatttttagtagagacggggtttcaccatgttggccaggctggtcttgaactcctggcctcaagtgatccacccacctcggcctcccaaagtactaggattataggcaagagccactgcgcctggcctacttaaactctttgagtccctatactctactatgaaataaagctgattataacaataccctctctcattatgttcctgtgaacattaaatgatataaggtatttaaagagtttagactaatgcttcacaggtgctcactaaaagatagatgctatgattatctactaattaaaattccaaggagtatattatactgtcctagacaatgatgccaaagttaaatattttagagtggctataatgcatgcattttatgtctccaatgcacctagcagcattttgccaaacaaaactactttaagtttgataaatactttgcaattctcaaaatggtggcatagcattatctaaattggtcctcactgcacctggagaagggcaactgttatctcagtgtaatagaggtaggaaaagaggcttggagaaaagttgagttgaacatggctggtaaactgaagaacccaaagtagaatataagtttttattactcatggttgttaataagaatcatggagattgaaaacagtcattcgtggaattgttggttagcttaataattgccctaatcatgtctttgttttgaaatggaaattgtcttattttacttgccttgtagtaatatacctaagcatatccacaaaccacaaagaaactttgtcagttcatgtgctgtatgaagcatactttttcttttttctttttcttttattatactttaagttttagggtacatgtgcacaacatgcaggtttgttacatatgtatacatgtgccatgttggtgtgctgcacccattaactcgtcatttaacattaggtatatctcctaatgctatccctcccccctcccctgaccccacaacaggccccggtgtgtgatgttccccttcctgtgtcca

SEQ ID NO: 113249 - DNA, 1151 bp, Homo sapiens
tgtataccatggtatactactcagccataaaaaggaacaaaataacaccattcacagcaacctggatggagttggagaccattcttctgagtgaaataacttaggaatggaaaaccaattgttgtatactctcacttataagtgggagctaagctatgaggatgcaaagacgtaagaacgatacagtggactttggggacttgtcagggaaaggtggaggtgggggtaagggataaaagactacacattgggtacagtgtacactgctcaggtgatgggtgccccagaatctcagaagtcaccactaaagaacttatccatgtaatgaaaaccacctgttccccaaaaagtattgaaataaatttaaaatgagagcctttttcaagtgttgttaaatatcaaacttataatggctagagttgacagagcatttacctgtcacaatactaaacacctgagaggcatcatctctttcagtctcaaatctccatacaaggtagatgccatcttccttatctgtggatagtatcagtgtttattgaatagagtttgtgaggaacaataatactagtgataataatagctaacacttatgtttactatttgccagacattgttttgagcaccttacatatatgttataaactcctttattcttcaaatcaatcctatgagatagatactatgctatttccattttatagatgagaaaactgaaacaccaacatgttacgtgacttcccaaggtcacacagcgagtatgctaatgcctctaaagtacttaatgaggtatctggcatatatatgtgttcagcaaatgtagccaatattcttttcactggacattcatagtgttgtacttaagtgaagtattttaggtagactcagttagtgggttagtcccttttttaaagttttaatgatcacatgatttccagaaacaaattatttaacggttttgctttcaaaagtaatttcccttcactaggccttcatccattggcaaggttttccatgctgaaagattggctttggctacatttaatacaaaacctaaataacagtggcttaagcaagataggatttacttcatctcttgtagaaagagaccagaaaaaggaatttcaggcatagttcagtagggtagctca

SEQ ID NO: 113250 - DNA, 1721 bp, Homo sapiens
attgtattgaaggtaggtggaccgtgttaaaaaagaatcggaacagaagtgttcactgccccagcattttcaattggtataaatattgttgcatcagtgttattctgatgtaggtgccagatctaaatatgctgtactgattaaagtgtttgttctgccctctcccactctctttcccatttgcaattatttgctatttctgtgcaggtggtgtatcattggtgtaatactgcagttcttaggaaggtgtagctagggtcgtgagagatgatttttctggaggtgggtgatgccagagcctctagaggatccaggcaggatcgagtttcttctgagggtagggatttgtccttgatttagttttgacccctacaaccataggtatgtaaccaaatacattttacctcttgcagtatcctttggtttcgtatccttgaagagctgatgacctttgtgttttagagaaatgacaatttttaggcaattaaagacattggcctcttacacttcttggaattttatgttatttttactaagttcattaaggcattaagaggaagttgtcacattttctcaactacgtttattacatttattagttaaaaactaaatttcactttgtaattttgatttctagcaattctgggttaaatattaaatctaataacctagtagattggaaaaagaagtagcttgggtatagtaattagactagcatgtttaagctgcagtagcctacataatcaaggccaagtgtgtgtgtataaaagatctcatttgtgtagtcttacaaggctaatggaggcatcactgaggctttataaataatgtaagttgggtataatgtagagtctccagagacggcagagaaagcatcattaccagccttttcaacctgcttgagatcttaaattgatttacagcactgaactggtgcaaaatgatacatcaggatgacatggggtcagcctgtaaaagtctatgatgtcagcctattagttcagtcatcataattaaaccatattacaggggtagctaagcaggagtctggcgttatacttcagatatgggtggtacatgggttttgtttatagtggaaaggctgagatggccagggataccagtgtgtgtgaaagagggaaaaggcttacagaactatgaatttctgtagaaaaatttaagataaatgcagagatattcaatctgaattgtataagtagcttttcatttggtagaggagaaacagatgctttagggatgctgataaggacctttgcagctctgatatgtgtactgaatgcttcatgtgagtttgaatttaacttggccttagggaccttataaaatatcagtggaccacatacttaactttgatccttttattacccctgaattttcactgtattgatatctactgacatgttatttctttaactagtcaaacttaccaggcctataccagaaacaaagatatttgaattgaacatataaacagttcaggaaaagaagatccttattttgcttaagtttctgacaatccttatttagcttatggattatctagggctctgctatcctagccatagtcacacgtagctttttttgaaattttattattctatttttttgagacagggtctctctgtgttacccaggctggagtgcagtggcacgatcatggctcactgcagcctcgacctcccaggcccaggcagtcctcc

SEQ ID NO: 113251 - DNA, 1073 bp, Homo sapiens
tctcatggtctttcgggtgaaatatgtccatgggactgccaagtgctttcataaacattaagatttgtaatttcctttacagagaatagagatacttagtattaaaagttgctttaaagattttctaatctggttggttcatatcaaggtgaacagtctgaagtccagagaaggtaactgacatccaaagttacctgtctagtgattggaaaagggaaagccaagatctggactcctcttggcattaagtgcccttttgttttcaggttttttttctccctaccacgctcacgatatttctgaggctttggtgtaagcatatccagtgtaatttagggaagggaggaaagaattttttggcctgttagcaactttttatacctaacattgtttgagctaagtaggaatcaaatctgacaaccagagagaaatgcttattttctacatattaaaattgattctttttcattctggagatggaaaagaaaagccctatatctaatttaatcaatgagaccttattagaaaatgggagatccaagattgcacaaagttcaaattaaagcaggcaactctgacatctagcaaaatatacgaatctcctcttgactctcgaaaacaaatcacattcctaaccaaaagctaaagtttggggtatttagggagctagggagtcctagggagagaattggacaggtctgaggagaaaaaggataatttaaatataaaaaagtggaaaaaatcggttttaagtcatagcatgtctttgaggttgatgaaatgttctgctacttctatatgtggttttactctttggtaccaagattttaggacatactttgataacaaataggggcatgtcctctttgccccaatctgaaacctcttgaccctttattttcctttcctgctgttatctggtagtacaaatattcagtctaatctgttgatctggcatctgatttgcagcaaaaatacctgaagtattttcatcactctgctgtagccacctttaaaaagaaaaggaaagagaagaaaaaggcagagccaaatagtattaatgtaattgctta

SEQ ID NO: 113252 - DNA, 1012 bp, Homo sapiens
ttttaatgctttatttgtagtttccccttaattgtagggctgctgtactgtggatattttgctctacaatctgagattgttagggtatagttactccaactattcatgtattatcctctccctgtctttttgtgtgtgtgtgtgtgtgtgtgtgtgtggtttctttgtggtgtgcttatgcaaagtagaagtattccagacctttatagcttttttttcttttagtttcaaacacttcaagaaaaaaggtgggggggagactctctcaacggttataattaggcattaattaagccattattcagttaactaaatgcaagatcttttgtttgtttagatggaaaagaaacgtatctttttaatgaaggagggatattaaatgggcccttatttgatcattttgctgcagtattgtaataagtatatgcttcatttattccctgaatatttattagttctgaggcttaataattagagtatacacaaacatgaaaaattaaatgcagcaacattataagagccgttacaaggtagtataggagtaaattgtacagacaactcacatcaggaccactgtggcctggaaggacatgtgagtttgcataggcagaaggaagagggacattatagacagagtaatggcatgaaaaactgggagataagcatgagtgttgagtatctgtagagcagcactgtccaatagaatttctgcagtgatggaaatgttccacatctgtgctaatacagtagctgtagccacacatggaacagcattttttaaaaaattaatttatgtttcagtagccacatgtggttatcatatcaaatagcacagatccagaggcagtgagcagccctgcctgacctcagtgggtgttcctcatggagcctagtatggtggtgtggaggagatgctcagaaaggttgacttccagtgagaattttagggccttagagtgccagaataaggaaacattgggaagtcactgaaagtgtttgaacatgcagtttg

SEQ ID NO: 113253 - DNA, 1098 bp, Homo sapiens
ataaatctctggtaaaggtagacatggaaagagaaggatttaaaaataaataaataaataaaataaaacaaaaaaccatgaaggcttggtgattatgtggctataaagtaatgagaaagagatgtcggagatatatccttaagtttctaaacttggtggctggaaaactaataaagatgttacttaagaatagggaagagctggttgtagaagaaataaaaattgtgcaaatgataaattagacttgatgtgttaaatttaaggtgcgatatctaagtcaaagtatgctacaggcaggttggagataaggtttgggaggacttgaaagctttacgttagactctctgcagtcatctgctgggtattctgagacaaccacaaagagagaaagaactggtggattgaatcttccattggagcccacggttaggaattaatagaaggaagaggctaatttgaagtagactgcctgagaggctgtttgacatagaccaaagaagaaactggaagaaaggcatggggtcagaggagtgggaaaaccaggaagccactggaagagagattctagaagtaggtttggaggggaaaatgtacagttcagggtgaaggagaagaagtcagataatcatgtgaatgcaatttcagagaaggctgaatacattaagaagtgagagagtcttatattgccttaagtgacttgaattttaagatagatgagacctcttcatatttgaaggttgaggggaagaagtcagtggacagagagcaattggaggtgatggagttagccatctggagcacaagtgacaaatgttgaccgtggtaaggagggagagttgtctgagaaagaaacagaatggggtccgagtgagaagaaagcatgtggcagagctcctgtgcacttttgctgattttcctgtattgttggaggtaagtcctttcactgggatggtgaggaggaagatcagcacatggtaagggaagaagaaccaccgtaggtagtgtgccaggcaatctatagagaagtcaaattctaaacaattggggggaaacctggggtgaagtgtggtgaggctgctgtataggagactaggttaa

SEQ ID NO: 113254 - DNA, 1044 bp, Homo sapiens
ccagcactggactatgttttggatgggatagagaaaactgtaagtcattttctgccctgaagaagcaatctaattggtaagaggagattatgcatttgaaactttcacttcaaaatcaagggattggggaaaaaagtctgatgcatttgatagagctttttgcctctggcccacttctaccttactttattctgtatttattaattttttttgagacagagtctcaccctgtcgcccaggctggagtgcagtggcgtgatcttggctcactgcaacctccgcctcccaggctctagtgattctcctgcctcagcatcctgagtagctgggattgcaggtgcccgccaccatgcccagctagtttttgtatttttagtagagatggggtttcaccatgttggccaggctggtctcgaactcctgaccttgggacccacctgcctctccctcccaaagtgctgggattacaggcgtgagccaccgcgcccggccccagttcattctttcagcaaggttttgagtgtctgtatttctatttatgcttatgttcatagtgtatctcttagacagcttgataaagttgggggtaaggaattgtaagtacaggacctgcactgaggatcttctaactttaaggaacaatacaaacctgcttgtctagtctagcatctgttgtaatgccttttattacaattaccttattaactctttagactgagttcctcgagggtatggccagtgtctttatgatctttgtgctcgcacagtgcctagtgcagtggttctcccttgtctactcatcaaaatcgtgtgaacagctaccaccacaaagatgcctgggcccatcctattgaagggttatggtaaggaagcttttaaaaatactgttaatatccagcaacattaagaacggttgggctggcacacagtaggtacttggtgaatgaattttttcattttgttgtttttagaattacatcaggaaatatggtatgttgtgagttcattgtagttatgaaccatgtcttttatactctgtagcac

SEQ ID NO: 113255 - DNA, 1017 bp, Homo sapiens
tatctcattttatatattcagaatattccaacatccaaaaatacctggaatctgaaacaccatctggtcccaagcatttcagataagggatactcaacctgtattcctgtacaggaattatggacatttagtccataattcttggactacttctcctccagtggccttgtctttggtcctacctcagatattcaatctctgggtagaaagattccataaaaaaagaagaaaaaaatctcgctcagtcttacagttcccataatacgggttttcatacttctaaaaattaaacaattctccaaccttacagttaattattttctttatataagcagtaaagtattatttgttcatgtctgtactttgagaatatatccagaatctgacgacttctgccacgctggttgaaatctttatcatcttgtaccttaacaattgccatagcttcctaactggtctccctacccaccactccctacttcgatccctgcgtccttcagtatgttctcaacccagcaagccacagtaattctattaaactctaagttggatgatggctctcctctgctcagatctcccagtgtttccatctcaatttgggtcaaaagctctgaagtctctgtgggtcccgcacataccttcccctgtgacctctctggcctcatctctcatttctctcccctcactccattccagcctcagtgaggactccttgccattccttgaacatctcaggatcattcttgccaaatggctcaaatggcttttgcaattgcccttctctctgcttggaatgcccttccccagataattcctttcagggggctgttcagataccacattcacgacgaggctttccctgaccaccagaatgtaggccccaccaaggcacagaaacagactttgaaaaactttttgtgtctctttcagtgctgcgtttctagtgcttagaatagtgcctggcatgtgatagctgtttgttgagtgaattgaataactgtagtggttactagtttt

SEQ ID NO: 113256 - DNA, 1033 bp, Homo sapiens
catttaagtaatagttatttcagctttatcaaaagtttgtaagttcccagttcttctggacttctgattaattcagcctgattttatttagggcaaatgattatgatcccctttccattttgtgaatttttcatattttaccaataaatctcattgcaattctttgcttacaagatggcttgaaagatgcaagcaatgatggattgctctttattgttttaaaatatttattggccttaaattgctgaaataatatggtttttccaacctttgtgtttttatgcatttttaaccctacgtctttagtgtataatcttctgtgagtctgtggtttctataagtgtcaggaatttttcaggtgtctttattatcctttgaaatcatgatctatttggacaattccatctttgtttggactatacagttgacttgagtacctaagtgaaatggagcaggttagaaaaaagtagtttgttttatagtaatgagaattacattacaagtcccctggcatgttcccctttgaccttttttgatgttttaatttaagcatctcaaacaaggcaagagttgatctcaccaggccttgaatcctatccaaaattggatgttaggatagatgacacatacatttctgtaatactaattaatattgccagttaatattgatcactttctacaacatgtctctgagatatcttgcatctccatggcatctaatgaggtgtattgtgaaatagtttcatatattaaaaatactggaaaataatataaaaaattagctgggcgtggtggtgggcacctgtagtcctagctgctccggaggctgaggcaggagaatggtgtgaacccaggaggtggaggctgcagtgagccgagatcgcgccactgcactgcagcctgggcgacagagcaagactctgtcaaaaaaaaaaaaaaaaatgctgaactacaaaattcatgcagtttgcttataatcactctgaagcccaccataggtctactctggaagctcaagtcttactttttctgt

SEQ ID NO: 113257 - DNA, 1053 bp, Homo sapiens
atgttaagagaagctcactacaattgctggataacaagtaagtctttaatttaaagaacaaatacactgacttaactaatgaagatctgagaataattttgcagttatctgtttagatctttaatacttaataatttttaactgatgatgaaaattttttttttgtttttttttgagacggagttttgctctggtcacccaggctggagcacgatcttggttcactgcaacctccacctcccaggttcaagtgattctcctgcctcagcctcctgagtagctgggattacaggtgcacaccatcacgcccgactaatttttgtatttttagtagagacagggtttcaccatgttggccaggctggtcacgaattcctgacctcaggtgatccgcccaccttggcctcccaaagtgctgggattacaggcgtgagccactgtacccagccaaaaagagtatttttaaatgaacaaaatggtatttagaaacaataagtataacagtactgaagtagagttttcactggtgatttccaaagttggaagttggtataactgggctgtccaaaggctttcttctgtaattaggatagatacacataaaccccgtctgtttttcagctcttatgtatgtgcaactacaactggaacaaactaatagaatttcttgctatttgtttctaactttgttactaaaaggaattgaggcacaagtttttccccttctcagcctgaagaacttgcaagcagaaatgaaaaatttctttccccctttagtaaagggtgggtctttgattccagcgctgtatatatccttagcagtgaccgagtggaggatgccatcattcttccagctctacataggcaagtaggatagacttaagtgagcagagaactcaggtaaataagttcggtagactctctgagaaatctgttagaatccacagccaccctggcaaataaaactgctcctaaataacctctcatgaaagaaagtgctttgctgctgcactcaacacatggcatgggtcatgcaatttatataatgtttat

SEQ ID NO: 113258 - DNA, 1007 bp, Homo sapiens
agtaattggagaaaattgttctccaattttctccaattaggagaataaggagagtgtcatattaagaagtacctgctttaaacatcatagaaaaactgtatacattataatagcaattgcttttccagtgtcttcattccatgatcctgagccaattcaacaacacggtttcagtttttgagagcctgaggcactaaccttggttgatataacattttctttcctctagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggtgagtttttgctttaacctctttcagatgtttatctgttgtgtccctgttcctccagagctgacttaaaatcattcctgtaacaaactgttgtagcaaagaccaggtaatgttcacttgctgcagtttgtaaatatttttccagtttctgctatctggaagctcttgcagtcagtgatttttgtggtcgatcaactcataatattgaaattaattagttgaaattatgatttgccattttaagacactattctgtatgatattttgctgcagaataaattggctgttataaaatgaatcacaacctaaaattaaaagcaaattacagttaattgcttaattgtatttcaaatgaataccataactcagtaaatagaaaagaaagaactagattttagcacaaacatcgtgcaaggtggcacgatagaaccctgcagtgattgtacccccacagggacaccaaattgaacaactgtccatataagacagcaccttcaaaagaacaaaaaatcaggcatggatatatttataataagaaaaaataaagaccaaaaaa

SEQ ID NO: 113259 - DNA, 1020 bp, Homo sapiens
taaatacagacatacataaaatgaatttgcactcctaccagaaatatatgagtgcctttctcccttcatccatgccagtattatagttgggcattgtgcctattcaaatgatatgattatttatctagaaacctccaaagaatctatcttttaaaaattatgtaagtcagtttcctttaatctggtaataaccagttagaaatataatgaaaggggaaatatccccttcccaatagccacagaaaacatcagtttcttggaaataatctgaacctgcaatatgtgagaattacatgaagaaaccaaattttactgagagaaagaaaatttgaataaataggcagtctgtgttccttaaagggaaggcttaatattgtgagaacattttaagcatattaattccatctaatttaatttataatttaaaacaactcttttcagaatcacaatgtgatttttttgaaaattggaaaatgtattctgaatattctgaatattacctggaaggataaacaagtgaggctagctaactttgtaaatggaaaagtaaagaaaaaattatcggcattagggttaataaaacattgtaaaactacaagtaaaccagtgtgtagacaaaacagaatgagttaaactcagactatactgttataaaaatataatgtatgttaaatgaagcatagcaaatcagtagagtcttctaatggttctacaataaccaagttagcgtttgggtgaggctgggaaagagaaaccctgacctcataccatatatgcaaacagattaatgagttgaatgtttttcaagagtcaaacaattaaaaagctagaagaaaatatgcttgatcagagaggtggaaattttttaagcataaaaagcaacaaaagaccataagaggtttaactaagagattgcaaacttctgtaggttaaaaatatgtcacaaataaaattaaaagacaaaggactaacagggaagcaaataagaaagtatatccttcttacatgaacagttcatta

SEQ ID NO: 113260 - DNA, 1096 bp, Homo sapiens
gaagaaattgaatgtcattctgtctagcatagcttttttgttttattttcttgatgataaaatgagaatttaataatagctattacattactatcagtaatgggcaattaaaagttttaaagtgtctttattaagataactttataatgtattttaaaaccttcattcctcaagaccagcaattcttattggaatccatggatggaccctggggagctaacatccatcccttgaaattgcctgcgaaattatgcgtgcgtttgtgcatgtgtgtttttttctccccaggggcgggggggtcagggaggaaagatgcatagctttaatcagagtctttggttatgtgaactcttcttacttaataagtttaaccactgagttaaacaagttaaatgacctccagtatgtttttcctagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttc

SEQ ID NO: 113261 - DNA, 1741 bp, Homo sapiens
ccagtcacctctcaaaagtttcacttctcaacaccattgcattggaaatgaagcctccaacacattaactttggggaacacattcaaatcacagcaaccctgcatgctttcttctactctcactattatcgtgataaaataatttattttttaatagaaagatttccaacatacagatctgtcccacatgtatctctttcaaggatttataaaattaaacatttctctttcaatagatcattgagaggattggggactataaatcacttttaattttaaaaagtatttttgacccttaaaaaggttttaagttactcatcttcacaattgtttattttgactgtcgattatgcttaatataatgagattaattttcaaatttcacttggtaaatagagttcatagacctttctttccagaagttgcctttttaaaaaaatgacttttatttaaatgttttttcaacctttatcttttacagtttttaacttcatgttacttctaataattctgaaaacaattattccattttggtataattttctaaactcacaggggaagtctgattttcttttcttggtatgaacataaagggaaaatcaaatgtgatggcatggtaacaactaatcgcagctgatattattaaactattttatggctattgtcaacatccctgtgagatagatgctactgttatcccattttacatacagggaaactgagactcagggagattaaccaatgtgcccaaatgttacatgatagtataaaagtctggctttgagctcatgtaattgacttcagtgtccacatacttaatcattggtgcttacttttctgtgaatttactaaagtaacaggattatttcagattccctaacttattatgatagttccaatttcagtgttatctatacataagatgtgatgaaatggcaccatgttggcaaatgtttcgatgtagcgcacaatttcaccacatgatggtgccagtgaagtgagaagtcatctgctgctagtatttgacattaggctcagacctaaatatgtcaacagaatgtagtaaaagatgtttaaaaatttttttaaagagcaatcataaataattatagactagagtgtcttttgaaaacataaggaatgaaaacatcacaaatacaaaaagggtaagagtaattgactcataaaacttaaaaataaaaaagatgagcttttgtattcataaggaagtatgtaggacagatgtcagagactttccacaggaaggaaaacaccaaaggaaatgaattaaatgagggcaggtgacttaaaaaaaatgagaccagctgtatagtgatgtagctccagggtcaaatggttccagtaagattccacaatcagtgcaaacgagttagcaaaagccaatgactaaaagatttttaaaaacctttaatagacattactacttccttttctaatctaaaataagtattatttttccctgcattatcaaagatggaaacaacaatagaaggaagaagcattgcttttcagaaattattgaaacaaatccttacatgtcattattacagtgattctccaagtttggtccctggaccagcagcattgacatcacctgaaatgttagaaatacaaattatttggccacgctcagacttttactgaacctgaaacttggggaatgaggcctttcagggcttttggatgcacccaaaagttagggatccactgtgttacttat

SEQ ID NO: 113262 - DNA, 1034 bp, Homo sapiens
tggagagtcactagccaatctgataggttcatctcatctcgatcaggaagctctagatcttcaaccttttccatttcaatggagaaagaactagtagtggaatggctgttacacttttgataacttggtttttcaggaacttcctgttgctgactcttgaggagcaagttttctaagccctttaggtttccccagacattagtaaagaaattgcaggctctggaagaagtctgtctattctccaaggtctgctttttggtgagccagtcctgggggttggtgctgggtatgtaaggagcctaatgaccactggcaggtttgcttccaaggagccatttgctgagagggatagctgcaatactggatgctgacttctgctctggcatagggatatagcctcttctccaggaagggcccaatatttgatgaactagcataagccatcaagtgctcagaaatttgaattgttttgagagacctaaatatggtgatggtctggcacagagcagttgtgtcagcttcaaagagtaggacatttgaatcttcatacttaagggtcaaactgcccagtctctctaggcacacagagacttgattggctagatctttgttttgggtacactccagttgatgaataagacaattgaactggcctgataaccagtagagctgctgagcctgctgttgaattgtctcctctttaagctgatagatgaggtccacctgttcatttagtcacacctcatggcttctaagacgttccagatgacgggttatgcaactgtgaatctgagctttgacctctcgcaagttatctttaatttgctgttcagcctggagaactccaccaatagcaagctccaagtccctccgtgcatcactacccctcaaaaggggttctctattactggagctgccactctggtcttggaaggtattcattctgctcacagctccaggtcccagtgcctctctggggcagtcggaggggaccttgggtggactgagacacggccccacacaaacctagggcc

SEQ ID NO: 113263 - DNA, 1035 bp, Homo sapiens
tcactcctgataactaagttcataacatatttaaccccatgaatttatctaattaaccagattttaaagcagcccataaattttttaagagccaatataactcagccttgtatgagcagctttctacctttatatactgtcacaggcagaacagactaattccactaaaatggcaaaattatgtaagtagagagaaggattatttcctacctgctcatgtaactcagcatcttttcctgctttctcatgggaagaaatcaaagaactagatcaataatcgaatcagctttgggccctaggtttgtgtggggccgtgtctcagtccacccaaggtcccctccgactgccccagagaggcactgggacctggagctgtgagcagaatgaataccttccaagaccagagtggcagctccagtaatagagaaccccttttgaggggtagtgatgcacggagggacttggagcttgctattggtggagttctccaggctgaacagcaaattaaagataacttgcgagaggtcaaagctcagattcacagttgcataacccgtcatctggaacgtcttagaagccatgaggtgtgactaaatgaacaggtggacctcatctatcagcttaaagaggagacaattcaacagcaggctcagcagctctactggttatcaggccagttcaattgtcttattcatcaactggagtgtacccaaaacaaagatctagccaatcaagtctctgtgtgcctagagagactgggcagtttgacccttaagtatgaagattcaaatgtcctactctttgaagctgacacaactgctctgtgccagaccatcaccatatttaggtctctcaaaacaattcaaatttctgagcacttgatggcttatgctagttcatcaaatattgggcccttcctggagaagaggctatatccctatgccagagcagaagtcagcatccagtattgcagctatccctctcagcaaatggctccttggaagcaaacctgccagtggtcattaggctccttac

SEQ ID NO: 113264 - DNA, 1030 bp, Homo sapiens
tgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggg

SEQ ID NO: 113265 - DNA, 1069 bp, Homo sapiens
gatgcagatagctacctggaaacctcgttcctttggggtcttgctttcatgattctttggcgggtctagatcactaggcagtgatttatctaggtttaacccactactaagagacctttcttagttttctacctaatgccctgtaaattgtgtttttccaatctgactggtggaaacaggcattatttctagccctctctaagtgccgggcactgttctctaagcttttcaggtggcttttccccctccaactatgggtagtctcttcacccccgtgctctgatccatactttgctgaatactcaagggggaccctctctgtgtctctggggttgttcttctgtgctgccccttcctctctgatactccgtcctgcaaaatctggtcagaccctcagctctgtatccgccactcggagtctgtcaggttccacctggttccttctctctgcaatgaagcctggagagtctcaaggcaggaaactgatcagtcatatggctcacctcttttgtttcctgtctctcaggggccacttttcttcattgcctaacatccagtgatatgaaaactagcatttggtatattttgtctgatttttttcagttgttagtagtaatggtaaacccagtccctgacgcgctctcttgagtagaagcagaagtcttctgacactagattttaatggtctgctgacttgtttgtatctggctttgagggagagggtcccgagtactgatgaagagcatggaccctggagtcagacgaactcaaacctcttctccaccacttcccagccatatgatctaggccagattaacctttctgtgactccattccctcatcgtaaaatggggctgataacagttgtgccacacaggatttttgaaaaaacaaaatgagataatttaaagtataatacagttcctggaacgtggtaacatgtttagtatgtcttagctattactgtcgttttattttaattcatgtaagaccttaataaacacttgtcaaattaatgaatgcctgctcttggcccccagtaccacaaaggaggtaggtgccttaggac

SEQ ID NO: 113266 - DNA, 1041 bp, Homo sapiens
catcaccatatgtgacagtctttcaatgccccagtcttatgcctttgcacactggctctcatttaagccccatagcaaccctctaagtgaatactattattatcacactgtacagtacaggtgaagaaacaggcttaacagaggtgagatattccatccaaggtcagcaactaggggttgctgtggtcactagtttcagtcactagttcagtagtcactagtttcagtgactactgaaactcagcccagaacagttttcattccagagcttgctctctgtatcattgctgttctgacagccccgagaaacacttggcagagctttgaacctttctgttttcccatgccagggcactacacacctacttctgtaggctctgttcctctccagtgaaactgcagccctgacgctctccttaatgacgcatggcatgtgtgttcgcggccaaagaaaaccagattctcctgaaacaaacccatcactgtctaggccatggccaaggcttcaccagtgctcgcctgttatttaagcttcttgccattctggttaacttcttccatttattgatgttaacattctgacttcaccatgcaattatactctcacaagtgatggttacaaatgataccagcaaggagtcattaagtgagaatgaggaggagctccgtctgcatttgcggggcttacaaattaagagctgatgttgctgattgccagccctgggtgttgggtcagcccctcacatcatcagcacttgaaggattcgggaaggggaatttccctgacagttgtgctgacgatgtacacagcagaggaggatctctctgtgtttctctggccactttggctcagtggtgccaacagtaataaaagcttgtttttgtcagtaaattgagcagctatgacttggaggtctgcagagagccgttatgccaagtgagaaggtgccatttttacagtcagttgtctgactgtaaccacattagcctgtgggcagcaggtgagctgggaaacccatgttgaagacaaattaaattcag

SEQ ID NO: 113267 - DNA, 1010 bp, Homo sapiens
ttaggaaaactttaacatgttcaaaaaagtggagttttataaggtcacattctctgagcatacttaaatgaaattttaaataagtaagggtcaataaaatgtcctgcctaattggaccaaagaaaaagggagaaaataaaaattcaaataacagacatctaaaaggaatgaaatagagaacacttcatacataaacctggagcaaacagcaagagctctagtcagaggaaaatttatagaggtaaacattttaattagagaaagacaaaaataaaggaacttaatggtcatcttaaggaattgataaaacaacaaagtctagaaagaaatggccataaaatagataaatcctgttaagcctgattaagaaaatgaagcaaaaatactcaaagttaggaatgaaaaaggaaacctaatcatcaatgtggaagatgttaaagaattattggagaataatgaagctctaagaaaaaaagctgaacacttagatgacatagatcatttaaacagaatgactaaaattgacccaaagtggggagggaacttgaatcagtcggttcccaaagagaaattttggaaaaattatgaaggacataccgtttataaaggcatcaggtccagaaattttcgctggtgagttctttctaaccttttgagaagaggaaattccaatgttattaaacctttccaaatgatagaaaaagatttaaaaagctccacagtttcactttatggaggatgcataaccttaataacaaaacttaacaacctcacttattcatacaaacacaaaacttctaaagaaaggacacattttatctggacagtggggctcctcccctgaccctgctgagcccagatgccagcccttcaagatgttggggaccacctataacaataatggtctcatattttgtagagaagaacttttttccatgttcttctctgtgaactaaagaagacaggtatttcctttaagccaggcacagtaataccaagtaagcattaag

SEQ ID NO: 113268 - DNA, 1017 bp, Homo sapiens
aatactgaagaattgacaggggtcggaatccacttgccaccgcagctttcaagaacggccttcttagagacaggaaatgagcaggaaaaccagttacggagactcatttgcaattactagccacattcttcagagagaaggctctgctgaaatcctgaatgttgactaacagaaaatgtattcttgttgccttatttctcatgatgctttgttcttttgacccagaaacagaaaagatagtcctagaggcaggaaatggattaccatcctggaaattcaatgaccagctttttccctgtgacgtgtgtgggaaagtgtttggccgacagcagacattgtcccgacacctctcgctgcacacaggtgagtgagtagggcctgggctgtcagccctctatgctccatcaccaacttctttactctccggaaactgagtttctctaagagaggcattacaggaagtgctgggaatggctgaccttttcaagccattttctctggcatgtttaaagaagaccttggaaaggcttttttatttgtattgaaagggttcattgagttccaggtaggaccgatgagaaaatatacacaatttaggtttattcaggtaaaattcctaaactctgttaaaaaaaatgtattgagttcatcttgaaagtgaaggacagggggacacactccatcttactggttttatcttattgttgtgggtgggagcagccagggaaaaggcaccttggtggagaaacagcttctgcctttatttatgtataattgtggagaaatatggttggttctgagagttgggaaagggaaggcaaccaagttaacaaggaggaataaatagtaacttagtccacacagcaaaaataattgaagacaaaaagacataaggtaaaatcagtagtaaacataaagcaagatggaaataataaaatcaaacatttccatttttacactgaaatcaggtttttaaataatccagatatatcttatttacagggaacacaaaaacaa

SEQ ID NO: 113269 - DNA, 1002 bp, Homo sapiens
gatgttatctctgacccatgttgtgagcattttctttttttttttttctttttttttcttttttttttttttttttttttgagatggtgtctcgttctgttgcccgggctggagtgcagtggcacaatctcggctcactgcaacctccacctcccgggttcacgccattcttctgcctcagcctcctgagtagctgggatttcaggcgcccgccaccacgcccggctaaatttttgtatttttagtggagacagtgtttcaccgtgttagccaggatggtctcgatcttctgaccttgtgatccccctgcctcggcctcccgaagtgctgggattacaggcttgagccactgcacccagcgtgagcattttcatctgcgtggattaggagaagttcttaccaccattcaattatcaccacatggtgtccagttctataatgcagtactgagctttaaggagatttgcaattatttactgaggtaaaagacaagatattaacttagtgtgtcatttgtcttggtcttcaaagtgaggtgaaaagcctatcagtggcccattcaagtgtccttttagaagtgtctccttctctctttctggtgttctctgtcacctattttatgacattatcataggaggaatgtttgtataatctggtacagttccacaaaaagaaacatggattagaaaattaaaggtaatcctagggataagaatgagaaaataaaaactctttaagatgattagagaatgtattaaagtccatttatttcattcatggctatgaattatgggtagataacttgtggcactgttttcccaaatatgagacctttgggggaaattctggttcattcttgcattagggaattttctgtggcacagcgtgtggtagttatcactgattctacttagcacaaattcctcattaaggattttgcacaaactggaatgaagagcaaagctttcttcttaaagagaatgaaagcatatttcctttcaa

SEQ ID NO: 113270 - DNA, 1616 bp, Homo sapiens
agaagtgatcaaaataccatatgtcacaatggaaaacccaagcggccccagagcctcttcttcagtaatgagatttagttgatctgaacagttatttatgcattgaggtcatattttggccaatcttttgcttacagctgtcgccaaataaagccttctgtcttagcatttcttttaccaaaatcaggttgagagatggttctttgagaggactgttttgtcagggaatacagggatcttttcacacagtaaaatgtgcccacaaagccaaacaatacaccaaatatagggtcaaattatgttaaaattgaaaggaaacaaactaaagtctttttctttgtccctgttgttttttgaggttttgcttatctgtttgtttgtttaattttaccaaaaatgctccccaaatggcaatgaaaggttcaagggaactttcttcagtaataccatgtttacctcagagaggattggctgttaggacttccctagttgatcttcctcttgttccttctttattgtaagttttgacatattacactttctaacatctctgtgcctggaaatattctaggcttatacttttaataacagaaatggagaaaagtgctagtgtctggattgttgctaaatctgcacatgtgtaaccaagagtattaaactcagagccaaagaacaggaagagaagaaaaatccctcctttgtttgtttgtagactttggcattgatttcatgtggcttggaagagcttgaatgacaccgtgggtctgtctctgctctcccagagtcactagccaggttacctggggtaattacttaggttctcttggcctcagttcccttatatataaaacagaaaacattgaacaagatgatcgttcaggttcctccttgaactaagatttggggcaggatagagacttagttactgtggaaactgttgcccaaccttgggcaacagttgtgggttactctggggcaggagaggtcctggaatataatgcttcatttttatcctcctgaaaatgaacaaattggatctgaagataactgagtgctctacttgataataatgtattgtcaagcagattttgatagaactccttcctaaattctaccgaatgggtttaattaaggaaagtttttggaggcatgctggatgggtttcatcttcccaggacctacgcatgaaatgagacatgtccccttgaataactaggttataagaagcatagtttgctctattgtattttggccaactagtcctcatcattatggatgataggcctcagttcaccattaacaggaggagctgaaagccttgttttgggattgctaagatgagatcgttctccttacactgtgttcctacttttctagccatactgtaaggacaaaagtgcttaatcctacacacctatttgcttcatttaaaacaaaaacctatataaggaagaggaaaagcccaaatgacattcaaggcaaacatcataggtggaaaagtagagaaaaaacatctgatcacataataccgagtagccaggaatttctggaagcaatttatggttatcccagggatcagaatataagagtgtgaaatgaaataaaatgctttataa

SEQ ID NO: 113271 - DNA, 1256 bp, Homo sapiens
ggcagccatgtgcccagctaaaactcggggggttcctttattaaaggaaggagaaaagtatggatgttggagggcagctagcagtctctgctcagatgtctggttttaggttaattcttttaggttaaaccaaagactggttaataattccaaatggcctttggtcaggatagagttcacagactgtgacagtgtctgtgatggcctgttattttactctattacattcatcctgaatagtcagccttccgtgccagacttccttatttgtaaattgccagtaatacctaactcataggcttatggtgaggattaatgatgtcatatatatgttacacactcagaacagtccctagcacatagtgagctccactaagagctataaatattattgttatgggtgattgctgtgcccgactagctgatttgagccttaacttattcagcacacaaatgtctgttaatttcatttggtttgtaaatctcaatatttgttgctctgatctaatttggatttgtagccacaaccccacaaccccaataaagtatcaaaacgggagatctgctttgaatatgaagataatgctaaattggaattgatgtgggcacgaaccagtagactgccagcttcttacatcagaacattggtggccaagctagaaattcagtgtagttgtcaactttagataacattgccttgcattcatctgtttttcaacaatgtcagagatttctggtttggtcccatagagatcattaaatttgtgaacattctttctttacttctcaataaagacatttacaaactcacagtggaaaaagtgcaactcagatttacaaatggcagtagctctcttaccttttacattatttcagatttcaacatcatgtagcggataaccttccctgaaattctgcctcatctgttctaatatttaacatggctaaagataaggttagaacatctttttaaaaattattattattgttgttattattattattgagacaaatcttattcttgtcaccccggctggagtgcaatggcatgatctcggctcactgcaacctccatctcccgggtttcaagtgattctcctgtctcagcctcccaagtagccaggaatacaggtacacgccaccacacctagctaatttttgtatttttagtggagacgaggtttcaccacattggccaggctggtcttgaactcctgatctcaggcgatctgcccacctcagccttccaaagtgct

SEQ ID NO: 113272 - DNA, 1024 bp, Homo sapiens
agcttaataattatggttatacacaggataggtctttgtcagagactgctaaacatcttgtacaacaatcttgtgtaaacaacagtggtcaggaaaagactccccagaaggtgaaattccaacaaattttggcagagtcatttcagaaacgttaaagttacacatcctgtaagttattaataaagatgtgaaatccttgtatgaaatacgactatgatcacagtcatttccatttggaggttcacgaagcttactcaaggaatgattgaagtttgagggtggttacttatttttaaccttgcaagggagattcatgaattaaattaatcttagggcaccaggtgtgatagaagaactgcacgccattttctctatcttggttgttgaaaatagagtgttcaatgggacagtctgttgtactgtctcattgcatcattggtctcataagtatcagtgacttaggtataattaataaaataatagctgccgtgggagggtattttcagtcgttatatcaaaatgtataataagcattctaatttctgttatatctgtttaatttcctaacaaaggagttcagttagaaaaaggatatcagtggctcctgacaaacctgtccttaactttccccttagattattttcattcttctctgccagtgtcgaagaatacagagatgttgcagaatgaggattaaattaaaaaaaagatctgagtatcattaaatatttgatgagcagtatgagaagattgtgaggtgtgcatatcactggggtgaaaagaaagttcattcattcatggcccagcacaatgtctcacacctgtaatcccagcactttgggaggccaaggcaggagtattgcttgagctcaggagttcgagaccagcctgggcaacatggcgaaaccccatctttaccaaaaatacaaaaaaaaagtagctgggcgtggtggagtgtgcctgtgatcccagttacttgggaggctgagatgggaggatggtttgagcccaggaggcagaggtt

SEQ ID NO: 113273 - DNA, 2044 bp, Homo sapiens
gtagtgactgggatggggatgagaagggcttttaggaagctggggcattctctttctttatctgattactcattatgtatataggtaattttgtgaaaattcatcaagctgcatacttatgatagtatttctgcatttgtcaaggctaattgcttatttacaaataggtaggtctagatgccaagtggacaccttcaggctaataggagtgcacatttgcttcagactatgacagtgataatgatgacaacagtttttcaattatgccacttctagtttgcaggaacatttctatttgtaacacaaactggttgccctaaactaatgacatgtaggttgatatatcttctcctgttgcatttcaaatccaaaaactattccacactgcttatggcacttctttgatgtacttgcaggagataagctatagtctgtgcagctgtttactagagggagaaagtttcgtagttatggattttcttgatccagacaatgttacttgaggctaaggattgtgtgctccttgttagccccatctgtcccccaccagcctagtttggtcttagagtataggtgtatttcaaaggggagctgttgactctattagaaactagttgtagagaaagatctttcattaggcactgtcagctatgtgtctgagttagctcttctcagtaattaactaattaaattaagttgtcagcccctatagaccagcatttataggttcacacactaaagtacacgcatacttttttaagggtggtaacctttctaaaggagaaatgtgtatcctgtttagatgccttacctgaagaatctgtagaaagccacaaagataaagaaacaactgtgattgtgtggccacgcccctttatctctgcccatatggtttgagtctgcccagataggttgagtcacttggtattaaaaataattatcaacactttcatgtttgtgctttgtgggaaatggtaacatccgaaagcccttataaaacccagatccaagtcaaatgtggtggcccacacctataatcccagctattcaggaggctggggtgggaggatcagttgagcccaggagtttgagaccagcctggacagcatagcaagaccccatctcaacaaaatccaaattccatttgaggactttgtttctcaagtataggttatccccagggctgtggccactttggccttggcctggtttcttcctctgaacagagcaaatttatcaaatttatatgtgctcacataatattccaaacaccctttataaggcctcagcagtgcctgtggttgcttttttacttttgcaaagactatttagatgcctcgagaatgaatagtgctataaaaggccaaattcttgagtatgtgtaatggatgatggagagtatttgtttgaaaattgcaatgcagtgaccctggcttcagtttgggactggctaattcaatctacaaggccttttctgtatatacaatatgttcttccattcctttgctatcaaaaatacatattctcatttcatgcaatttcttctttgtgtttatttcttttcagggcagcaactgccctctggtaaccaggatagaaaaaagaaaagtaattccactcataaactagaccatctattttcattcaaacaaatctattctgtattctcttacctaggccaaatgagtgcctctctgtggtaaagaagacactcccacatcacaccatggctgtctcctgatgtagtgataggaatgatggtccaggacttcatttttcattttctgctattctctctcattcattgtgtctcttagcaagatacttagcttttctattttcactttatcattcagaaacaaaagatgttcactagaaatgcaaaagtgtggccagtgtttgcattcgcatgatatgaggttcaccacaccatccccagaagttccattcagacatcccacatcaaggtccctggagctctttcagtccaaagggcttcaaactgaagatgtcatttcccctgcctcccactttcttcatacca

SEQ ID NO: 113274 - DNA, 1051 bp, Homo sapiens
gaattatccacaatttacaaattactacctggaggtgtagagagatttaataacttgttcaaagtcatacagttgaggaggggcagcacaggaattcagacccagaactgcacagcacattttctctctttctgccctatcttgctgcctgctaagtcagataatatgtcaccagacactgaccaaaaggaacacacctcccagtgttgcccacatttaccgcagctgttggcattttaagtattactgatgcaccgtcttcttttagctagaaataaaaattagtcctttaagtaagatacttgaaataatttataattacttactgttgattaacagaattctaattgtattctcttctatttctatctttcctctcttcctttaatgctttgatatctagtaatatcatagtcacttggaacatttctttcagttaggatgtcagtagtttttaatggatcatctggttcatagaaatggttttatgaagctgtgttaaaactctcagttagataaaatatgtattgctgagtttagtgatgatctggtcagcagcatagaagaaacatttctagactgggaatcaggagaacttgggtttggtcctagcccagtttcctatagaaagagatgagaaggtctacaagctccttgcacatcccctgtattaaaagttctgtcatcttgatatggtttagctctgtgtccccatccaaatctcatcttgaattataatctccgtgtgtttagatcatggtgatggtttctcccatgctgttgtcgtgatagtgagttctcacgagagctgatggttttaagtgttcggcagttcctccttcattcactcacccttgtctgcctccatataagatgtgcctgcttccctttccgccatgattctgcttcttgaggcctccccagccatgcagagatgtgagtcaactaacctcttttcttcgtaaattacccagtctctggtagtatttttatagcagtgtgaaaatagactaatacacatctgttatggcactgtaattttagcccagac

SEQ ID NO: 113275 - DNA, 1122 bp, Homo sapiens
agcagccaggaaacttctgccagttgctaccttccctcccagctgtggagaggatctcagcagcactcggtagcctccatccacattcatttgtccaggaaaccgtggccacctgtgtgcagggcagtactcacagcagggttgttggccccgcagcctcttcaaaaataaagtccaagtctcctccacatactcaaggagccctgttttacagggcactggagaactaattaatttgcaatgcagaaagaatgcagtgacatctgaaatattggcctcgggtatcacaggtcattggaaatagtttgtgacaaactggggtggagggtgggggtggggaaggcaactctttgtcattcttgagtctcataagggtagttccatttcttctcatctccccacattcagccaaagaatccagatacctgcatgctttttagctttgcaggcagggcttttctattcaaacaccagaaataatgtgcttacacaaaaacacattacataatggctggttctagaggtggaaagaaattttgtctagtttatgtcttcatactcaaacaggggttcttggaactactgtttacttcccacagtgtcattttgaatagccatctccctggtcccaaaattattgccctgctgttaagttgatggattgtgactttctaatgtcaaaataactgcccaggaattgcctgtcagaatgctgtgacccatacggccagcatcccatgatatatatacaaaccttgcactgctggctttatgtttggcttggcagtatttaaagcagggtttattggtcaagttaaaacttgacctaaagagtgatttcattatatgcttaactgtgcatcggggggttttccgtgatttgcttgataaacttacgttagacattagatgaactcacactttaaaagcttaactcttatttgggggagaaggtcagcataactgagatttttaaaatgtaaattcgccctgctgaaagataatcaatctaccctacttcaccaaaacctttctttaggtagagaaaagcaaaatgactacatttacattttgttaaaataagcagctaaaaaaaaaagactttttttgttttaataagca

SEQ ID NO: 113276 - DNA, 1086 bp, Homo sapiens
ggtttgtggctgcatcactccagtctctgtctgttttcacatggccttttccactgtttctatgtcttgtcctcttctgtgtcttattaggacacttgtcattggatttgggacccacctagataatccaggatgatttcttcttgagattcttgacttaatcacatctgcaaggacctttttttcccaaataaagtcacattcgcattcacaagttcccatgattaggatgtagatgtttcttttgggggaccacaattcaacccactactctatctgtctgtctatcatctatctgttcaactatcaaaatcctctttgttttttgtttcccagtgtgctgagtacacagtagttcctaattattattattaatttgaaagtgtggccttattttatagcgacccaagttattttctgggctaattgtcccaccttgtttcaaagatgttttatcattaactctaagcaatagatggacatagacactccacccttacaaaacaaatatgtgtttcagactaaagacccagcatctaatagccacacctaaatgacacacagtaaattgtaccattattataacttgtaagattgctgtttttctgggtgttgctccttgggctgcagttaacttcctgcgtggtcttccatacacctccagcaaggtgcaaatgtctccgttgaattgaccctatttatccttgattaatgtatgtgccctagaagagagaaaagcaattggtcagagctttaaaaatagagggagaggccgggcgcagtggctcatgcctgtaatcccagcacttttggaggccgaagtgggcacatcacctgaggtcaggagttgaagaccagcctggtcaacatggggaaaccctgtctctactaaaaatacaaaaattagccgaatattgtggcaggtgcctgtagtcccagctactcgggaggctgaggcaggagaatctcttaaacctgggaggtggagattgcagtgagcccacatcgcaccattgcactccagcctgggcaacaagagtgaaactacttctcaggaaaaaaaaaaaaatagagggagaaaaccat

SEQ ID NO: 113277 - DNA, 1481 bp, Homo sapiens
tagagactggatctcgctatgttacccacccaggctgttcttgaactcctaacctcaagcagtcctcccactttgccctcccaaagcactgggattacaggtgtgaactactgtgctggccagaatttgtatattttagatttttatgttttagaggggatttctaggctgactttaatgtaccgtctcattttgaaaaacatctttattaaaagtgatcctcctgcctcagcctcccaaagggctgggattataggcatgtaccattgccaggaatcctgtttagaagccacatgtgcacacacacacacacacacacacacacacacacacacactcacacatgcacacacatcagcactctggttcatggaaggatatataaaggcctattattcacaacatataaggatggacagggcttagatttattaaatggcaaaggataataatgttaaatagctttaaggttagatcagatactttaattgaccctttccatttttttcttttttctgcctttttaatatgagacaggaaaagtatattctggacattagatgaaaaataggttaattttttttaaatgagatcatttggaatgttaccaaatggcatatatatagttcaaatgcacctctttagctaatttctagtgaaattattaaatgaaaagaaaacaagatgattgggagaggttttacatttaacaccaggacactcaaagttcaacagataatgactgagccacccgacatcatctgctgggctgccaaagctaatctctctgagctcccagcgactgaaggattttaattttgattttgatttggacaaaagtgaaattgagtgcagaatttgttatgtttgagggacatattctgatatctggtcaccagaatcaagttgaaaactcatactgcaggtgtgggcatactgttgtggccagtctgacaacatttgcagatatccaactgagttagctcagtcgaggacctgttgcattgataactggtgtagaggacacaagactaatttaaaaatctacgtaagagtaaagcaacaagcgctttgatcttgtagaaaatgatatgtttcatgtaccccagaaagaaattccaagtctcactaactcttttttacctgtagagtttgagctcagcatttttaagacatgtttgttctttgcaaattcaaaaagttagcaaaatagaatacctggtgcttctcaggtgtttttctaaaattgactctaagttgatcccctgctcacctctgtctacttaattatgaattctaatttgcatagctaattctaaagacatttgttaattttccttcctaaatttccaggtattatactgatatagagggaaaatgttggttactttatgattttgatgataaaattcaagaaatcaattctgataaaatacctttgaaattgttttaagaataagagtgtgtgtgtgtgtgtgtgt

SEQ ID NO: 113278 - DNA, 1135 bp, Homo sapiens
tgatcaaaatatctattctttcctaatagaggacctggcattttgtgtgtatttatactacactctttaagcaccattacaaatatttttcttaacttcataagcatttgagatggcacttgaagtaattaccaatagagtggcaataagagattttatggatagagaattttataatggaatattacaataattaatctgttcttaagattaatgaatcattctttactagcatctaaatgtaatctcagcgtattaaatgtagggaaaatagcttataatttgaaattcatatagtttggatttttttccacgtcatctcctatctgccctgtcctctctgaaacaggtaaaaacataatgtcttttcaattcaaagataggactttcagaacatggaaaaaaaaggttatatcaataataatacttgtcaagtcatatcccatccttagttcattacctcttaagcagaatttttagaaactatatttaaaatgctaatatgaatcgaaagctgtttttagtttgaaacttgctgtgcttggagaatgaaagcaagaaatgcattagagagactcctttaagacctgtaatttcatcagcagttctgactgtgtttctggttgactagtgggttggaaagtaagaaattaacagtgatttacttagtcgttatatcagaacagttgaaattcctgtacttaccagttggtggggttaaaaattcttttctttgatgttaattcaaagcacattggaagttcaaggtaacatgatttgttataaataaagcataatgcaatcattacattcttatcatagctctgtcttcctaaactttgcagagatagtgcagtacctcctatgcagatgagatgttagtaagattgtactatttgctattataaaagctgaatatttttataaaggatgttcaagtgaacacattttttgtatatttgaactctccttcctatgttaaatgatgcagagtaatctatttgttgttttctgataaattcaaagaggtcacatagctctgattcttcccccatagcatacactttcacattccagtgacttgaagtcttaaccaacagtgacccctgtctccctccttatggtcagattccag

SEQ ID NO: 113279 - DNA, 1845 bp, Homo sapiens
gaacactgtttgaaaaccattgctctgtagtcccttccaggctcaagagtctttggccttggtttagggtgagatcgtaaataaaattctcagtgggttgctttttcacagagcagttcagcatttataaaattgccatacgttgaactgaaggagagttctgtcttattaagctcaagaaaaggtgtcattttccttcaccagagggaaccaatagaagtatttattttgcagttgattccttcccttcatcctcctagtcaaatcttctcaggatttcttcctaccagaaaatgtcccttttcttcagacaaaacccacccttccctttctcatgaacagtgcttaattcacccacatcacttattttccaaagccattgttcacctgctgaggatagtgtcccttttaaaggtacctgggtgtcttggagagaaaggaaggggtttggatgcatttccagtgagaaactctgagccaagtgtctctgtgaattagatctgtgatttggggcatcagtttcttaacctttttaggaccttagtttcctcacctgtaaaatgaagatagtaataacatctgtctcctgtgattgatggaaggtttgatccctatgtaattactcaagagctagttgtatacgttgttaaaacaaatgatggtctttagaaggaagttatatagtattttccctagtaatagggaagttatatagtattttcccaattactatataactagaaaatattgtaaaatatatagtattttctagttatacagtaatttcctagaattggaagactggaatcatcttatcccagcagctttcccattcctttcccacatttgcctttatcttgaattcttcataaatcctcaaaaaagcggatttgtttcctttaaatggtggtccacctccatcaagtacataaactgagaggtatgtgtaattgatcagcagcgtggcccaggtcctacgatgctgggaacaaacagcgagagagggggcctcttgattaccaagggctttctcatcacatcaaaagtgcagttatccagaaactttcaaataaataaacagaagtcaaggcaggtgttgtgaaagtccttgacaagttgagttccgcacctgcacaaatctttctgtgttagtagtaggaataaagtgaagactatgtcatgagtcataaatggttgcttttctcttagcaatttccccaaagaaaaagaaaacatcttgaattccacctctcactgcacatgtgggtttttttgtaaagtgggataatttaaaagatagtaattattaagtcatattaattttaaaatataggctttatgtactgttctcaatgtaaatatttttggtcattgaaaaaagcaggttagccttcatatttctatttttacgtcttctattgagacccaaatgtttgggaaattaaaacttgggcaaatgagtgatttccatatgctcttctgatatgtcattagctatatttacatttcctcagcacattacaattttctgttattctctgtattgtcagaatgaaaaccaggtatgtagtgccttgcaaatgtataatccagcaatatacagcttgcctattgccttttaaagtgtctttttgaagttctattaaatccaggttgtgctagcaatgctaaatatctttacttttttccccctaagtctcttatagcatatactctgactaatgcttctagaaaccacttacatgtgcaggaagcatctgcttaatgatctctagaagttgggatttgctcctggggcctcaatagttttttttttttcatctctttcttagcttcatcttagaa

SEQ ID NO: 113280 - DNA, 1045 bp, Homo sapiens
cttttcctccccagcactgcccccacccatccacccagcatttctgatggacttttcttccagtacctcttgcatcagatcatgctcctgtctggctagctcttttccttccttcctcctttccttctttccttccttccttccttccgcccttcctcccttcctctctctcccttcctcccttcctctctctcccttcctcccttcctctctctcccttccttcctttctctctctccctttcctttcctttcctttcctttcctttcctttcctttcctttcctttcctttcctgtcctgtcctgtcctgtcctgtcctgtcctgtcctgtcctgtcttgtcttttttttctttcgagatgaggtcttactctgtcacccaggctggtctcgaactcctgacctcaggtgatcctcccacctcagcctcccaattagctgggtttacaggcacaggccaccatgctcagccctagctcctttctgctcagtaactatctctccacttctcttaagaaaactgttaacagtcttcaccagctcatgaacatacccctctcatttccatttttctacctttactcatgttgttcctggggtctgataattggaaccatggaattgcatgtatattttcctcctcttgggaggagctacaaagtcacactgtaaagaggtgggcctttggaggggggaatcgtagccatttcatggtctgccacagtccagagttcttcagactctctgggtgatccacaatgacaaaaatcatttacaaactgatctgtaaataagaatgtcagcatattaatttaaaatgacaagtatagcagtcaagaggagatgtcatttggggcaagtggatcctgactttcctgaaaaaggttggaaatatattatccagtcttcaggttttctttcttctagtctccaggcaaaccactccattgctgctcatacatttcattctttggccgtgttaatagtgggaatttaaaatacagccttctttcacatttacttagggcttgattggttttccag

SEQ ID NO: 113281 - DNA, 1051 bp, Homo sapiens
tgtgatgccctacctggctgtgtctgtggatatgatttagggacaaaaaggccaaatcccagggagctgcggctgagtttctagctcttcccatcatcaaatgtagtgaagtagtggctagtctcgggccttgtcccttggcgttataacggcgccattgttcttgcactgaattttttccctgggctctgtccgtgcacctgctggtactgtagggtgcagctgtttgtgggcactgagtctgtgaatctttgtgccagccagatcactgtctgcaaaactggagcacagtgacaaattcaagcgtgcagacacctacttgtttccaaaagagagaaaacacttgatgctttcttgcctggttattaaggggagtctttcttgctccttcaactaaaactaagcataaagatgattgaatggaaccgagtgggattaaaagtcagtggatagaatactgttttaaatggactctcaataccccccacccccattcctgttagaggtttcttaacgtgcatgattgtgaaataaaatcccttctccaaactatcagctattcttctgactgagcccacacttaacactgcttggtccttcaaaaataatgctgcttgcaaaacggaggcttccaggcccggcatcgcagttgattcagggaatagtatgggcagctttcagggctgacagaaaaatgaattttgtagatttcacccacggtttagactgaggcagacctgagaggactccaggcctgtatgttccagcagctctttcctggaagccagaaagcatatgcaaatcattgcatgtcagggcaggtgagccagtggtcacgtggctagggtgttcagggaaaaggtgttcacccgactgcggagagctaagttcctgctgattctgtgccttgtcacccatagccagcagcagttcttaacctcggctgcacattagccttgcctggggagtttttcacaaaatgccagggcccagaaattatgattcactgggataggccctggacattggtattttctttaatatcctcaaa

SEQ ID NO: 113282 - DNA, 1572 bp, Homo sapiens
tcacttaaaacaacctatttataaacccatggaaaaaaagcagggttttcaatagcaggaactactgaccctgaaactacagggagatgagttgggtgccttgatgacacagacggccggccatggcagtgtcacagatgagagctgcaagggctttgtgggtcgtggggtcttagaatgctttcagaacaaatcaataaccagtacgataaagcagttgtgtgaaattactactttattcaaactcatggtgtcctaacctgttgagctatgacttgagcttttgatacgggaagtgtgagaagagctcatgcaagtttaattttatcaaacggtatattctttcttgtccctgctttccacctcacttattggctgttctttttttaatcaaagcattcatgattttatttggttaaaatactttaattttgctacattttgcaaatctagtctacctggaaatataatggttgtagtcttatgggtagatatcctctgctacatccaccagagactacaaatatggacggacagatttttttttttttttttaatttttgagacggagtctagctctcttacccaggctggagtgcagtggcgccatcttggctcactgcagcctccgcctccgggctctaagcgattctcctgcttcagtctcccgagtagctgggactacaggcgtccgccaccacgcctggctaatttttgtatttttagtagagacgaggtttcaccatgttagccacgctggtcttgaactcttgacctcaggcagttcacttgcctcggtctcccagagtactgggattatgggcgtgagccactgcacccggccgtggacagattttcttaatgaattctgcctaagaagtggggtcagtacgggaggcggagcttgcagtgagccgagatcgcaccactgcactccagcctgggcgacagagctagactccgtctcaaaaaaaaaaaaaaaaagtggggtcagtatagccagagattaagatctcaaactgtatggtcagaaaaaccttagttagaatctcagttccaccttaggaactgtgagactttgaaagaatcatttaacctctccaaacctctgtttccactaatggagataataatcatacagtctgtctcatggggttgttatgagagttaaatgagataatgcacataaagcacttaatacagtgcccagcctggagaaacaacattcagtaaatgtagctaatacagtgatcattatcggaaagccatctcaatatacattaatgtttatttacatttagaaataatcaatgaaatggtataaaaaattactctaaaataaattttattccttttccctttttgtgatctgtctttagtgctgagaacttagaaaaactgataaacaaaggaatataaagttgatccttaatcccatcaccaagaatgataaataaccattatcactttgatgtatattcttctatattggtatatcgatgttttaaagaaaaatgggattctactttctttgttcaacaaatatagtacttactgcatttgtattatagt

SEQ ID NO: 113283 - DNA, 1047 bp, Homo sapiens
cttggctgttactgccttaccctccagcttgcaaactaagaggaacacacagagacaccgtgtaggaggcatgaagacagtgaaggcaccgggcctttaactttatttagccctgtgggaggcttgggggccctttctaacaagactgtagtcctcattgaggctgtcattgtttgagctatcataattcccaggattacatttaccaaacatccaaggacataattttcaatgtcctattaaaaacaactggggagctcaaacctacactaaacatgtacagaaaaattgactggaatccatgagtccctcttatatgagatgggggaaaacttagttagatggaaatctttttagctgactccgttaatgcaaagggttttgtctcaaaatccaggaggaaactcatgggatcaaaagagcatgggcttttgaatttgatagacctgaattgaaatcttattatgcaacttactagctaagtggccttgagcaagttaacctttagactctgaattttctcatctgttaaatgggaatcataatgtttgtctggaagagttgtcattagtatttaaggagagaatattaaccaaatatctgacacaggaattttcaatggaagttatttaattctaataactatcattgagcatcttaatagcaatcatatcttcactgatattttcgatatgatttggctgttgacattatttataaagtgtttactttcctaccataagaagtataatgtatggacataattaaggtatttgcttatttggaaatcttgcagtctaatccttttaaatagatcagtaatcactcttcagaattgtagctctaaaaaagtgtgaccagatagaacctctactgactttaggaaatagcttggaagattaagaaaatttaaatccatgatgtaatttgttttctatcatttgcctttgtctcctgggagtagcatgcccttcatcttcagaatccatttaaccaggagttctggttggctgaattttactcagccgacttagtttttactttaac

SEQ ID NO: 113284 - DNA, 1059 bp, Homo sapiens
aggactgaggagaccatgcgatttgagtccttttcctccccttttagctcccagtctgccagttctaccttggccgctttgtccaagaaggtcagtgaaagaagtttgactcctggtcaggagcaccctccaccggccagctccttcctttccctggcttctatgacctcctcagcggcccttctgaaggaggtggccgcaagggctgcgggcagtcttctggctgagaaatcatcgctgctgcctgaggaccctctaccgcccccgccttcagagaagaaaccagaaaaagtcactccgccacctccaccgccacctccaccacctccaccaccaccaccacaatccctggaattattattactcccagttcctaagggaagagtttctaaaccctccaattcaggtatggcatcttttctttcaatcatcgtgtaagtcctttagactataaactgcgatgtcttattcattgcttttttcagttgggttccccatctgatctgaggcaggaataaaaaagcaagagcacaacaaaaatactttaagtaagcagcatagtagtctttcatgtacgtattacacaaagacttcacaaatagcttcacttttgaaaggtaatgaataatcttagagacatacagcattccctccctttcatacaaatgatttttttttcttactaagttcaggctaggtccatacaagatatatttaatgggagaagatcaaagcatctttgtcatggagtgcatggcatcactgaacataaggggaaaaaaacccactgcttttgaaatagtggacaagggagagcccacactcctgctgcctccatcacaaatggacttttgtacaatcaggaactactctgccctaatttatcacaccatatacttttatgttagcatttttattactttttgtggaatttaagcccttttcacgtatcctattctcctacaatttcttgtcctataagaactcaaaaagattgtcaatcaaacataatcaacacatttcctgtgaatgctttatttaattcaaatccaatccaat

SEQ ID NO: 113285 - DNA, 1033 bp, Homo sapiens
cagctcagtgacttgcctagagtcacggagttagaaagtagggaagcgcttcccactgtctgtgtctcacggtctgtgtcccactatgccaggctgcctctctcattctgtcacagtgctaaacatactgtgctggtttttcacaaggatataggcttctttccatttccccccattccctgaaaatagcagtttcttcatccaattacctctttaccagatccatttttctttttccttcttttccctttcaacttatctggactacttgggtatgtttttacctttgcctgtgtagcattttttacttttttcaggcttctgccaagtctgtctgacattctgttaaggctgttgccacctttcatttggttcttgggtggaagggaagagaaagcatgtcatcacctccatttgaatgtcttgagacttacttattgttcactttgggagtaaacctgatcttcttaattctccccagatgttagtaggcaggaagaggcggagggagagctcagtgaaggagaacactggtatggaaactcttcagagactccgtcagaagcatcctatggggaagtccaggagaactataagttgtctctggaggaccggatccaggagcagtccacgtccccggacacctccttgggaagcacgactcccagcagccacacgttggagctggtggcactggacagtgaggtcctgcgagactcactgcagtgtcaagatcacctttccccgggagtgtcttctttgtgtgacgatgacccaggctccaacaagcccctgagcagcaatttgaggcggctgctggaggctggttccctcaaactcgatgctgcagccacggctaatggcagagtggagtcccccgtaaacgttggctcgaacctctccttttccccgccttcccaccacgcccagcagctcagtgttctggccaggaagttggccgagaagcaggaacagaatgaccaatacactccaagtaaccgttttatatggaatcaaggtaagtggttgccaa

SEQ ID NO: 113286 - DNA, 1192 bp, Homo sapiens
cttgcattcatttctcccaaagctcctctcaccatttatttaacctcaggtattgccagaataatttcagctatgtttctcctcaagtttctgctctttctctttctatgccatgcattaaaattatatggtaacttatttcttgaataacctcaatttcagtagcagcatcttcagaaaagtgattaacagagtattatgaatttaagagatactcttcatgcatccaagttttcttgcagtccagaggtgtgtgtatctcagtgatcgagtctgcaaacaacagagggatggatggttgagaaattatctaggcattttaggagccacaaacagttctgtttaagaaatactttgtttattcacttgtttattttgagtttgtgttttgacaagttaggaaagttgctttaaatgtagacattagctgttgtatctttcaagaaggttcagacatctttatcactgcttggtaggattagaacctgaattgacagtttctttagcctttggcacacttacctgtttgcacactcacctgtttcagcacgtttggagggggaatattcttgctcactgagggtgtggagggggttaggaaattaagctttgcttttgggactttgccagtagaagtgctaaattctttaggcatttgaatctccttttgaccgactccaacaaagaagaggcagaatgggaatgaagagattagagtacaggaataatgagtgttcacctcttaatgatttatctcaagataaagagtgaatactgtccttatctaagagaatcccttgctgatttctgattcaagaggttggcaggaaggatgggggaatggaaagcgggtgagcagctgctcagagctctctagaagtcgtcgttcagcggttctgtctgcagattgtgcagtggaaccttgcagagaagcattgggccagctgagagatttggggttcttggtttctgcattagctctacgtggtcgtgtgtctttgattcagccagtaacctttacttaacgtatttaatagtctgagtaaaatgacaagatttgatgtgtggttgtaacttcttgtggttctcaaaacctagattttaggtatgctgttaggtgaccctactgcattagtttggaaccattcttgactatcttgagctcctctggtatgacacacatatgacctaa

SEQ ID NO: 113287 - DNA, 1391 bp, Homo sapiens
gtttgagaacttactttggctgctggttgagaataatggagcaaggttgggaagtgaggagaccagttggaaggctactgccatagtacaggtgggggatgacagcactgggtaccaggttagtagtagtggtggaaatggtgcaaagtggccagatttggtacctctgttgaaggtagaaccaacggaatccgagaatgaattggatgtggggtctgagagaaagagaagagtcaagggaggtggcatggttttgggtctaagtaattgaaaggatggaggagttgccattcctgctgagacgggcaggtagagggaggaacacgggcagttcctcggccatggaaggtctggctaagcactttatatgaagaatactgaaactgacttagctactttttcgaactcactctgcagaggagtgatgcgttcatttgtgttacctttattttactcacggtcatttagaataatgatttgaaaatgttgctgtgtgccaaatgctcgtcttgacccaggagcccctccctccccccgtgtgtggactactctcgtctccagacttcctctcacttcctcatgcctttgcagcaccttttccctagctggactggtgacaggaatctggttgtcttctgcaccctggcagttttaaataactagcagttcttacattttcttcctgggcacgctgacagcggttgggtgtcctggacatccgtgtttcgataactgtaatctccgagtctctgtcctgtgaagcccattgccggccgtgcatttacctcagactgtggacttggagccttgaagacgcgagaggtctcttagtttcaggcagacctggtgtgggggatgtgctaaggctctcaggctacaaagggacaatttaaaacttggcaagtaaaaccggcctaaatgcggatgtgttttatgcttagcatcataaaattgattcagaacagcctgatatgcggcagaagaaacctttattaaacattatagaggtcattgcttttgtcttcctgatacctcttccctctcctttcttctgtgacccacattgagcccattgtagaacccgccccctggcttcagtgataggcccatggaggggaacatgacctccaacaggccaatcagaggcgtaaagacctttctctagtgggaagtcattgagagtgaaaacccagaaccggttgcagccaggttttcagcctcctgggaaaagtggcctgagaggaagagactagaggcgaatgagagagagccctgatggtgctttcgacatcctatctgatgctggctccattgtgccccttttattgtttggtacaggaactgagaaaattcccttattgcttcatgcggtcctgctggttttctgtcat

SEQ ID NO: 113288 - DNA, 2596 bp, Homo sapiens
aatgaaatcattaccagtatgatttattgctgttgctgtgattcaagctaaggtcccaatagttttacccgtcattgcttttgtatcatcattacagatgtcaatggagtaataagggcaaatgatagcttagtattattataaaaacagttttgatcttgaggatccctgaaagggtctcagagacacataggggtccacacaccacactttgagaaccactactctaagttgtctacatagtaatggaaatgccacatcttggtgcatgtgcgtcttcagctttactaggtaatgctataatgtagcactttgaatattttcaccaaagaccccaaaaggcaaagaatcctgaagatggggaatcctaaactcacaacggttctcacagcttctgtgagatttccttgatgtatctttgaattatcttacaatgtgcattatactgtatatctgttggtttagactaaaagtaatgttttcaataactcatcagtcaaattacctttgtttcttgtaaatatgtatgtatcagttttggtctgtgaagatgctccatatttatcctggtacctgttatgatttcctggaacccctgttggaggagaactccagtgagtgccttggtccagcatgatttatcttggagactgcatggtagcaaagaagagatgactaagatttccagtcttggggaattaggagtatttctggtcttcgtgtcttctttttctgggttgctgtcctcattgtccatgaacccactcatctgagacagaaacctgagtgtaatccaaatgccacccccttccttttcctcccctcattgaatttcttccccacccagttttgttggttctgcttcccaaatatctctagaataaatcatgcccaccccctgccactgctttggtttacactcatattttttctcaaagagaattgaaatggttgccagctgacctctttttttttttttttttttttttgcctgagtctcacctctcccctccccaacccctgcctctgtaatccagtctccacactgccaccatggcagactttctaaaacactcatgtaatccagataatcctatttaagatcttttaggcattttctaaaaggataaagtctggacttctagactttgccaagaagcaaatctagaagatgctttgtcatctaagcccctttcctctgccatgttgtatactccttgttttattcgtactgaactatctgttctgcaaatcatacttatacctccttttcttggcgtattcttttctctgtttctgaaatatcttcaactcatttatgtgcctgataacctcctacttagcctgcaacactcagttctctgagaagcctttcctgcttcccctcctgcattgtcccacatgctgggtagaattaggcgtctcctcccctggttcccatagctctatcataataactttgtgtgcatagtatacttccttactagtcgatgttcttattgactgtgagcttttaaagggcatggactttcttattcatttttgtacattcttgcacataacagtaactgattatagtaggtggtcaataaatagtgctgaataaatgaatgaagggagaagtaaagagctggtcacagaatccaagaaataggagatgttctattaatattgttgaatgaagaaatgaatgaaattaagaaggggggaatcccataggtgtttcataaacactgctgaatgaataaacaaagaagttaagactgggtcacagaaccaaagggttttagaggtggaaaggactttagagaccatctcctgctgtcttcctctttcaaaaatgagaaaacgatttgcctaaattgtcccgggctgggtataggaggcgatgaacagtaccctggacattcgcgtgaatgtagcctggagatgactggagggagtcacatgcttctcctcccttcctgaggagacttgcccagaagagcagaggccgtggcgtatgctgcaggggataccaccgtctaagtgcaagagagaacttttgtggttggaagtctgtggcacattccagactgtggagtctcccctcagctattggctgttgctctctttctgtcctcaaactgtgccaagaccgtcagattttcctgatgactgggcatattctgcatctggattccatggtcataacaaccagaagtttcctgtcttctttggttggggtgattatgatatagagctgggtaacaatatcaacagttctgaggtaagccgtcctctttaaaacataatgttttctcatttgagatttctaggtgcctgggaaaaagggaaagctattattcactaagcgtcaactctgtgccaggtgctttacttatgtaatgctaatttacctttacatagccctgtacaattgcagatattagtatcttatactctaaacaggagaaggtgcttgtagacttcaggtgggcctagtgtatagcaggataagattcgagtgggagtgtctggttccaaagcttgtgccctttctattttgccatgctgtttcatgctgtataaatagattttctgctatacaaaactt

SEQ ID NO: 113289 - DNA, 1080 bp, Homo sapiens
cagtctttttttttgagatggagtctccctctgttgcccaggctggagtgcagtggtgcagcctctgcctcctgggttcaagcggttctcctgcctcagcctcccaagtagctgggattacaggtgcctgccactgggcctggctaatttttttttttttttttttacatttgtaatagagatgggttctcaccacgttggccaggctggtctcaaactcctggcctcaggtgatccgcctgcctcggcatcccaaagtgctggtattacaggcatgagcctccgcacctggcctgcattcaatctgtgacatgttttggatggcatatctgaagaaaatctgacttcacaccaatatgtaatagtcttttcagataattgtgaatattcattgatattacaccaagactcaaaaagagatagcttcttaaagattagttgcaatgattaatcaaaacatttcaataaacttttcatattttgaagcattaaaatctactggtctctcttgtgctttgaatggatcaatgtgcatagaacatcttgtgttggacatttggaaaatattggttcactgagttatgtagatctaccaaatgttgacacattttgttataaaatataaaaaaaatattaatatcaacactgatgttatctgaaaggtgtttaaggaccgtattgggaagctgtcaaattcacagtgtaagatacatgttttccaaaattttaattcttgtttgaaagcttgaattttattgttggcaacaaacactgtcagtttttccttgaagtatcagtcttacttttcatttccaatgaagagtctgccaaataccgatacttgaatgaccatagtcagttatcctttcaattaaaagtgatgttcaaggaaaaattggctagttcggctcttaactcagtcacacatgtccttttccttgagacagccaccgtactttggtgatagcagaagtgctttatgcatgtatttcattacatgtgttattaaaaagatgtttactcaagggtcagtcttcaatgaaaataatttttactgcttcatcaaagacattcttaagt

SEQ ID NO: 113290 - DNA, 1485 bp, Homo sapiens
ctcccttaaactctcccatcaccaaggtttttcactggctttgtgaccttgggcaagtcacttaaccatctctgtgcttaagtagctccatcatgtaaaacggaaaacagtacattactcaaaccttctgtttgtattatgctttattcttcatgaagcactttatcatctgcctgtgaggtgggcagggaagggctgcttctcccactgattggacagaagtggacacagacccagagaaaggaagaaattagcttgtagtcaccagtgtcagcactaccaagggctggaccatttgatggtctcttgagacacagtgcagctgtaggtctgtgaaatctacatgggatctcacagcctgaaggagatggttttggccactataaattgcttagagcctctccactacaggagaaccccttaggtgttgatggaacgtgatggccccatgattcatgaaaacctctgctgccaatagtatttccctcctcaaagacttaagatctgagttcatctcagtcttatcaaatcaaatgtatcttccttctaacttctaccctattggtcctactctctgttttctgatcagcacttcataagtttatgaaaatacttttcaagctgaattttaattatttgtttccatctctttctctgctcacttgtctctgagctccttgagagcagggactaagcagagaatagtagaacggagtcacatgcagtgacactgtctgaggcctgaattatgtgctccatatggagagcactgcctttgcgtaatggcctagaattaggcggcgttttctaatctgcacttgtttggccgtacttgttaacccaacagtcctctctagagcatgaaacacagctgtatttgggaggaaacaaagtgtgggagaccctacgctccaggaaacgttactgaaatgtgctatatgatttctcccttctagaggaaggcaaacttcaaataataacttactgggttttaatctgaccttaagaaagtgagaaatcaaattacagtgagctgctttgtgacatttatagaaagagagaaatttcacaatccagaagtagggtttgggttggctactagatcgtagttagaagtgctgtgcacaaatggctactcacatacttgttgataggtgaaaaaatatgtgcagaagaagagaaaaagtatgagaagcttaaacatgacttgggcgtactccataaggctgaaaccatagaaaacacaaatattaactattaatttatttttaaaaattgatattggcttttaatgacaaaagtagtatatgcttagtataaataattaaactcatgcgataatgcttaagtatgaaagtcccctcatcccaacttccacccccagagataaccactgttaatcaacaattaatatttaaaacttggcctttatttgaaaaattggtacatttcagcatagttggctaaaagaatttaagtatggaa

SEQ ID NO: 113291 - DNA, 2873 bp, Homo sapiens
gtgccatctgtgaaagctgaaggcagtgtatttctgagattaggttaatatatcctttgtccccttttgaagttgccatgtcttcctccattcttcatttttaaatatccactgtagtattaggacaggacaaggaaaaacaaacagagtaggctggagctaatctctccattctgagtgatgtattggtaattttgtataatttaatcagactgatcacagaacaagataatcagagtatgacctacagaatagggctttagggggcgttaaggatttccagcataaggttttacaagaacatgagctttgtggcgaaggcatagattttaggttttctcttattggaaaaaaatccaggccaggcctagttatggtaggatgtgagctttttttcatcagatttcataactatattggcttagttaatgtactcttagaaccacattttaaaggtatagattgtaaatgatggtgcctgtttctgagatacacttttctgtctcctgctttgccaggtgtagctcagtaattcattccatctagggctaagtgtacaacactttatagttcatggtagctaaaatgtcttctatcatattttataagagaataatgtgtgaagcacagaccttagaaatagctaagagtacttgatgggctgacatttctggctgctttctcccttctgtttgggagtaagttttttgtatttctgtcctctctctgtaagttattttttatgatattggagaatagtgtgtgactaggtgctgaggcaggggcctctctgatgactcctgtcattccccagggacccaccttgggctagaattgttgtagttacaaagtagtttcataaattaaaatcagactttggcttgatactaatcttaaatggcatgggtacatgttgctgtttattttttaaaagttagcttcactgcatgtacacacatgcgcgcgcacacacacacacacgcacacacacagagaggctgcactgtagctaattttataaaatgcacagtgatacgcgcccacgatctgaggtcagaatgtggcctttagcaactctgctttcacagtctgacctagggttatactaaatgcagcaaattcagtgtgcctaaaaaggatattgtttccgactgtccattcccttcttataaaaaacagcttttactactgaagttctgtctctggagttcttaagtgaccagggtttagatacactttgcttctgtttttaagaaaatcctaattcaaccaagtttctctaccagcaaggaagaaatgcatggaccttcttggaggccagggcctgaaaaagcaaaccctaaaataacctgtctctctatctctttctctttggtcatttctacatgggtcggaaaagtggttagaccccattagaattgtgatgtgaagggaaaaagaaaaggggtgagagagagatgtggatctcagggtgaaatgttttgagtgtgctgaagaagctggccttcaaaggagactgaagaaggccaggaaaaaatgatcttttacatgattgatcagtagcactctgcttatctgagcttttgaaacaagctactgtgcttgtggagggtgatagatgtttctaaggttacatagtgctagtatcttaggtggtctggtgctgtattttaaaaagcttttgttgttgttttgtaatgagagggagaaagtatcatctgtgactgtgccctctttaactttgtctactgtgtatggcacaactaaagtagaaacaggattcatgtgctttcaaagttcgtagggcagcagtcaaacgtacaaactctggggccaggctgttcagagcccagctttgccactgactagctgtgtgaccttgggcaaattgcttatcttccctgtcctccactttactcatctttaaatagtggtaatagtttctgtatcacagagctattagaaggaataattgaatacatatacaaatgtaaatattatacatatacacaaaatcatgcctaattagtgcctgctgcatagaaaggacttaataaatattacttattattaagtatgtgaaaggtgtttcagtttgtttagattgtgaatagattacaggtatttctgacctggaactttttggtggtttctatggtttttttttctcaatatatctcattagtgtggtgagtaataataatatgatatggtaaaattcttttacaaggctattattgtagggcttgactaatacttgtttcataggccaacaatattatattaggcttttactacaggaatgagtttctctgtttatatgatttgacctgaattatatctaagttgtgtaataatcatatgcattataaccagattttactataaagtgaggatactaaatcctcctttagacacttagagtgagactcaaattagagaataggtattccataaatatttatttattcttctgttcaacaggcagcccactggttagagtaacacagacgaaatttatattaggtgttccatatgttacataggtaatagtttatttacacagaaagaaggaaaggcagggtctgctgtttctaatcacagagaaccaaatcaagagaatacatgcaatgaatcttaaatgaaggatggggttgtgtatatgtgagcacagtgggaaagagagatcatatcgtaggttacaagctggtgccatagtaatgtgttttgccccacacagatactgtttaaaaacttgagacaacattttggaaatcggaggtttcatataaaaatccaaatttccagcttcctttgaaaacttggaagagtcactcgcactgggcccacctccccacatggcagcaatctgc

SEQ ID NO: 113292 - DNA, 1351 bp, Homo sapiens
atttcactgatcctgtcatccagagctaatgattccaaggtacccagaagcagtctagattgatgctggataataatgcctatctgttctctaaaaagaacatccctgtattcctatacagtaagtagggtatcactgagctttcctgttaaaataggaaagataactcaaaatcacattccttctcatgcttcaaaatagtttctaataaaaacattgatttttaatttacctgcatgctgccatctcactctggggatgacacagctggtgtgagttgacaagtcttgctgcacaaagtgttaataaatcatgctggagaggtataaattggacagctttcggccagtgttagagcttgctgtgcatttgagattttagagtctgaatggcctctattaggagagttcgaagggaaatgtagaaaatctctgtcttgtgaggcttgtaaaatcagatggacaaagactatgggcacacctaagggaaagtgtgttggtggagtgacgatgcaggcttctcctgaggtcagaagttggtttaaaatacaagctgagcgcggtggctcacgcctgtaatcccaacactttgggaggccgaggcgggtggatcacgaggtcaggagatcgagaccatcctggctaacatggtgaaaccccgtctctactaaaaacacaaaaaattagcagggcgtggtggcgggcgcctgaggtcccagctactcggcaggctgaggcaggagaatggcgcgaacccgggaggcggagtttgcagtgagccgagattgtgccactacactccagcctgttcgacagagcgagactccgtctcaaaaaaaaaaaaaaaaatacaaggagttctattaatgtcaacatgttcttgtagaaaaggctggattggaaatgtatggtgcctggctgggttggtaaactagtttacttaagtaatcccagtagtttgcgttcggattctgtctggacaagttagtttcacaaaagagaaaaactctcatccactgttattaaccctggtcacttataagcaaattggtatctttggacttaaagatgacaaggtgtctcagaccgttggctgctataacaaaatatcttaaactgggtattttataaacagtagaaatgtattgcctacagttctggaagttgggaagtccaagatcaaggtgccagcagattcagtgtttgctgagggctcaatctctgcttcaatgatggtacctttttgctgtgtctttatatagtggaaggggcacacaagctccctagggccccttttataaacgcactaattcctttcttgagaggtctaccctcacgatctagtcacctcc

SEQ ID NO: 113293 - DNA, 2656 bp, Homo sapiens
caggcgcccccgcgcctccgtgtcacccgggccgcagccgaagtggcgagcaagggcacttgcaagcagtccgctccgcaaacattcctctttctttccccttcccggtacgcaggagtcgacgcaaagggcttgggttgtgcttttttccccttcctttaaaaaaaaaaaatgcccctgtgcagtcctttcttcgcctgcccgctagaggttctgaggataatatcacatatgtaatatatatgcacataaaatcactcgcaggcggctgcgtgtgtagggaaattttgtgcgaggaaggagaaggcggtggagtcggggagggcgagttgggaggctccgcgctgcgattcacagaaaactcgcagcagttggtggaagagtgtgcgtgcacatggccggactgccccgctgccgggctcttgtcgggggcgtgtggggggagggagaggaggcaggaatcctgagggggtcaggggaggtctgccgtgcttggacaaaatgggcttcagtgttctctgcgaacttgcccttagatggcaactttgggagctgatgagcttgtgtgcgaaaacagggcggtgaggttatttggtcattttccctttcttctcttctccccctgctttaaaaaaaaaaatgttggcggggttagagggagggtgggagaggagaagggatttatctgtttcgtctgtgacggagatggaacgccttccctcctcttgtgtgtagtgcagtcgggcagctgcagcgtgccctgctgatgaccttgaccctgacctcctgcgactaccctctccgtctgagaggaaattcaggctccattttagctcgtgtgcttggtgggcctttcctgcgcgtcggtgcctggtgatgaagttatattttcagagtgggctctcctactttgctgtctgattgaatcctgttagccactcacttaaaaaaatatcacctccctctttcagtcacataaagtcacttttactgaagtaagaagcaattacctttggaaacaccgtaaaagtccctgcagttttgaaagggaggccttaattttctaagcttttccacttacctttgcattgaatggatttttgtggatatgtgttgcctgtgctaagtgtgttttgcacatgtttttaaagcagtttgtgtttggactttgcaatttctgggcaaatggtgtattttgcagttcaatcacagtcacccaaggcttgctaactgctgagtgaggcttgaaacttgcaagtggtgtgaagtagtaattattgactttgggaaaaattagtgttaatttgtatttaatgtcgaatataattgtagttctaagtcccacttttaatgctagacactttgtttgtttgtttgtttatatgtgagaggaggaattctttttcactggagtactgttttgtatcaaatttaaaatataggaagtctggggattaaatattcctcctagaagtcatctcagggttttaagaagttaaataggggcagatttaaaagttgactctaaaagaaaggagtgtgtaacggaggaggagaagggagatcttgaaggaatgagaggggcaaaactgtttttgaagccaaagagcccttttgagtaaatacaaaagaggttaatagccactgttaatatattgttttaagaatctgtagaacctgtgaacacatttaagaagtgcaaattagaatacaaaaaaggaacttatgaaaactgaatctatagaaaattcggagggctttccacttcctcttaggtctctccctgtgtctgcacccccctaaggattctacagcataaagcattgctacttatagactctttctgtgttggatctatttttctgatattaagtacaatactagccagacacagtctggatctacaaagcccaaagtcctcccactacacagcacagacaccagggaacctggaagttccaccctggagtggattagtcctggaaatccagactagcacttggtattatctgataccaagtctggggtgagcctcagcccctggcacagagtcccagcaattccccagtctgagctccggcctgctaaggtttcccagctccttctgttcagttagacacccatgggactgttcagaaccgaattagctttggagatgggttagcctttaacctgacactactaacctaagccttaggtttctgatttaaaattctacacagccatttcctcctgggcctctgaagtaagtgtgtgtgtttgtgtctgtgtttgctttgttatatgggccttatacatatacagaaaaagatggcctatactgtagggttgaatggcgatcttactgtctataaatcaaaagaagtcctgtattaacttctgcaggtgaccctaagcaaagagtattaaacctacactatttttgaggggtggttttaaaaattattacacgagatacagcctttatttcttggcctagagcagtaattatcattttgggatttaaatatgattctactgttgttgatggctcttttacaaaagttctttccattaacaaggtccaatactatatttaaaaaaatgtccaagaggccctttgagctatatcacctgcttgtctttagcagaatcctgaactggataactttaaaaa

SEQ ID NO: 113294 - DNA, 1027 bp, Homo sapiens
tgctgtatcaggcagtctctcactgaactgtggcatagtagatactagaatttaaaaatttgtttacatcacctgggttattctctccttttaaaagtgtactaacagattttaatcatcggagagacctgtaacactgaaaaattggaaagtgatcattttcatggccaagactagaaatccattatttagaatggcaaccccttcaagattttgacagttgttttcaggttccctatatgttagaataaaacacccctgattaattataacctacactccatcatttggttagaatgtagcttttggttatcatttgcggtaccttggagatttctttaaaactcctcactttaaaaccaaagaacaattttttttatttttatttatttttatttatttttttatttagggcttatagcagagattgtcaacttccattgacattttgtgctgggcagtcctttgttgtggagggccgtcctgttagttgtaaaatgtttagcaacatccctggtctctacccactaggatagcagtagcaccaccttcctcagtcatgacagttcagtgtccccagatatttccaagtgtccctgagcagggtggggcagggttgggggtactgcccctagatgagaaccatttgcttatagaaattatctggagaactttataaaatgtaaaatacagtgcctttacctgagtagacttcgggaaaatctgcattttaacaagcatctctagatttggaaacagctggttcttgaatgacacaaacagttgttttctcagtttttggtgctcataatagagattacttggttagtatttgttgaagtacatgcatgatcctactggtcactgtatccatagtttgggctgatgggggctggacagggattttgcttggcactggccttgaatgtctcttccacagacttgggtagtgtgcttaggtaccagggacaccaagtgagtaagatattttccctgtccccaagaagctttaaattcgcacgggaga

SEQ ID NO: 113295 - DNA, 1068 bp, Homo sapiens
ttgtaaaattctgcatttacatgtttcttgccctctctggaatgtaaactctgagggcttaaggccttgtctttgtgttacattccccaaccctgtgcgcctgaacttgacaggtgctccgtgaaagttggaagtgttgattgccttcaggaagagattgatgttaattggaatacagataaagcataatggacaaggcgttatctttggtgagcttagaagaacatatctgtgtttataaaaaggtgtggaaagttaatattaataatacttttaaaataacctatactgtcaagcaactgatagtcaagatttgcattcttttttctgacagttattaactctttccagcttttgcttttcaaatgtttttaatctgaaactgtaaatactctatgagcagatgaaattagtaataattaaagtagttaatatctccatgaactagaatcacattacaaagcattttagtgatttttaacacaaaatagctacttttatctcagttttatacataatgaaactgtggcataatgggatttagcatctgtgataggaaatgcacctgactcatcagttgagtatcaggccttcagagttaatattctctctagatgtgttcagcctcaaaacagcatgtattcaaaatgtaaataaggcggtttatagatgaatgggaagatttgtgtattttcactaaactcattaaaggtactgaatctgttacagtatttattttgtattttttcactttgtactcagaacagtgtaaataaaattactgtgtgatctgagtcctgaatgaaaagtggttgtcctgaatagtagttgtaatagtagttgtaattgtagttatctgttgagattgtggagctaataaaataagctagaaattcagtggaaaagttaagttaacatttgttgagcaaaataatttattgcattttaaaaacatctttcaaaccttgggggcagtgtagattgtccaaatgatagcccaaaattcaaagataatttctgaaatttgtattttcttttatttgacttaggatgttgacttttcttggc

SEQ ID NO: 113296 - DNA, 1030 bp, Homo sapiens
ctcatggaaggaaagggttgtatttctaaccccctgggcagtttttttgttgttgttgttgcttgtttgtttgtttgtttgtttttgcctttgctgtgagaatagatattttaattagaagtgaactcttttttttttttcttttttcttttttgagaccgagtctcactctttcgcccaggctggagtgcagtggctcagtcttggctcactgcaacctccgcctcccaagttcagacgattctcctgcctcagcctcccaagtagctgggattacaggcacctgccaccatgcctggctaatttttgtatttttagtagagacggggtttcgccatgttagccaggctgatcttgaactcctgacctcaagtgatctgccagcttctacctcccaaagtactgggattacaggcatgagccactttgcccagcctggacatttcattttgaaattcttttcattggttttcaaacaggtttgcatattgtgcctcagatttttcttgctcatttataattgcagtttgtatgtaaaatagtacagcaggaaacgagctaaagttgtagcttaagctttcttttgctaggaaataattttattattcacagtccattctcgttctttgagagtttaccgcttttagcagaattctggtagattaatgtcttttgctgtcattacacaattttgaaaggaaacttttttgtttagaggataatgggggcagaggcagagagtgaggagcatattaatgaagttaagacatcaaatgagaaactatagactcgactgaattgaatctagtatttgtttttacttaaatttttttttctaggaaataccactttaaattagagacagaattagaggcttacagattttcatcttttgaaaaagatcatcaggtcaaattttacaaaatttataccatcttaacacaattaaagattgactcaaactgtttccttgaaagctccctcgaatgtttttggccattttctctattagttttgattggaaaatatt

SEQ ID NO: 113297 - DNA, 1098 bp, Homo sapiens
tcttcaaccccctaaatagttggatctctttgctataaactaaacttcctgacttttataataagagtctgtcccctatgcttacaggaccttatttcttcatatcatatttttacatacattatttcctggctttctagtcctttctatttatagaattatttatcctatttttcatatccttatttgacctcctctttttcctaagaaatgttatgatcttgtctcacctcaagacagctaatggcagcagtcactggcaggttgggttctgtgcgtgttgatagggtagatcctttaacgtgcacactacccctaggacttggggggcagggttggggggcggctgtactggcattctgatgcttcccttcatgtcacatttcccatgatgtaatcagtgacactcatctttagactcccaagttcacatcattggctcttaaagaggatcttgacttatttgattcatctgtgctatgttctttgatgaagacaccttactgttcgctttgagcagacctctcagaagccgagtaggcatggaaggtggaagggagaaccacctctagtttggccaaagtgacccaagcatttcattttgtttcattcctacggaccacacatcctacgagttcatgttggtagtcatgagaagaccactaagcagaacattaggtaacaccaaagtatgagacttttaacgggaactcagaataaggactttggtatcattaaaaaataaaaataaaaaataaactccttagctcttgtttatcctgttgcatttaagaaggtaaacagcaagtttagagtttgtattggggagacagatgaaaatatgttgtttattcttaatttgagatctagcctggttagatttactgatttactttctgaaaagcatctttttttttttttttttttcctgagatgaagtctcgctctgtggcccaggctggagtgtagttgtgcaatctcagctcactgcagcctctgcctcccaagctcaagcagtcctcccacctcagcgttctaagtcgctgggactacaagtgcatataccaccatgcctggttaattttttgtatttttggt

SEQ ID NO: 113298 - DNA, 3016 bp, Homo sapiens
ttcagccactgattgagtcacctaaataaaaaacagaattggaaagccaagagtgccacttgcacataaggagtgggaattcgaactgaggtgctggagaaatcctaaagatgaacaagatttcagtgaggagaaagccctcctgtcagtggtccccctgcatctccttatgcaattagactttttaggtttccctgctccctttcaggagcattggcatcaacgttattctctcagtttatgaacacagtaggggaggggccattcctgtacatctctcacagtcagattaaagcaaagcctagagtttgtaaacataattcaggttctaattgccgagctgagattgggaaagaatttttcctaactctggtctagcaagtggctgtagggaggcctttctcaaaaatcagctgtatttgcctttgacattgtccaggagcagagcaccaggctttatgttgcttggcacaaggcagctcctctggttatgtgactcctgctgagaggattttcacaatttattaatgagctttccacaaccctgctttattctccaaacagttttacgctgtctctaggaacaacaaatatatctgggcactgtggttgaatgaataccagacaattgtgtgaatgttgtattggacttcctcttccctcccttcccaatctaaatagcattcctatttcaggagccgatggtgtgattcgaaacaactgcttggttgaaggatggggggcaggatcgagaaggagagagggaaggggcagtgctgattctggagaggtgtatgtagtgttttgtcttggtttattttaaagatcagagagtaattggaaacaattattttttaattaataacttgggaaaggtgaacagaagcatttcacagggttttaccgtgtgcacactgaaaataaaacactttatgctatgcttcaataatttatcacttcttgacaggggcttggaaaaggtccagtatgtaagtacaaatcaccaatttgctcttttataaatgagttcttttaaggagaaaatggatggctctccaagtggagcatacatgttctcatttgttttgtagaatatgtggggctgcaggttattgtgtcccttcattcacttatatcagccacctctaaaagcaattccattgtagtctcccactaatctgtagcgtcctgttttttctaacttcttccctgacctcgcctttgatatataagtctttattttccccttgccatctctctagtttaatagctctacagtggagtactgttttcaaccatggaactacttttaatcaagatcaactttgggaagtgctgccatttttatggtaataaaggactgtattatgcacttgaacccgctcaagttgtcccctgtgtataccttcacatagtagaaccatgaaacaaagtgtaaatgcttaaattgctttgttcttaactgtagtctcctagaggtcagtgaatgatttctagttgcattgtagcgaagacatttgttccaggttgaagaattttttacttgagaacatacattttccctgtctgtgtgcccccaaaccctgtctgccacactctttctcttgggctgtgacaaaacagaatgtttagcgagaaacaaaattgtgctcgattttcagactatctgacttcattttctgttttggtctttgagctattccttggctaatcttccaacaagtcgaattgattcttatttcaaaactgtttatcccaaaacagagctgttgacaagtacaaatacagatggcagacatgtggtatgattttcatgttctcatctcagcattcaggaagggaatgttattgaaagatggtttacatctgaagctttctgctcaaggcaatatggaatgcatgctaggagcgcttaattatgcttaattaataatagtaacaaatgcttacgggatttccttaaggtctaaaagtgcagcagcattggacttgctgtgtaaggcttaccgccccggaggctataataatctgtaacaatagaagcaacctctagggggtaaaattgtctttgataatcactgactcttgggtgacctcagtacagcattccaggccaaagatccagaatgttcccttactgggggcagacacgcctatgattgcactgacctttgtcctccgagcagatgatcctccagagtactggctagctcttagattcagaggtaaatcccagcccatgctgtggccttgctgttccccacagcccaactgcattaactataatttttttttctccacaaaaagaaattgttggtgaaaggaagacaaccttcagtttttctccccaccgacctggtttcaggaggccgtgtgctcagtggagtgtctctgcctgtcttcgctaagcttgcccctgaccattgtggaggtagatgccacctaagagtggcagggttagtcctgacctctggggtctgaatatccagcaactatcttaattccagtcgctgctgtctgttgtaccaccagtacacagcagtacagctgtgtctctgttgttgaccgactaacttagattcactgttgaagtccaattagccagagtgggggtgaaaatgcaagagtggacggtgagagtggtatgtgtcatgtacgacaggacagtggagagagccctctctgatacctgttagtccctcctttaaaagatgcgggaggtggccagggagtggggatttcagaatgtggtggcagaaatcagtttggcatttattggatgacagctgtaggcaggcactgtgctataccttaggggggtagataaaaaaggaaatatgacattgcaccttccatactgagtttgtaggtttgggtatttatgggggaaagtggtaccctccatcctttttttaaaaaattgggccaaaattgtaagaattcttttaaaaacctgaacattttagatggatttgagcatctcaactgtatgttcgtatcttgaaattccaaataa

SEQ ID NO: 113299 - DNA, 2042 bp, Homo sapiens
tgccctgtttacccacaggcccaggtagttcagcctcccatctttgtttttttccttctcctagaaaagccagcttttgtgtggtttaactgaacagtcatgttggatttttttttatttgaagacccattttgactcatctgcagcactgaaggattttcttcatagtaatttgggagttatagcagatagaaaggcagaggcatattccaggaatttcatgaaatataaaacactgaaacacttgggataggctagttttcaatgcctaggttacacaaatgtccaaattcacatgggcttaatttattccaagttttataatgggatggatgttggtgagtttggcaatataccaataatttggattaaaggagaggttagtttatgaaaagtttacgtaacaatcttaggcaattttattaccatcatgtgcatacggtatttcaagtcactattcagtgtttatatcaaatagacgttttattgaacttggaaaaatgaaaaaattaaaaatgtgtaatatgtacggtagagtggatgttgctgggatacagggctccttataccccgcccacagtagtgtgttagtcacaaaccccaaatctcagtggtttgaaacaactaatgatcttacttatgctccatgtgcacaggggcccataggtgggactccactgattgcagtcacctgggggcccaggccgagggaggtagcaccttatgtttccaccatctcaacctgaggaatcagcatctgctgtggcaggggaagggcagaaaggatcactccctggctcctaaaaccttttgcttaaagctagtgtcacttctaccccattattaggcaaagcaagttacacggtcagggcttactttaagttttcagaaaagtataatcctttcatggacccaggagagacaaccagaaatactggtgaacagtggtagtaacctaccacatgatgtgtactagtcatggttcctccagagaaacagaaccaataggatgtatagagagattttaaggacttggctcccacaattgtggaggcaagcccaaaatctgcagggtaggctggcagcctggagacccagggaagaattgccactcaagtctgaaggctggctgctggaagaactcccttttcctccaaggaagtcagtgttttcctattaatgccttcaactgattggatgaggcccacccacattatggggggtagtctgttttatttactttaaataggtctacttatttaaatgttaatctcatctttaaaaaatagcttcatagcaacatctagagtaatgtttgaccaaatatctgggtaccatggcctagccaaattgatacatgaagttaactatcatggtatgttaaccatatcctttgcattatacattttcttaatcattagtaaagcattcagaagtataaagcatcggtgtgatttttactatattgaaaaaagaattctttctttgttaagacttgggttgagggacctgtgctcttggtgtcttaatctatttttcattagattccaaagaaaatagtaactggtttcttcatggtttcagaagctgagtctgaatagattgttttggtttggttttgttgctgcagtttaatttacaattttccaattaatatattcctatatttaaaagaaaatgcagaaggtgaccatctttcattagaccaggtaattttatctcaagccaaccaaatgtgttccatccacatactgtgaggagatgatcatggagtctttagtatacctcagaacttgcctcatgtaaaatgtgtctcaaaggcacagggcatgttacagctaaaactttaccttatcacttttcatacagtgggtttttatggctctcccttttcagtatattcaaaactctttacaagtatcttcctcctgagaaagtgcatgtgttcctgtcttgttcaaagatgtcccatcaacaggacctgatctccagtttgcttttgtctttttcctaattgtgatattcttggcagagcctgcttc

SEQ ID NO: 113300 - DNA, 1479 bp, Homo sapiens
tgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaatttcataagagttattctcagtgtgaattttaaggctaatgccagatcctgcaaaaatctatgctaaccaggctgtagtacacactgttataaagaattttacttgtgtctaaaactacagtaattttgcttaggtaattgtgcttacctatggagcacaggaaggctcttaggttttgttcctacaagtttctttgaattttggagtaaatggaagtgtctgtctgtctgtcatctatctgccctatcataaaaatctttctccctaacattaaaatactgatccccgcccccaacttatctacctctattgtctaacacctatagtaggtgtgatcatgggataaaattcaactgaaaatgctatgataacattttatcgtttgctttaaaaatgtgctttgttttcaaataatctttacatagtgaactttggtggcgttagtgatatgtttatgcctatttcttttttttacacaaattccttggcatattttttcataaagaacaaaaaataaaatcaaaatttatttttaattcatgcttattgggatttaattattcagagcttaaaatattttgttatgtttatacactgtaaagctatctgttttatgcatttgttttgtctaaatgtatttatgaaagaaatacattagattatatttatgtttactcatttttccacctggattttttttaatggttgttacaaaattagattttttaatgggtaataatgttggtattttcatgttttttcttagtattaaaatttttgtgggttttttaaaatttttccctattctgttaaaaattaacacacctctagctaatgttcagtgtttgtgctaaataccaaattttttcaaaaggattggttaagtcataaagtggattatttatgatgactggaagatgaaaataattatatgattaaacaaagaatgtttcagaaatcacaagagaaactgtggcttatttttaacctgatttcagatggccttgtgatgccttctaagtgtctttagatttctcttgattcatttctgcaccgttatgtcatttgtcgttatatagatgtaaacttcatagtctcccgggtatttctatgggtacctccaccacaccatgatgttaaaatctagaggtagcccttgcctttttatgagagatattttctctgcatcaaggtttaggaccaaaaggaaaacatatgcagcagaagggacaaaatg

SEQ ID NO: 113301 - DNA, 1029 bp, Homo sapiens
taattaaaggtcatgttgacaaaacaaaacaaaatgtatattaaaaatcgttaatgtgcatttgggtcacagcctactcacatttactttttaactaacatttggaagccttctgaaagttccagtgtctaaagatgaaattatcaatgcagccttttagggaaaactacatctaggttgtggggcagtggcagagtcaacgaaagctcatgtcataccatccagctttgctttgcatcagactcaataggttcaagtgtttttcttcatttatataaaaatacatctaaaaaactctgtaaaattggacaacagttccagagccagtcagaagaggccagttctgtgttggtgactatgttaaatatattcttttgaccttgtgttatttttgtcatatgaaattctcattctatttttgatgttttcacatcctgtgagtgtgaacattagccagattgtctctttagaagactaaacaactcttcattcacagcctagaaaaggaaaaagtaatctcactacttcctgctaagcttgtctccataaacgtggtgacccctcctggaagacccagctagtattggaacgaagacttcatggctcagttctttaattcattcttgaattccctgtttgctagttactcctacaatgctgtcagacaggtgagggtgtacctgatcttctgaggcagaaaccttcaattggtagagttaaatctttcattgtcagcacctggtgagtcggctcaggccattcattaaacatcttttccaatcacaacatacctgtttcaaaacagaagcaacaccagctgctcattttggtcttttcttgcatctttatttacataaaactttcagcaaagtgatggggttacagcctgggtcgttgaagactaaaacacaatttttaattttcttaatgtcctaaaaatggtaatcaaccaacctttattcaaagcctgccaagtaataagcacctttattgaaaggtgtatctctcttgctttcagacttttctgtg

SEQ ID NO: 113302 - DNA, 1033 bp, Homo sapiens
aaagttagtgagtccagaggcagatgctgccagactcctcagatacacagagtgcagggatcgaatgagcctgtatccttagagcataggccgaaccatggctgcaccaaatacattcccacatttctgcaacaggcttgcaaacctgacccacttttttttttttctattttgaagattgttcttatttttcttttttttttttgattttacttcaagttctgggatacttttaaggacttgcttttgtcaggaaaaccagaaagggttttctctgtttctctgttctgtgctagagctagttgtgctgaacaaagagcaaaacgcatactcaggaagcacacagcagtgtgaacagtgtgcttttctataagcagaatatctacccattcagggttttttgtctttttatttttcttaatcctaaagtcatattttctgtcctttgtactctccaaaagctaattttcaggcaaacagataggtgctatgaagtagttgttttgctaaaaagggttgggttaaattggatttctgtttgcttttgcagtgttctaccatgaaatagatcctccaatatgatgctgtactagtgtaatatctatgtaatccttagctactttcataacatgatagacataggctgtcttggaattataagacctaaatactcatcctggctcttccactgatactttcctgggcctcagtttccttggttctaaaattaggtaattttacttccagctccaatattctgtcatcccttgatcatatttggcttctgtcttacagtctcttagatagtatttatgaaaatgccctctttgctgcttcccttatctcagacagatcaccgctatttcccccatacagcaagggatgtttagatactaatgctagaatgttcttgttaagcactataaatttactgtatccattttcacaagatccaatgcatggatctactggtgacctgacatctctggtacagaggataggccatgacagtgacctgagatataggctgata

SEQ ID NO: 113303 - DNA, 1013 bp, Homo sapiens
actcaaaatttctaatttctctttggttcttccttctctctcaaagcaataataataatatcaatatcccctagcttgtgttcaacatttacattgtgccacattcttaacaagcactggcatttatccccacaattgatcctaagagtcagaaggtcttatactcattctacatatgagaaaaaggatggcctggaattaaaatcaggtgtgtttgctccaaaagcctgcactcttgagctgttgggaggtactgttgcacagaagttaacagaaattcttttcatcctatctccatgtctctttccaccatctcctgttttcactctgattctttagacccttagagctccctgcttcctgcccagcctcaccatctttagtcttacaccatgctgtgtgatcacttctccttaagaatggatctacttatgtcattctactgtcccaactccttcagcagttccccttatcccatcatatcaactccatactcctgatcataagccagtgtccctgcacacaagtcagcctgaagaatctgttctttgccaactgccccctacactcccatactgcagtctcactgtcccctatctaaaacacacatctgcacatatctaaatctattctttaaggctcagctcaattgttattttttcccagaaggttatttgtgctctatcatcatctcctactttccctgccaagctagaggtgatccttctctttcagctgaaagcactctatttctctctcctctcctctttctcatgtatgtctgtagtgctttcatctctcagcccatgcatttacggaaccttatggaactccttccccattaggcctactgtgaggaataaagggatgaagaaatatgaaagccatgtaatgcaatgtttaaaaaacaagaatgctattacaatatcaatatgagaataaaatgtagaaacaattaagccagtcttattatactcaataagagtatatgatatgcatccatggggaatcct

SEQ ID NO: 113304 - DNA, 1066 bp, Homo sapiens
taggaaatgccctgctccagataacttctttattcttggcttctcaggcctctttgggacctatgttcatcaggtatttctctctgccgtgtcttcactttctctttataatcatagtcaaatatcctgtgacctttttcttccctttgccagatttcttgaaaacacagtccttaccactccaaagacggtccttctcaccagtccaaactcagtcgttctcaccactccagacacagtccttctcaccactccagacacggtccttctcaccactccagacacggtccttctcaccactccagactcggtccttctcaccactcgaaacacagtccttctcaccactccaaactcagtccctctcaccactctaaactcagtccttctcaccactccaaacacagtccttctcaccactccaaacacagtccttctcaccactccaaactcagtccttctcaccactccaagttcagtctttctcaactctccaagttcagtccttctcaccactccaaacgcagtccttctcaccattccaaacacagtccttctcaccactccaaacacagtccttctcatcactccaaacagtccttctcaccactgcaaacacaagccctcaccactccaaacacagtccttctcaccactccaaacacagtccttctcaccactccaaactcagtccttctcaccactccagacacagtcctcctcaccactccagacacggtccttctcaccactccagacacggtccttctcaccactccagacacggtccttctcaccactccagacacggtccttctcaccactccagactcggtccttctcaccactcgaaacacagtccttctcaccactccaaacacagtccttctcaccactccaaacacagtccttctcaccactccaaactcagtccttctcaccactccaaactcagtccttctcaccactccagagtccttctcaccactccaaacacagtccttctcaccactccaaacacagtccttctcaccactccaaactcagtccttctcaccactccaaa

SEQ ID NO: 113305 - DNA, 1090 bp, Homo sapiens
aacagaaacctatattgtcattagagtggcaaaagaaactgttaatgaaggaaaaggaagaaaacaaatatttgtatatgtgttttaattctgatcagtacatttccagtgagatatctcaatctgcctttcaccatagccctgggagaagcaggatgggagaatgggaaagggaagcaggcaaggaagatggcgatgatcattaatggtaagttttcttaccatttcagaggaggcaactaagccttggcaccctgggtagcttgttcagtgccacccagctaatgacggaagaggtcttctctgaaaacgagcagagacaaaacacaggtacagaggttaacaaagaagaggcctcacttggaagtttcctcctctgaaaatagtgggcttagacagaagtatctcaaaggaccttttctgttctacattctgtgattctactagtaaaacctgacatgttttcctctgtgggtactgcaaaggaaggcaaaataaacattatgtggaaaacactgattgaaagctttgtaagaaagaataaaaagaccagttgggaagaaaaggaaataaatatctcaagagaaggcaaagtgatcaaaagaatcattaaaaacaggataaaaagaaaatcaatattaaaaagagataaggtagagttagaaaataaatagtaatgtgattcctttcaagaatgtgagcagacccaatagagatgttaatcagtgagaataattttagtcattactactcaaatatgatgtacaggacacttgatttttctgggtcttgtcatgaccttgtaccatgaagtcccccttgacagagtatggctaagggtggattatttaccaagatagctgccctcacccattacattttgtagtgtttttggttttaatattgtctttctcaaaagggcaaacttatgaccaaggtttggggcaaccaacttactagttgtgtgactttaggggagttgcttaacctacttgtgtttccagttccgtttttggaaaaagcagagcaataacactatctgtttgtatggcttttctgagaaggaagtaatactggctgcaacgtgctt

SEQ ID NO: 113306 - DNA, 1025 bp, Homo sapiens
tcatcaataagaacagactgagtcccactaatttaaatgattctttcaatttagcaaggcatgcttgtttggtttatttgtttgtttttcttttttagttcctataaattttagataaaacaagtataccaataagtatgctacaaatactgcttttagagtgctaatttagattcaatctttttttcttcagtattttctatccagctgagttttatgcttttaactttcatcttttcaacaaggtaagtgatttggtatctcttgttattagttttctaaattaggaatcatgcggtctacttggctactatgccactatacacgtttatatttttttctccttttacatatgtttttctcctgtctccctgaccattctgcctcccttctgccaccttcaaattgtagacattacaaagggtctttccttggccttatcttgtctatccacattgagtgcttaggcaggcccttccattctactggcttgagctgttagcttcatactgatgattttcaggtgcaaaccatccattgcaatgtttttaactgagtttgaaccctatgtttcatttaccatttagatatctttacttgactgtcttaacaagaccttagactcaagatattcaaaatggagtcatgtttttcccaaaaactgcctctttctcttatttctttccttatttttagtgaaccaccatcctcaaagttactcaagctggaatccttcacatcatttttttttcaatttcccgatcctacttctgtaatattttttctgctccaaaagccacttccttaattcaggctcttgttgcctctttctctctaggctatttcaatggatatcttactgataattccatttctacacccaacttttgttatgcatttcatagtgcttccaatgactagaattctgatcatggctctctggttcagatatcttcaatggttatccagtgcctatagaatgaagtttattttgggggacaaggtactctagtctattttccagt

SEQ ID NO: 113307 - DNA, 1638 bp, Homo sapiens
catcagtggatttggtattcacagaggtcctagaatcaatcctctgtggataccaagggacatctgtattgcttatacagttgattaattattacagatttgtcttgggttttaaaatggttttcacttacaagttgcacctcattcatatttatttattttgttggagggcaatgctggtaggagaggaagacacttatttttggaattgggatcatacattctataacctattgcagagagagaaattttgtggtgtttttaaccattgtgtattaaaaacaagattgaagggcagcaacaatttcaataatttcatgtaatttccatttattttatttcctaaaggagttgaattatattaaatttgggcagctaccagttttgtaccaccaaacacaatagattatgaaatgaccctttaaatgaagtccctctgtggccttccaatgaccagctacccaccaaccctagtgacatatctgatcatggagacatctagatacccatgatacctatagcactgttgtccaaaatttgtgttctaatatgtcagtacataatgctgtgtgacagaactgcttttatttttctgtacatcactgtgttttaaatttaaagaaagaaatggatgctagataaattactatggtttgggatcacttctacactccccccaccttcccaaaataaaccccataatattttgtaaatccaggtgcggctttaattacaagatctacttttttaaagaaaattaattacaattttttaaaatatctaacacactttccatttattcccaccccacctaaccttcaggattttgtacctgtacctggtaccagctggccagctttctgccaagactgcctttaatacactgtcagttcacttcatgagtccctgagaacagttgaagttgatccaacagccagttgttcaaagattctattgagagtagtttattttattcttgagcatctgtaaagatatgctccattgcgaattaagcctttttagtgacagagtacctgatgacagaaccccatcagccttatcaggataagttccctgacctcattattgctaatggatccatggtaattcagcctgttgtgaattctcatgttcaattatgcaggataatgagtgactcaaaacttaatatgtctcagctatcgtccttatgatgggacttgtacagcttctttcaaaagtgaaacaatgttttaagtagagtggttcacttttatgtccaaacagaagttatcactaatattcagatgacctgattttaaaataagacagaattgctctataactttatatttcactgatccttttgtaggagagttaggacaggtttattcatttttaaatgttaattctggaattctaaaagtatgcaaatggcatttgtctttggattcacaaaaactctagatattcagagtttgaattatttaaactcccacaacacatgcacttttgcttttcaagcatgagttataatttaattaaaaacttctggtgcattgctagcgttttaaatattaatatgttccatggatcactttcgattatctactgtcttgaaattcttgaagatgtcagatttttaagattcccaaagtt

SEQ ID NO: 113308 - DNA, 1080 bp, Homo sapiens
tgatgatcaatctcaggcagcccacttcatagccaccatacctgtcctcacctactaagctcacatactctattcagtaattcttcagtctcaccaagaccccagattaactgacctttcagtcaccatcctcacgactttacttcccttcttacccagctttgattccttagtctaccattataatccctccttggcaattattctcaactccttcactctttctccctttgatgtacttgctcaaaaagccccaaccctggttaaagccaactctgcctactccatgcgtgcaatggagctgctcagattccatgacctgtcattcacctcactccctggcagagctctcagcttcttcacctctccattttacctgcttcacaaaggcccaaccccgcttctactggagcagctgagctttgcttctcagagagcaatacacattggtctcatcttgtgttgaatttatgaccccacatttaaggtgtcatctaacacctcccagaaaccctaccctacttccttatagtgtttctttttctactcttcaaagggattgttaccttatcctctatcttcaagtcccttttacctccccaacactctcccacttgcccattgcactcacgtctcactgactttgcttctgtttctcaaacatgccagtcttgttcctgccttagaacctttgcactggccgttccttctgcctgaaacaccttgccgcctttcacatcctcagaaagacctttccccaccctctccttgagtggctacccagtagcaactcagtcactatcatatcatttagtttaaacttcagcttagtatgtatcattattttgcctcttgtttatttgttgttttgctttttatttctctcttaaactagaatgtaaacatcatgagagcagggactttgtctacctagtttaatccactgagtcacctcaactgtgtaatgtaatctttgaggaccctgttagccgtacacatatgtgctagttcagaggaatcaggtgtcctgcatggcaggctactttcacaactgtaaccaggagtgccaaattatgaaaa

SEQ ID NO: 113309 - DNA, 1053 bp, Homo sapiens
ggcaagagcacctggtctttatactcttacactgaccagtcattagatactggcttccctcctaccctccatgagggctgtgaccttgggtgagtctgctctcttaggctgagggcaagtcccgaagaggaactctgctgacatattttactcacctaacactccctgcagctgtgggtataagtatctcattcttgaagagagggatctgggtggtgctccacagcatccacaacacatgtactaattttttttaattttatacttagaaaagggactaaatttagcataaaatgggggatttaaaagcactttaagaatagcatttaattaaatataaaatgatacttaaaaaatacttctcccacagtgttgatcacataacagagattctgaataaatgttacatccctgcctacctttctgacctctgccagatttcctacttccagcctctctggttttctcagttcctgctcattctttctgtttagagtgtctttctgcctaccctcccacctcaacttgtttctcatttgactctttaatgaagccttctttgaaccatatagctgatatatatttccctggttattcttcattgcaacaccttgtttgatttctttcttgacctttctcacaaaatatacttatgtttagtttgcttgttaacaatttatctctgccattcgactgtcagcttcttgagtactggaaccatattcgttttgtttatcattacattcccagaccataggtacccaataaatatgtgctgaaagagtgagtgaaagaatgaatgagccagagttctgtgatctgtaagggatatgctttgttgtatagaggcataactgaatctacctgtacttctcatctccacacagtttaaactgtggattatattagtttaaattcatacttattttctttgttctgaaaataattccatctaataatttaaggcttatgcattcttctcatggtagatcttggaaatttccttattaataataaatgcttggcttaaaacatacagacaaaaaatctgca

SEQ ID NO: 113310 - DNA, 1061 bp, Homo sapiens
ctcaggattaagaatctcactctaaaccgctcaactacatggaaactgaacaacctgctcctgaatgactactgggtacataatgaaatgaaggcagaaataaagatgttctttgaaaccaacgagaacaaagacacaacataccagaatctctgggatgcattcaaagcagtgtgtagagggaaatttatagcaccaacaacagacatctagcaagtctttaccttattctgcaacttttgataaggtctccgtgtttatgaccattgttgggaacaagcatctgtctttggttggtgtctttatagactcctccaacagcagttatgtttgtgaccatgtaattgataaacaatttaatcctattatctcttaaagtttatcttagaatatttagggtttactttgtcattcttattcaattggactgataggaattctattttaacttcttataacaagttagtagtaagcatataagcatacaaattgtaaaacaagtggattttttttgttttctatgaaatcataggatgccacagtattggagtatagaatttaatgcacaactaaagtgaacaagtcttaggaaagcagtacattaagagcaactagattctagacttatttctgccttttatttgcagtgttactatgggcaagttatttaatctccctagctctaggttcataatttattaaatattatgacaataatatctatcgtaaagggttgttgtaaagattaactgaaatatgcatgcctgtaaacttcttgtcatagaacctaacacaggtaagtgctctgtagcttctatcatcataatcattattaccaaattccctgcaaatactaaacaggaaacaagtctttgaaatattgaatataaaaaatgtatgtataggctgggctcggtggctcacgcctataatcccagcactttgcaaggctgagatgggcggatcacctgaggtcaggagttcgtgaccagcctgggcaatgtgatgaaaccctgtttctattaaaaatacaaaaaaattggctgggtgtggtggtgggt

SEQ ID NO: 113311 - DNA, 1033 bp, Homo sapiens
gatatatattcttggcattttgagtgtatgcagattggggctggagctgggggacagaattttatacaatgtgtcggagtggagaggagatttttgtaaaccattcatgcagaaatcagtgaaaacactgttcccgtaccacttcattcagagctattgacttcatgtagctaaatgtttgatctgttttgtttgacattctgtaccctcaatcatcattacctccatgtcctttcacaaaaattgttttccaaaagatatttccaagtgtaactaaacttaggtagatatgaaaactgaggtttggtctgcaggggaaaggcaaaaagtaagttccaagggccaattatcgatggtttggtagatctggttgcaaaatgaacctgtgaaagagaaaaacatctattgtttgtccagagaagtttgaaaaacaggagaaggttttgacaaacactgaaaagttccataggaagacttagcaattcttagtgatggaggctaacgtgagtgtgttactgtgtgtgtagataagcactcttgtgctgcagggaatagcatcttaatgaaactgagattgtaattgttaacgaagaaagaatcaaaaaatgaggaagaagaaaaataggaattatgaacagtgttaaagcgtacaaatttaggggagctatattgaaattttaagttgaaaaataagttatatttcaggatttcccatttgctagacattgtgtaagaaaaaattctacgggatctgagattcattatatttgttttgaaggagtcagaaagttagaaactatttcatttacataaataaaaatgttatcttgataaaggaatgagacatttattttagatatctacagacaggtgaaataaaaatcacataacctgtaattgttgatgaaatatcatgccatatgattatagactgtatgaaaacagaatgactttactaaaataataagcaatttaggttgattgcaaatcaatatttttctcaatcttagtctcccaataaaaattatatttt

SEQ ID NO: 113312 - DNA, 1144 bp, Homo sapiens
gcctccagcccttcatggcctggaagctcaattcttcatagctttcctctttcctctaggttagaacaagccaatttacggttcattttggcacatttcactaaacagactgtgtgggtttgagtaacctgaacctgtgattgcacactttaagtttccatcaaagttattagaaagtaaccttttcatcttacattttaaattagcgtataacatggatgaactggaggacattatgctaggtgaaataaaccagacacagaaagaaaattactgcataatctcacttatatgtggaatctaaaagagtcaaactcatagaaacagagtagaagggaggttaccaggagccagggagttggagaaatggggagatgttgaccaaaggatgcagacttgcagttataagccagtaagttctggacacctaatttacagcatcgctactatagttaataataaagtattgcatatttaaaatttgctaagtgattagatcttaagtattaagatcatacacaaaaaggtaactatgtgaggtgatgggtatgttaaatagctttatcatagtaatcattttgtaatatatatgtatatcaaaacatcatgttgtacactttgaatagatacaatctttgtcaattatacctcaataaaactaagaaaagaacagtagctagcatataaacaaaaagaaaagtgaagccatgttttatataatgtttttatattgataaaatctactaagcctcttttgttctttatttctcagagagggaaaaagactgtgcatataaatattaaaaagatactttcctctcctaaacatatactttccacacaataacccaattttagcttgatgcatgcaactgaatcagtatggctgtttaataaccatattcctaattttgataaaaatcatagtctttttaacatttgagtctgtcacctggtatacatttacttgacaattttatgtaagtttagtttgcatgtacccctgtgagagaaggagcagtaggaatgaaagaaaagctgaactatatcgtgtatagggaggggattggggcctggggagactcttccttcttctgtttaaatgtttatctttgtgacaggaaggagatatgggtattaggag

SEQ ID NO: 113313 - DNA, 1135 bp, Homo sapiens
aggggaccatggtggaggcaggaagaccagttagaaagctaatgatattatggcaagtgatcctgttagcttggaccagagtggttgagtaaatctgataggagatagttgtaagtagaactggaaagtagaactaagagattgaatgaaggttttttgggaaagagaagagtcaaagatgactccaggcctgagcagctggaagtgtagagttgccatttactaagatagggaagattttagggttgagcaggttgaaggaactcataaggataattcagcatgggagatacttggattccactgactttcagacatctaagtagagacatcaggtaagcaatggactatatgagtctggaattcaggaaaaagatcttaactagagatgtatatttgggagacgtcagcatctggatgggttttaaattagactggaagaaagcaataataaagaatgaaagatatcagaggatcaagtgctaggacactgcaatagtaagagattcacaaagtagaccaaggaatgaccagttgacttaggaggaacactgagaaattttggtgtcctagaagtttagcagagaatgtgtttcaaaaaggggagagtgatcaactacttcagttgctgctaatatttcaaataaaatgaagtttcagaattgaccattggttttaagaagacagaggtcattgaggaccttaacaagagctatttcatcaaagttttgtagttcaaagcctgattggatgggttgaggaaagaatggaagaagagttaaagacagtgataattgataactctcttagggaaatgtttctgtaaagggtacagaaaatggggtactaacaaagtaataaaatatgaagagaagattttgtttaaattgggaaaattagtggcatatttgtgtcaatcggattaacccagttatggagagaaaaactgatacagaaaaaataagggagagcttgtggacacatgtccttgagcaggagaaagggagtgagctctagtgcatagtagcctcctagagagagagatttattatgggaattgactcatgcaattatggagcctagaagtcccactatctgctatctggaagctgggaaaatggcaaaggcaatgatg

SEQ ID NO: 113314 - DNA, 1049 bp, Homo sapiens
tgttttaataagtaggatttaaagtgattcttagattaaaatattgtattctctttggccaattgcaaaagtgtgcacaataaaaaatgttcattctattatttaataacaaaacaagtctgtctgtggatattcacatgtgtatatgccccagaaagtcatggtagcattgttcatttaaggtaagccagtccctcttgggccacatgcaaaacacttgagtgactgttatgacacagggactttcatgtaaataccaaaaggactttttttcttccaaaagtaatgaagtagtcccagatctggatcttggacactgtctggatatatagtacctctgtctatctgtctctctctctctctctctctctttttctgtgtgtgtgtgtgtgtgtgtgtgtgtgtgtgtgtgtgtgtgtgtgtgtgtctgtccctctcttttctgtcttaggcacgcacaacctcagattctctgaaattttaaaattccaagtagaattcattaataaaaatctgaaatgttttttctggtataaatcataatgaaatgttgagagacaaaggaaaaactaaaacgggcaaataatcatctgctgctccaaaactgaagcctgtcattacaactcccaactcaaacacttagttttaaagatttgccttcaagaaacctaaaagctggtattctgcctcattggcaacagcctcaaactgttccctgtcatcgaagaaaacaaatcttttgctcatttctgcctaggggaggcagagggaccgaggtggtcctatgtggctgaattagatgaaagacttgccttccaccatggagacatgaagtctaatcaagtgaaatgagttttgagatcccagctcatttcctaggggagaccagttcacattacaaaatcatgacatctcattcatcacaactgacgtggtctttgctcaggagaggaccccaactgggactaaaccacctgtcttctctcaaaaaggggcattttatccaagttagagttgaaagccttggagtgaggaagcttgccagccac

SEQ ID NO: 113315 - DNA, 1050 bp, Homo sapiens
atggttacattcttatgtctgatgttattaaaacactaacactgattcaagttagttcaaaatacagaatatcaaaaactctaaattatactttcaaatgtttgtgtatggccatttttggttttgggggggtttggttttgcctattcttaataaaatattttatgcaacatattagctatatttggaactcagttatattgaaattcaatccaaatggttactaaagaacaatactgtgatcatttccctcttttatttaaattcctgataattctatcttagtgacctaatggttgctacttttaaagttcctgcaattatacttatattaatcataaaatgctaattactcattacatatattcaattcctaactactaatttaaaattccatgacattttataagctactgttagtgaaaatccattcataagcataagttatattgttttattttaaacatgcagtgattcatactaatgtgctgtgcatagatttttttttaaactgtcaaagtgtgtagaagttgccctctactggggaactagaaaaattatgttaacatagattttcaatttccttaaagacttaggtaaatccattgatgtgatttaccagatgattgcttcttgctctctggcacttttaaattctgaagatattgaaatgattagcagaagatatttaaaaataaatgtctgatatgaatatatgtacatccatttctaatataaagtcttggctatttcttattaaaaattccttagtaacaacacccaatggctaaggtctagaagtaattttattgggataagtctctactgaaacattaaggaaaattagctgtatatacctatgtaactaaaaatgactcagtactgtttttaataattcaccatagaaatgtccaggttaaaagtctaaaagtctaatcactctctctctctctctctctctctctccatatatatatatacacacacacacatatatatgtatatgtgtatatatatattttgttttttgttttgtgctagagcctttgc

SEQ ID NO: 113316 - DNA, 1040 bp, Homo sapiens
ccattcttactgatcatttgggtcttagtttagatgttacatcttttgaaacccctcgctcagttgggtgaggtaagcagcctttccttaaccccattatctggcctttacctttttagtttgctgcaactagaccgtaagatcttttaggatagagaccaggccacctttatctttgtttcccccctcctcttgggtatgcctatcatagagtaggtatccaaaaattatttgttgaatgaaatcacaaagatcctaataatataaaattgacttgaaacataaaaataatgatatggcttgctaggttttagatgataaattgttcgaatttataggtttcctggatctttgtttttcatattgtgatatattcttaagcatgctgtgataatagaaaaaatagattacaattatgttacacatttaaatactcatgaaactgttttgtaatttcaaatgaccaacttaatagaaataaaattagttgaaaaataaatatagctgaaaagttataattgaaattaaaccgagttgaaaagggagacatgtatctatgtaattctgaaacttaaggctcatagctttattttgattcactttctttttcaaaaatagaatttctcagaagatcaaaggttttctgaatcctaacatgtactatctagttctagatatccagaagaggacattgtttttgtcattgtttcttgggctgccctcataccttcagaaaatacattacacatattgcacatatatgtatttttctgttataaccaatgaaacataaaaagctaccaaagctctcacatgaaactgctgtttgttgttttttgttgttgttgttttcttaatactagttaatttcagaacttattccacacagttccccaatagagttggtcatcagtttgtaccttagcttcctagtttataaatcagtcattgatttctatgaggaataattttgaattccaaccttataaatggagattgggcccataaatgctttttcatccataagacaactgaactac

SEQ ID NO: 113317 - DNA, 1046 bp, Homo sapiens
tgtatagtaatgacaaagtgcgactgttacacactctttaaagtaatagaaaattattatatctttggctatctcacaatatttacatgtcaagtaaattattttataaaaatcaggcattaaaaattctacccagaaagtgttgaacaatgaagatatacattcaagaatgtgtggttcaggaaaatttacataaatttaaatgatacgtttttatgtactgtagttttctccagaagaaatctgtatgctttctgaaaacatgactcttagatgtttaaaagcttgtcaaataccctacaggaaaggtaataaagtcattttacttaaagcaaatcattttttcaaatttcctcaagcacatttatgtaggtactgagagagaacaggagttcttttacacgttttaaatacacagcacaccagctgctaccccagctatccactagagaaagggagaataactaaatttctgtagcaatgtgtaaaactaaatttattgaaatcccagtgaaagcttttgctgtgtttggtataatagggaaaattccataagatatcttagattgcattttcttcatgttaatctttatagtccttgtgctcccaggtcagtttgtaaacatacttcattcatttagaatgaaaactctcacctcagaagccaacgaggtttggtaattacagaacattttatttcaaataacgtgactactccttgttgtaaacactggatccattgaatttggttcagagaggttagagcttggtgacccccattagttatttttcctggaatatataagaaatgaatttgtattctaaagtgtgtggttttgatgtgctgatgtcagcctttcttgtgtctatatccaatgctttctcttagttatatttctggtttcaagtgcttttttaaaatttatttttcatttattataagaagccaatgtatgtattgaggattactcatattttctttcattttcttcctcttttcacctatcctgtgttttctaaaagtagatagaatcaagtgtttttgt

SEQ ID NO: 113318 - DNA, 1735 bp, Homo sapiens
ctcacaataacactaacttgtggagaagctgttgttatcactgttttactgaggaagctgaggctcagagaggttagataacatgtttagggtcacacagatggttaagtggtagagcaagatttgaacccagggtgtctggctccagggtccatactccttatacctgctggaggaatatacaagagatgtagcccctgtcctcagtggcttgctttctcatttttgtgatactaatcatgaataggaagttataatagaagacagactagtaagtaactgaataagtgcccctgataggtgttgcaggtcatcaagtaaaaaggaagattaatacaggctgggtagctctcaaaataatttgtcattatttacttaaaactgagatgcctaggaaaactttaaagttcctaaacaccgaatgttaataccaaaagcactttcatagactatagtgtctttgtttttacatgtgactctagacactaactagtaggagttgtcttttacgaattatcatttttttcccaggttattttgaatatttatatttctagggaaactgtccatttggagaactttcacttgtgacagaaattgaatatacacttgataaaaatatgttactcaaagccaatttaatagctagtgggtttgttcaggaaggaaggaaggggcacaagttgtattcttttatggtttttaagtctttcttatttaaagttttaggctggacaaaatgttcctttgttttctgcagttaatcaaatcagtgcagggttactacctacgtaaaaataataacttgctaatttaatgtcaaagccaagaatgaattagtttcatgtgattagttgtcaacagctttggagatttttggcagtctggttaagaaaagctatgtaacagtaccatggagagaacatttgtactgttaagctttcaaactcttattcagctgtcaacacatgggcattttctgcagccagatactctcatgctgtgtactgcctgcagcttgccggaagcccaaccttgactgaaagggttgatttctctgctcttacccttgttctcatttagtgttaaaacctgcttaaagtcctctttttattctaaaaagtacacatgcatgtgtcatctcttaaacaattctggtgtcaaggtaaggggccccaaagaaatgctggacatctgaatgcataattgattagaaaggagcctggcagtgttaattctgagctgcattataatgaatgctgaaacagagctttcgggattgttccaaaacttaaggaaagtttttaggactgggcaagagggtcagtgtcctgaggtggaatttaaaggagtgtttttgactgtgatagttttaaaattgcctttgtcacttgctattgttctttgattgaaggctcatttgttatcaactattcattgttttattgttgtttgttttgtttttaatgtttgcctgaagtcactttgtgaatatttatttattagacatactggtaaggtagggttggtagaagagtataaataactactgaataaacagaagcacaaatgttggataaagcaatgagttcttaagtcaatacccaacacatagaaaaatgaagcagaaactttaattctcgggagatctcacaatttatattttaaatgattcttttcaagcaaggttgttagaaaagacctcttaaatttcactacatggaaaacattacag

SEQ ID NO: 113319 - DNA, 1092 bp, Homo sapiens
gtgcctccccaatctgctcaggggactccctttaggaatataagctgacaccaccttgcctgagcttctttcaatcaataacatggcagagtacacatgatatgaataggcagaccgataagaaagaaaagcatatctcttgatacaaatggagcgataaaaggactggtttctatccaaggactttgaaggagaaatcaaggagagaaagatggccaaatgagaatgtatagtcaattaatttttcttctgaaggattttttttattacttgtgttccgaagagaatggtcaagttgttctatgccagaaaggaatttgttactctgattcttggaacaacaagcctcttgggagcatgcattttgtgactgtaaatctacagtggcaaaattgtgttaatttgactgactagaaatattaaccatattatatcaaataactgccagaaataattctctatcatgccctctgactttattttaattgatttttttttactttcagcttctgtgatttttgtttattctgacatatatttattgaatgcataaagaaaattgttttgcaaattatttttagtgtttttatcttgtttaaattggtaggttaactctttttctgcagaattccaaggttttttattttcagatgtgatactgctgatttagctttgtgggcccactaatggcattattgtccacatcagcagtctgtacaattaagttttatgcttatagtatcatttgatatttatcaaagatgtgaaaatcaaaattgaatatgattgattgctatgagatatgttaatattgggattcctaggctatgttatggaataaagcattcgctgtaataacaaagataaggcctctaacattactcattttatgttctatcagtaatcaggccttaggagtaagcgtcatttgtctgctggagatccctcatgttaaaggaatcacaaggtgaaagttcactgaatcatcatttatgatagtaggatctaccagtcaatatcaccagtaaagaaatattcaaagggagataatccatctgttttatcagcgtgtttgcttctatttgccttgac

SEQ ID NO: 113320 - DNA, 2189 bp, Homo sapiens
tttgcacattgatggcaagtagtttttatagagcagaactctctttttcagaaattgcataaccatgttttgcaagtacaattaatataatatcacaagcctattaccacattattacctgactagtgaatgcatggttaatttaggcaacctatgtgccttttctggaaattcacatactgtcaaaactatgggatttttttcttcattattattgtgattttgtttctctgcctttgatagggttgtagattgatccagagggattaaaactaacatatacctggttttaaacaaaagtgtatttgacccatagtactccttgttatatatttggatctgaaacatcttttggatagttttcttcccaatgggtattagattttcctcagactgctttctaagagacagaagctcagctctcttgcttgcttacccatattcttgcatacacacacgcacacacacacacacacacacacagagagagagagagagagagagagaattatttgtcaagcagatatttgtgtagtatgaatcactgaatgaactctgaactgcatagtttgacaagacttggggccattcttcaagctatcaagaattttaaatctctcagctaggaataatatatctgatataatactcaatagtgggatgatctagaaatactcaatgaaagagtacttaatgcgatgttctttggagaggataaaaatataaggaggaatacactgatttagaagaaagtaattaattgctaatattgacattgatgatttaagtttttcttccaagtggacagttatcaagattggggtttttgtctttggagaagactatttctcacttttctgatctcttcagttattctggcagtttcatagccaattacatgagacaaaatatttgtttcattttagatcagctatcctagttttgaatatacattagtcttaccagcaacagtaattataatattaagataaccagtaacttttttattggaggtcttatttctcaaagacctgtttatcctgatgatgttactgaagcgtctgataaatctgcatcaataaaatctgttgtattcatcaattaaacaaagagaggctgcagatacatgtatatatgtgttaaagatggtcactttggatagttgtaaggataattgctgagaacaatgtagacctcagtgaaacagactgatatgaactattctgagctattggaccagcatatgtctaaatgaataggatcctaatggttttgtgagctagaaggtagaatgaaagtaatttggtcagcattcctaagtctgcaattctgttaggctagttcagacactctccacaggaagtggacattgaggtcagaagttgggtcaaagccttttaattgtgagcctccatgatgcctctgggcttgggtcaataccctgaaaggctctgtttgtgggcctggaaagggtatattatgggggctcaggtggtctcttgactgttctaatactcaattgtgagaagcagattatctgctttgcagattatctgatcttctatcatcagccttcccattgggctttgagttgccaaggatggggctaaaatgtgaagtacaggaagttaggcacagtggactctgtgtgcaatcccattacaaaaccaaatataaataattcaagaaccactttgttaaatgactttagttttatttggtttggcctttttctctatcttaatctatattctccagagttgactaagcctcatttattttattctcattttctagaaatctttagactagaaaatagacatgtcgtaaaatctattcaagttggaatgacacaaacacctttccttcttttatgtactctataatgtagattgagcattatggcataatttaatttcttctctgaaaattcatgaaatcattccagtctaggctgtccttagcaccctggtaatcttggttgattgtgtctcttcaaactgtggtttgatcagaagaaagactggttatctttgtgattcagtttctgtggattaggaaattggagctgtattgtggattatgttttttatttaagaccagaacattatcgttattctcccatgttttctaaaataagaagagagagagagagattataattttctctatagctaggcagatgaact

SEQ ID NO: 113321 - DNA, 2653 bp, Homo sapiens
agtagaaggactacctcagtgaattccacctccaccatttacaagctctgtgatcttgtacatatttcttaatctttctaggactcattttcacatctgtaaatggagataatgctaataagctcatggggttgttataaaagctaaattttaaaaatgcatgtaaagaatggagcataatgcctaacacacagaaacacttagtagcaattgactttttttttttttttttttttttttttttgagacagggccttgctctgtcatccaggctggagtgtggtggcatgatcacagctcactgcaaccgctacctcctgtgctcaggtgaccattccacctcagccacccaccaccctgcaatagctgggacacaattgacttttaagctgagacctgaacaatggaatttcctaagtggagaacatttattaagagagaacaccatgatcaagggccttgaggcaggattgcccatgttgtttttaaggaactaaaagaaagccattgtgccatgagctcagaaaatggagaggagaattgcttgagatgaggctgaggtagtcagtggtagcaaggtcatgcagtgtcttgtgggttttgttaaggaggtatcagggctttactctaagggcaataggaagaattttcacaagagaatgatgctattcaatttgagttttagaaagattattctggctttagtattaagaattgttcaaaatctttcaccaggcattgaggggtctggctcatctcttaagggacctttggggaaaaatattggtggatatttttgctattgtcatcttcataggtgatgagccctgggacaacaatgagtgacataattggcattgccaattttttgtttttcagtaaatctgaaggtcataggtatgtgagtatgagtgagtgtgtgtgtgtattcatctttgcacacatatataaacataaaaatatatacatgcacatatatagacccacacatatatacacatacatatatatctcccactagagagacagccaaggtgtttttctctcttttctgcctctgaccattcaatctcaatgttttttaaattatggcacataggtttaagagataagggagatagaatatatttaccaatccttttagtctgtatggtataatgacatattatcatggttacccttcatgtgagaatgggaacatattatgttatgcataatgactttataatatagattcacgaatttcagaaattatagagatacaacagagtcctgtgttcttttgcatgtcatgatgaatgcagcagttgtatgtatatacaagaatagatcatactgagcatcccctgagctccgtttgcagacaagtcgtatctccaccatgacaaaattcccacaagattttgaattattaatgtcttggaatctgcgggtttcagcagatatgttcagtgttattgatggcaaactttatctcttttattcctgagacgcataatgaaatagggagttcctcaaataaccacagttactgtttagggtaattttgtaggggccagtgggcttttgccttaatgtgtatgaatataatttttctctctcacagcagaatgtatggaagatagagggagaatgaattggcactaatttatgaacctccagccttctcagtgcagtataccttgtgagggcaagatgctctaattgcacctacttcacataatgagagcttttaatgacaattactgattagagttagggatgtatggggactttagagaagatgtattgaccttgagaagacaagacttcatctgccttttatacacctctgtccctaacaattgaccagcggctcaatgaaatccagctctacagacttgcaccaaatatttgagcagattttaaaactgaggggctgaggtacactttatttctcaactcaaattatgtcagacagttcaagaattctgtttgcttttagcagtgtttttactttacgctttttcttccttggtgatggtcacacagactgtttttctgtttggtaacaacaataacccatagttcagactgctctttttagagacattgatttgcaccatcacaaatggagacctgacattgttttcctcttaacacatttgcagtgttcacatttggaaggccaatatttaaaaactggtatattttatataatatgtatatgagaactgtaagaaagatgaacaaattaaagaaaattgctgattgttttattaagggcaagagtttatatggtctacatgtccttttttgagcaaagcagtttttttaataagtcaagatgacattttatgtgcatgtcatctttttatgaacatttagacattttaattacacaacacacacacatttaactagcaagatgatagtgtcctttccagcttcactatctagctctctccttaatgaaaacagatcaaagttaatttgtttttccctttcaagttgctctgagcgttagtttcttctaaaacccctcttgcttccgtatttcccacctttacaaccattttttttttgttttaacttttctgtatgtctggaaaatctgattttagaattaaaagcaagaagtacttacaatgcaggcaagtttaaacccagtaga

SEQ ID NO: 113322 - DNA, 1562 bp, Homo sapiens
tgcctctccccgttacgtggtcttaaaaatgttccttgatttctctctttccattgtcttcccctccccgtatctgatttatcagaaaatgctatcggatctattttcaaactgtatcttgagtttatcaacttctcttcatcttcactatgactattcaaattcaagatgccattaactcattttgcctcttgtgctgtaattatgcctgttgtgctgtaattattccctaattggtccacctccttctactctaatccccctgaaattttgactccacacattggctgtagtaatctttaaataatataaacgtttacattgtattcccatactctctcccaactctttcttggtgttaaaaacctttcttaacttcctattgcccttaggttaaaatctacactccttatcccaaccagtaagccctgttatctagctcgcccttcctctgtggctccaccttatgctacaccctccacagtcagctcaccacagcagcaaagactttctcccctcaagcatttcaagcctgttttctcctcagaacctttgaactagccaccccctgtgtctagaacactctttcctccgatcttcactagatttgctcctcttgtcactccagtgtcagctcaaatgacagctctacagtggccttccctgaataccgccctagtgctttctatcacattaccctgtttattctcttatcagctaggttaccactattaaaagttaatcttgttaatttccccattgcctgtcaatctccactagagagtcgggtccttgtctgcctttttcactcccgttctcctgctgcttacacagtgcctggcacctagtatgtgctaaatatctgtagaataaatgaaccatttttctaggattcagctagagcaaaaaccctgggactttgggagtcttaccagtcactggtctgtgatacctagtcacatgcagagtttctcttttcccactttggctattttttctctccattcttttctcctttttcaggatgtacttgttgtttgtttctgcctctcaaagcctttacaaagccacattttattcttgtcttttgacatcacccacagattcttttctgaagaatagtaattccagcatgctgtggtccataaatctgtttcttattatgtcaaattagaggacttcctgatcactggtcctaggcttgtctacttttcttataacaaatattccacggtttggtaagaagttgatggaatatagattctcctttggtgtttctgcttttcttgatcttaatttttcttctctgacttcttttgtgatgaagaatctttttgatactacttctctaactatatctttaaccagaaagttaactaaatatttaagctataatggatgccacacattcattttctgtgtatgtataaatgtgtgtatatacgagtgtatgtaattattaacttttttacatggctcttccttatatcctaattgatactttattgccaaaataaatgtcaaattgtaggatactgactcatgtaaaaagatttatctat

SEQ ID NO: 113323 - DNA, 1987 bp, Homo sapiens
cgcctggccacgcacaataaactcttaaggaaggatcctaggaactaggcattgagcagatggctggtggttggcttcttatatgtcaaattggcaagaatgttctggcaaatccttaggtctccaatataattaaacagcacgctccatttgagttgttcatagcagagtgtggagatcagctttcaggacatggcaaggctttcccatgcaaagtaccaatgaagagcttatagatgaggacatggaactgtcagtctaatatggtccaaaataaatagatggagtgcctaagctaaagcaggagattggtttatatattaggtattcagcgataggcttaaaagcaaaattttaaaaaacacagaaatataaccaaaattgctctagagccaagagttccttagcctagggacctgagatcccaataatttatagaaacttacattgaaaattctataaaattctataattgtatatggattttcttggttttttaattttgtttgttttgttttagaaagaaaggctgtagcttttatttaattttcaatgattaagaactgagaatctactgaatgcttaactaacccagactggaagtagttttccagatcttataagttactttaagagaagtacagctcccaattgttctatgatctgatataatctatttaaacagtaatctctctttgctatgcaaatgctttacagtacttgtcaaaaatggctttatggaaaagatatccttttttctccaaaatacctgctagtcttggatccacaaattcagtttttctcttgaagaatataaaatacattctatgggatgagcaaaattaggcatcatcttgtaagtggtattgcaagggagccaaaaaaaaaaaactcttccttctgcctccaagattatatagcattaagagttagttaaaataattaaatgcttaattatttgctaggccttccagaatttgaatatccaaggtatttgtacatctacccagttagacttttaatcataacaaaattttatatatggtagacaggcagatagatagataaaaaagaatgagtttttctcaattataaaacaattctcagttcttcattgccttcatagttactcctgtcctttagatgtgtgtgtttaaataattttttcttcatggatgaagctgacagcattttccaaattgattttctatctgtaatattctaactgtatttcaaacctcattaaagcccttttcatcatttctctgacttcattagttatggcagcatctcaaaatctggttttctcagtaaatttcattattgtggtgccaatttattataaaatgatcagagaagtaggagggagtgaggaggaattgacatataaggacaaagtgaaagattaggactctttggcctagaaagtaaaaatctatcaaatcatgaatggtatggataagatgaatatggaccaagatggtagatctggaaaatagaaagttgaaggggcattctggaaactttcttaaaatataagtaaagccactaaacagaggcaaaaaactgattttaaaaggctttgggtgaatttatttcataaccagtgaaagactaaactatagtaaatcttcctgtaaactgagcagatcctaattgattttaagtattattctgataaacatgatttcttgttttttatcatgttctccaggtcactcgttagtaacagaattttgcactggttaggcgagatgggacctgacctagaaagataattcctatgctcttttcacatgaaatgtacaaacaaaactgtcaataacaaaaaccactgcaatgtatatcagtaaagacttcatctttagtttatttttacagtgaaatatcagggaagtgcttttatatccaaagttcacgtaacaaagacgcaacacataagccaggtgcggtggctcacacctgtaaccccagcactttgggaggc

SEQ ID NO: 113324 - DNA, 1063 bp, Homo sapiens
aaaattagccaggcgtggtggctcatgtaattccaattactcgggaggttgaggcaggagaattgcttgaactggagaggcggaggttgcagtgagccgagatcatgccattgcactccagcctgggtgacagagcaagactctgtctcaaaataaatacataaataaaggtgaagaaactatgaacaagatatgccttaaaagatcttttaaaacaatcttcattaagattcaaggttatggaactactgaaattttgactcaatgtacaagtgtgtaggtttaaaatatttttcttttggctcttaggacaaagggcttcagaatccaacaggcttggattgtaatccatgcttggatgaatgctagtttatccatccttgataaactaggtaactttggacaacttattagccttgatccaaatttctctaaatgtaaaatgaggataataataatacctattcttagggatctttgtgatattaaatttaaaacagtcggcctggctcattgtaggaagtctatgtgtgtctactttcctttttattagagcagtagctttccttgcctaaaatcctgcctgtgctatattctcattttaatttaataggaccattttaaaagctgtagagctgcatttgagtgttgatatagactttttgtcagttttagttggctttgtagtttgagatttggggaagagttttgagatatattgtctttaattggcagactgatatagggaggaaattattagatttgggatcagaatatcttagtttatttcctgactattaatactaatgttagaactgtagacaaatcatctaacttattaggcctctatgttctcatctatatagtggagaaaaataatactaccttacctttctaaccttgttggattactgtgagaatcagatgatataatgtgtgagagatactttgtgattattaaatgtccttaaaaactaagtaaactattaacatctgcaatttatcattattgaatatatcatgtgtgtctccttcccattggaaggtacaattatgctatgaa

SEQ ID NO: 113325 - DNA, 1752 bp, Homo sapiens
ctgcaaacgatagtatttacatttgaataaaaaagcaaaagatactgtttaatattttcataatatttctgttataggttagttatttagtgaatctttaattcatcctgagtagtaaattaaaacttattaggaataagaacctgtagtgaagaagcagctagaaggtaaaatactgaaaatagaaagcaggaaaggagacaacaaaatgattaaatatgagtctatgttggtaggtccctttggtttagggacatattgccttacttatctcactagtatctgaaggtactacaatattatatgacagaatgtaaaagcattttaatacacaattttggttataagacattaataaattacgtgaaacctatttttaaaaaacaagctaaagaagtaaataatgatgtgtgtttgaatgacacacttaaaataattggaattaaactgtcttagaatcttaaaggtatcatctttggctatctgagaaaatcagcttatttagaaaatcagcttatgtattattctacagtgatcctagataaatgaagttttcccacatatatttttccataaatatcaatttttaaaggataaatgaagtttttaaaggaatagagaagtttaggaagtcctttggaatctcttctaattcaatctggttgaaattttaaaaaatttgtttgtataagaaatacttattgagtatttactgtgtgcctggaactaagctagacattggaaatggagtggtgaacagccagatatgatccttttccaggtgaaatttacattcaaatagagagggaaacagacaacagatataataattacattataattaagtgctattcaggaaataagcagagtaagtaagaacaatagatagttcaattttgttctagttcttctcccccaactgctccccatttctcctcctgttctaagataatttttgtatcagagaattcagcctttaaatgttttgcttaaatcatccatataaaattgtgtaacacagataaagaatgtataaatccttaaaaatgtattaatcctttgcttaaatcctccatataaaaatgtgagtcattgacagattagctgaagtcaaaaattggctgatgtttatgttgatatacataaaattttaacttaggtcatggtaggcaggctaagctagaagaacatcattttaataacaaactataacaataacaagcttagtaggcatatttgtgtgctttataaatgttatcagtcattacagttaatggctttctttctttgcacccaaaagaggcactcattgcagagcaagtagatgttgttatttctgctatatacaatcaatactaatgtttgagggaggtgtatgctataaagaatgacaacattaattagtaacttgttttaaaattatctattgataagataaaggaaaatacctttgagaaagtcatgtgaattactccccatatcttttaggccaagcaattatattctatcacgtaatttttttttggctagatggacagagtgaagataaaagacaactgtagagataacagcgtacttcacagctgactgaagcaggtgttagaaatgcagatgaagtgtattgactaaagactatacaaattcgaagtgaaaatgccactggtctgcatgcagtgttctgcacatatgaagtttcaggtagttaaattattcattttattgtgtgaaatagttgaggagttagggaaaagg

SEQ ID NO: 113326 - DNA, 1109 bp, Homo sapiens
catatagagataactcaaagtacaaaggtattgaggtaggagaatagccagaacagaaaaggcaatgaagatgaattcagatatgtaataagggtccagattataaagttaggaccttgtgggtcattgaaaagattttggctttaaatccaaatgagatgggaagacatttgtaagttctgagttcttttctagtagagtattcagaaagaccagattctctttctgaatactctcctggtaagtagtgcagttcctttaaagcacctatcagaactttaagtaattattgtgaaattttttttgattcctgtcttccatcaccaggatatcaccaggatgtaagttcttggagagcaagggctgaggctcattgatatcctagcagagtttctcaaatagagtcaggtgaagaaacgaatgtgttcacgctttctagctagctcaggatttattcttttaaacaactctctaaacatttttttattatattaaatacaaatattttaaagtacgtcatatactctccagtcttttgaaattctctgttgtttaaccttttgttggtgaccctatttggtcattactctattgacaagcatactaggcatggctctcatgctaaccatgctgacttctaaccctactgagtttttgcctccacactaagtgactgctgtgccacagtgctttttgagttagattgtttttgctttaatttctggcatctcccttgctctaagctgatcattctcactcagtctttcagccaagtgtctgctccatgccagacactagactaggttctgaacatacctgagaataggtatagagtatgtctgggagagcagccaattttttaaaatttctccagacttggaaagcagtttgttggaattggattgaaaaaggaatagtttctgagcaagatagaggctagggagctttcctcactatttgtacagtgctctttgtggctgtgtacctaactaattcgcaatctatgatatttcaagctggttggaataggattaaagttgatcaaaaatagtcatactgcaaataattttgtggtagatatttttaatatacttgagaaatgaactcaa

SEQ ID NO: 113327 - DNA, 1071 bp, Homo sapiens
gtggggaagaaataataaaatatttaagaaagagagaagacaggaaggaggactgtcttcaatgcagtgctttccagcattcagacatcattatagcttttgccatgtcagcatactgtttgttaaataagactcacattttcaatttaaatttatttcaagccaaaactttacatcaacactataaataaagaactatcttgtcgtgaatagaaggtaactgaaattaagtcaatggaaaaaaaagctactattaatttgtagctaacctctgctgcgtattcaaggctctgaatctgatgcctgcccttcttttaataaaaggtgaaattagcaccagcaccaaacaaagcactttctccttctgcaatccaaaggattgaaagagagttgaaaagacagtaagttgcattactaattctctgtgcacatgtcctttgagtcatcttgttttcatttatactttgggaaacactgttctctgaggtcgcttctcaatcacgccatcaaagaagtgaattaaaattatttggagaagtcaaatgaagaaacccctagaatcagggactctggcaacctgaacatgtttgtgtttctttcactagatcattttttacatgacacctctctagaaaaacagtgatgtgtgtgccaaagtgacaaacatatttgcagagttaaaaatatggtataatgctccaatcaagaagacccactgatagctctatgtgggtttgtttttaaaacaaactcttatctgaagtacaatcattgtaaataaaaaatggtctttgttacttaataaaaatgtataggatctgtacctattccattttagcagcataatgttctatgctgtctggcaggacttgtgtagcaagtaaatgcattagtcacagtgatcatttttcttgcaaatttgtgacacagatttaattataggaatgaccagcaacttacaaatctaattttggtggaggctgaagcaacttttttttttattttaataatgatggattttttttaaagcaatgatttcattaccatttaaagaaatctactggtgtagaa

SEQ ID NO: 113328 - DNA, 1534 bp, Homo sapiens
aattgatagtgatttatacaagattaagatttatttctctattatataacatttggagggagctgtccaagtatggtatagtggcttcatggtctcatcatgggccaagactcctatctctctcctccaccatctgcagcatgcagttttcttcctcaaggctgcctcatggtccaagatagttgctggagccccagccagaacgtctggatagcaaggtaaagtagtgggaatagaaaaaagagctccctactccagcctgggtgaaagagcgagactctgtctcaaaaaaaaaaagaaaagaaaagaaaaaagacctccctaaaacctgagtcttctttctttgaacagcattcctggaattctaacacaataccagcactccttattgcagaactcagtcacatgatcactcctagccactgaagttgggaaatatggcaatttactgcgagctaaaaattagatttctgttactaagaaagaagaggaaaatagatatcgagacatctagtacattctacatatgagcaatatacaacaattattaaaggtttgaagaaagagattcatctcagttaaatgacatgagaaggcttcagggagaaattggtgcttgagttgggattaggaagaagatttattttagaggagtgaaattccaaattgtaaactttatatttttattttattattcttaaaggatggtacttgttacagctatttgtgaattttctctataaatggaaaatatccacctgttcttaaaatttaggattatgggtagtagtatggtttctggagctagactgggtttgaattcttacttgactgactactagcctaattatataagcttccctgtatataaaatgaggtaatgatagcgcctaaactgtagacttgtgggataatctatataaaatgtgtatatgatgtgataagaaataactttgagctaaactttagatctaggtttttattgaagctttgtcatgaatgtttgtgggtgtgactatggatatccatgaaataaggaaattggttatctctgactaagcttggcaagatctaaaataccctgatccaatgattattctctgattatgagtgaccattcctgtggtataaatataatacaatctgaaaagggtatttatttcagattaccttaaaactttgaatgaaaggcttttattaaaagaatttttgaagaaagaactctgagagcatttttgttgattttcaggcatctgggtataaataaaatactgtacatatttatagctactttaataatgtcccaggtctaatttaaacagtgtttttaggaactaattattatagaacgctgtttttgttgttgttgatgttattgtttttaatgtatctaggctggtaataactaatgataggtgaattcaatttacataaatttgagaccaagaaaatattttaaaatcatgccatggaggattgctttaagttaagcagttaatgtcattatctcctcctctcatttaaattgttcagt

SEQ ID NO: 113329 - DNA, 1916 bp, Homo sapiens
attcctatcttagatgaccagcggagagaggcatgtaagtaggtcatttattttcatttttttttttttttttgagacagggtcttgctccgtcacccgggctggaatgcagtggtacaatctcgactcactgcaacctccacctcctaggttcaagcaattctcctgcctcagcctcccaagtcactgggattacaggcatctgccaccatgcctggctaatttttgtatttttaggagagacaggtttcaccatgttggccaggctggtttcaaactcctgacctcaagtgatctgcccacctcggcctcccaaagtgctgggattacaggtgtgagtcaccatgcccagccagtcatttcaatacagtaggacaagtcccatggcagagataggctcaggatgttctgccagcaggtgtggagatactcagtccatctgtaagtgtagatatgtgtgtatgctaaggtgtgtgtgcgtgtgttgggggaaggtcattgaaaacttcttggaagtgatagggccaggaggcagagaaatactgggtagaagagggtggggttcctggcgagagctccaccctcaagcctggacccacggcccaaagtgagaactattcttgttttcccacctgaaattttaccttttggactgccccaccccctatcctgtgcccatgagaactgcaaaccccagactcaggggactcccgtgcacgcgcgtgcgcacgtgcacacacacacacacacacacacagaagagagaagagagaagagagaagcgtttgaacaaccagaggagaagaggctggacgtcagagactatggtcagagaggagttcgattagggatggccagactcccgcggaagattttcgtcccattccaccccgtttccagctccctttccctctgaaagccacttccaccgctcaacaaagtcctccacattaactaccctttgatttgtttgtgtgacctgatttttcctggacgcctgacaagaactcgggtaccaagagggcagagtgtaaaaggctgtcaccctgaccctccgctgagctagttaacacctagccatccacggacggcaaatgctaaaagagcagtgattgtaacacacgtcttcttgggcttcgagggtcacagacaccccctcctggatggcagagctaacggagcattgtaacacacttggacactgccgcgggtctgcacaaaccctgctcccgccagagaggtgcgaccggccagttccagtgttcctttgtgcgcgttcccacacccgtttgcttgtgtgctcgctcctgtaaggcatggagcacggcggccaagtaaatgagccaaccccttcgcgagtcccataagggatcaagggaactctcccatctcagaaggatgatgaccaagctgtgttattaaaattaaatagaattaccaaagtagaagagggggaagggtatttcaggccagggagcaaggagataagaaatggcatgatgagtttggggaattgcaagtagttcattgttgtcagaatgtaaaattcgaggcagggaatgagatggatagaaacatgttcatggaaggccctggacgtcatgccaaggagctgggaattcctccctaagtcaagatacatgcatgtcttttatatatcaataaaatactctaaatatttattattacttgttgaaactctggaaatcatggttctttcatagactgcaaccacagaattgagccaactattaccttaattatcggttgctgttgagcccaagatccttggtttcagtgtctgatttcacgtggtcttcagggtacccagaacctttaatcaatcatttcacaaaagattgacggagctcactgcacaggaggacagtatagctgactgagtgagttcaaatcca

SEQ ID NO: 113330 - DNA, 1394 bp, Homo sapiens
tctaggcagcccctcacctttgctgtttctagtcaggaagcaagtatttatttctggttcacttatataccctccctatccctgtcacccagtgggaaatgcactgggtgagaatgttcctaagaactcttacagggtgtatccgatgctcctgtggtggcccagtgtggaatttgtcctctcactaaacatccagcatggaacagagatgctattctaatttctttgctgtttgttctagcacagtttcttcatttgtagatatcaccctctaccccaacttgagaggtgtggtgaacagagcagctttctcctgtagagaaggaggaaaacaatttcattttatcaatctcctctggaatttctggtcttcacctatacagcctgcatgtgaagtggtccctgacccacttttggtgtcttttttataaataccaaggtatgtgtctggcatcttacttttgaatgcaggattcttctcccaagtttggtattctcctaagggtattctcctaggcttgaaacatcattagaaattctgagataaccataaatatcccgtttttacattttggtaaacatttctatgtattttgactaagaatcaggtactcaaaagcacaagctagaagtttaatacattaacttgccataaattattcatactcaatgtaaataatggattttaccttttttttatttagtaacctcataagggaaggaaaaagaggggtgttggaccagcattatgaaaatttttgatataatgtcataagagaagacttgggtaggagtcagcagtgtacatatatttgaaatgcatttataaaagggatgagacatatttatgtaactccagagcacagaacatggtccagtgcatggcagttatgagaagttatagatttcaggcttatggtaggcttaaggtagaacataacgtttagagcctttcagcaatgaaagagcttgcttttatcagagaattgtttttccccatttttttaagttttttttaaaattttttttattttttaattttattattattatactttaagttttagggtacatgtgcacaatgtgcaggtttgttacatatgtatacatgtgccatgttagtgtgctgcacccattaactcgtcatttagcattaggtataactcataatgctatccctcaccgctccccccaccccacaacagtccctgatgtgtgatgttccccttcctgtgtccatgtgttctcattgttcaattcccacctatgagtgagaacatgcggtgtttggttttttgtccttgcgatagtttgctgagaatgattaggtttttttttttttaagaaatttacctttgttttaaataattccaagtagtttatgatgaaattaa

SEQ ID NO: 113331 - DNA, 1070 bp, Homo sapiens
gacaccatctgtgatttcagtatagtcctttttgaggaaaagtgccttgatgagatgatctgcgaagtccattgcagttctgtgaatctatggtaagttatttcccagaagatggtaggaaagctattttattgctaatgaaaagctgatgagagagttattgctaagggattgatccattgccttcttaagaagctttgagattcccagacctaatggatggaaaagagcagaaataacagagttaagaaagctagagtctaaaattcgtaagaaacattagatgctttgacataggctgtcacttaggttttgtggatgcacttctaaacaaagtgttaggggaattcttggccaattcctctctcagtgtgctgagagcttagttcaatgtgttggtattaaatagagcttccattaattgatcagaaaagtgcttgttgtatttcactaggagatattggaaaagcccattttaaagttaatttctgtgctgccataactctttgataccattgatcttcttgtattgtagttattatgatgtctgtcttctagccctagactgtgagttggtactctatggtatttatttttgtgtttgcttaataaatttaggttgaaggaatgaataattagagaagcatttgttttattcttttctggaagagataggaaacccaaaggattaagaagaattaaacttgaggaatactgagaaattgattttttaaaagatataatatcaaatagtatataacattttaagtaagtttcattcagcttaatcttagagatttacaataaaaatcttagatatttatcaataagctattaatggataaatagtataaataaatagtattttcaatttaagtgttggtattctgggttatacccatggtttgttcctgtgaatattcagtgttagcatagcaaagaagactaagtagtttagtcttttaactacttttaagtagtttccttttggtattatcttcaattcattcaatttttagtcagacattgagcatctaatatgtgcacagcattgttcaaagtttgcctaa

SEQ ID NO: 113332 - DNA, 1089 bp, Homo sapiens
tcctacctcggcctcccaaagtgctgggattacagatgtgactgaattattttctgagataaatttttacaggagacattgctgggtcaaggggcacgtatggacatttgtaagatactgatatttaccacactttcagcaatattataaagcgtgtgaagttaacttttccctgaactctcattaatcatatgcaatattcgttgctcatttagtgtttttctccccttacaacttttgtttttctcctcccaatgcaagttagtctatatattataaagatgaggagtccacataatattttatagacacatgtatttaataaatatttttatttcaggccgttttcccaattttcatcgcttgcattttagagtaaaatctagagggcagcattttaaaagttgctgtatttctttattttacttcaaccaaaagatgtacatggtgtagttgctgagtgtgttatttaactggatctctaaccatgttataaatggtgcctgtagaaggatctggggacaagacctttaagctttttttctttttaatcacagcttaagatcttgaagaatctgaacttacataagaatgtttgggctactgttattacagtgaaaccttctgagagtatcttcacaggtgatttttttttagagaaagtcgcttacagatataaaacgtttgaccaggagaaagcctcaggttgtcagagttacttacacaccgttgttcagctgggcctctttattaaatcatctcttggcagtccattagttgtggtggtacagctattgcatggctcactaagctaatataccttcagtcactaacggaaggataaccttaataagaatttgaagtcgatttagtgcttcactgcttactgactagtgttttactttttagtgtgtctatacaatttccatgctgtgtatttttgatattcatatatatcttagctacatagcatattagagtcaaataaaggttaatggtgtggagaaggaagagtgtttggggggagctcttccttgtaatcctgactcagccactgttagacattgtgtgatcttgagcaagtcactt

SEQ ID NO: 113333 - DNA, 1116 bp, Homo sapiens
gatttctgtcttttgtagtaaagtaattgggcaccactgcttggcaggagctggtgctgttgagctagctctagctgccacaggttgataggcaggtgataaggcagcttccaccagggtctgcacaggaggcctacctaatatgctgtctgccctaagggcctatgggaacacagttggattattatgttaatgcatgagcccgctgccctcttcctatcccagctgggttccctgttgttaggaactgctttgcactgacagtggagtaatatgcttcatgattgaaagggcaaaggggcttgaaaggaaaaaaaaaaaaaaaaaacagaataagcctgcacagatatgtaaatgagagaaggaaatctgtaggaagatttcactctaagtatagacagaaagtttattagaaagttcttcttatagcactctgtaaaaccacccatttcttaattaatttctgggtttgtttttcttcctaacactggtatgtatgccgtacatggaagtgtttttctaaacaggcgcttaacttgatttgttttaaactaagatgctctaacacatttgtacccaggtataatgctgacagcagtgcattttttttgcacgttcattattctttaatgtttgtccctcagttattccactatattttatagaaaagtttatttttaagatgctgaaggatttatattttgtattgagatgtcacttttatttctctttatttttagtgtatatttggaaaactgcatgagctatcttttgggagtgggggggtatggagaacaggaaatgggtgggtcagaagaatattttcttgagttcgtgaatttgatataagtgatggttcaagcattttatgtttagtcaaggtttttaatgttgacaccttaacatagtgaaaagagtgtggcctttggtgtctctagacctgttcaaatgcaggctctactaattaagtactatctgattttagataaattattttacttctcatttacttcagctgtaaaatgggtataatatgaattttaaatggaaagataaagcatataaataatttggtgtgacatagagtaactactcattaaatgcttgccataatga

SEQ ID NO: 113334 - DNA, 1037 bp, Homo sapiens
aatagatacgctatcaagtgtgttatcatttatcatgaaatgaatgggcattatggttctaagttaaaattatacatcaatagttaggaactacatggtttgtatgtacaaaaagctattcttaaattcctaatcttttttaagcacaagtatttcaacttttatctgttttagagtggtgatttttagatcacagcttcctgttcctaaaatgaattcagaataaatcccagtggtgggaaatctgtatcttattaatagttgacctctttcttttcacattggtattactaatgaaatgctaattaaaaattcttgttatcctttacctgtttgcttttatgatataatcttgcattacttagacatgtacaaaattggaaaatacaaatgcatttgctattttaggttattcttaattctagagcccctaaaaactttcagctgaatttatgcaagggatgagtaaaactctaattataacttttgagtttttagcctctagatgagagtatcagaaaagaaaacaaaagattttggttgactttgctacttgtttttgtttctgtttaacattatcatgtaacaacaaaagtgtgtaaaagccttattcttgcttttcctgagatgtaatcataaaccattgttatcaagagcatgattagtcagctttagagcttttaagcgctacaacgcattctttagcatctagtaatataaacttggcataaaagctgtaaaaatgtctttaaatctaattggagatatgtgttagcaatttagtgcagagatttcatattctttgtgtagtggtcaaggcttcttttaattccttgaggaaaatgaagctcctaggagcagtttataaggattaattgatttatatctttgtttctagatttaagtattgaagcaagaataaaactggcttattgtacaaagaactggagaaacaactgtattttttttttttcagagcagaatttgttgttacttcagtgacaaagggtgatctgtgtttttcactctttacacct

SEQ ID NO: 113335 - DNA, 1574 bp, Homo sapiens
atttgaatgacctgcagtttctagttgagtattgaatggtcttattgaatgttgtgttattacttcaggagttgtgatatgtttcaccttggtttagaaaaccatagttttatcatgatacctgaaaaaagatttagtattctctctttttctgaagttgcctcacacattcacatttctttttacttcataaggctgggaaaagagaataccataattgtccacttgatttttaaaatcttcatttttttaatctctatatttttaaaattcacacctctcttttctgagcttcttgccttctctttcctgccttttccctccttttctttcgtcattgtctctccttatctcttctggtgaattttaattccttcaccaaccaggtcttcaccatgctagactctttagaaggaccctgcatggtcctctggcccctgtgttgttgtcatcatccttatgactgtcatcatcatagtctctttctctggtcataactgatttttcagcccagagtaggactttctcttggatttccaaatcctgaacctggacttatatgtgctttcctggtactgtgtcttcttccagaagccgtcatagttagactgtctgctctggcagtaataaatactctgaaggtcttctaggacaggagattaccttgaacaccagctctttgtgtggcaggcatttccagggcctactgggactccctgaggaattctgccctcagcaccaaggtgttaggaagcttcttccaaactatgtgaccctgttttgctgtgaccacaaggtccattccaaagcttgctgctgctgtcatgcccctctaggactctctgctaggtggccacctactctttgaagtcctgcttccaaagtcccctcaaaatgaatcactgcagctttatttggatgttgtaaaagccaaggagatagatggtcagtggacagcagctgtatctctaactaaaaaatctctagtcacagtcaaataagataatcttctttaattcccgcctgtgtgactctgtacaaataattctccatttgatctgggagatagacacaataggaagttggtttggttatcctaagttttactgttttgcttcttttcctacatatttttttccagtgggtaaaagggatgaggtgggatagtagaaaatcattgacattggtctatacagtttgttctggtccccacatttgactctgtctaaggcaacacagaatattaactcattggaaggatctgcctatattattattaagtactgaagtcatatttaaggaaataaaggaagttaatttgttgcaaggaaattaattccttgtatctgtctttaaattgggctttattttcttgaattgatctaatttaaaatttcttattttcattgtggtgatatatcaataactcccactcttttatctgatttatgctaatctgataccagtaataggaataactttattttcccttttatttaaaaaaatcaatacttacctacaatagcataaatcccatatctggcacaattttattacctattgtcctcatgtgt

SEQ ID NO: 113336 - DNA, 1067 bp, Homo sapiens
atctttaacttccatataattgtatgaagtacataggactgcttttatattattctggttttgtagttgggagaatagggattgagaggtgagatgacttgtccaaagtcccacaggtgggaagtcatggaatccttcttcaagacactttcatcccattatgcattatctcaggcaaaaacaacaaaactccataaatcagccatgtaagatctagatcttgtattggctcctcattaaagttggatggcttgacatttttctgagggatgactgtcagtgtactattagctaaaaacaaattattgagcacttgtactttatagagtactgaattaaaattctgaggagtggggagctctagggtgcaaggaagctcaaaccttgtatgttttcacagaggttggtaatgaactggggggaaattggcagaaacataaacaacaggtgagtgtaaatgtgcaagtcaggtaaggagagggcagagaagtctctagagcttgagtcaggctcacgggtcctggttggaaagttggctcttggaagtaataggttttcacattcttttccagtggttagggcatttttttgaaaagcctctcctgtgtggttaaggtactcaaactggctgaaagatacaagagaatgggtctagtagagaaggtgctgcttatagattttattctggggacctggtcaatggaacaggattacctgcactgggagcaggagagcaggctggctgaggaagcaattgcagtttggctgacaatttgactgaaaggttgcttccttatggtgagttggtggcagaattattgctttgctgtgccctatagacatgaatctaaatggaataaccaaatactgggtgatatgggtgggccaggtgcacaggccaagcctgtgtgtcctgcatcactggcagttgtagatttaaaagagaagactgccactgccctataggggattctccgtgttcatctcagtaactcctattccttgtaggatgagaaagtgaaagcaaagctgaggtcttcttgtacacctcaaacataaaagaactt

SEQ ID NO: 113337 - DNA, 1050 bp, Homo sapiens
ccttgctggcttttggtttccccatacaaggagcaataatatttgcattctcatttcataggattgcttacaaggatctcatgcattgatatgtggaagtacttgtaaactatgagggaacacatcaagtaagcatcagcattattatcattgcagaggtttatcactgatgaaataactgggttttctgagtcaatattattgctgtctcaagaacttgatcttctaaattcgctcattcattcacttcgttcatttattcaaaaacgtatgtcgagtgcttgcaatagcttgctgtatatacatattacatttatagaattttcagtttagtaagtgatataaaacaagcagtaaattgcagcttaagatgatttgtatttaaataaatttaataaactggataattttagtttattagtttgcattataggtcttcaggttttttgtataagtatttcttgtcataacctggaatattcatgtcagatacccaagatagcccgtttgggaattaaagggcatggggagccaaactagtaattgaaagattgctttcagagtttagaacgaggtaaaggggattgaagattgaatagatttataggatgtttctctgaaacagtaaagcctagaaaagcatcccagctccattccaatgaacaacaacaaaaaaacacaagccacaaaaacaatcaggtatatctctctctccctctctctcttttttttttttttcgagacagagtctcgcactgttgcccaggctggagtgcaatggcgcagtctcagctcacttaaacagttctacataaacattgaaaatgggttatcaacctaaaactccttgttcagtatcagaatatctgcatgtatgatgactagcaaaacattttttgataatttggtttattttgattagttatattttaaatatcaggcttcctatttagagaggcactagtctaaacaacaacacacttctaacttttcttttagctaatctaatctaattaatgtttatatttttgcatcttgttatacagaatt

SEQ ID NO: 113338 - DNA, 1121 bp, Homo sapiens
cgatctcctgacctcgtgatctgcccatctcggcctcccaaagtgctgggattacaggcgtgagccaccgagccctgcccattttggttatctttcaatgactgcactcactataccttgactgctttttgaattgtataataagagcttaaatagcttaaaacagactcactcaagcctatggaatagcataagagattagaacccatacatttgcagcaccgtgtaagccacgttgccttgtgtagacttgtctaaattcaacaggggatgtgcatcaataaatatgcccttatattcatttgctcagccttgctattttagaatgaatgtagtgaaagctgtctatgattataaaattatttatagttggattttcttttatttttcagtttgcagacagtaggttgcatgcctccgcctgtgtcttctgcagtgattttaaccaaggcagttggtggaaatgaggtgagtcatggggctaccttatttaaacataagtgcatgctgtgcttttatttcaaaaatatatcacatttttggacatgaagggttgatgttgcagaaaactcctagccatagcagcttgtgaaagaaggaggtgtactcacatactagcatgatgctaaaattgattatgatggatggaatttaggatttcaaagagaagagcaagggaaatgagtgaaatagagatagtgatttttcttctacctcagtggaaattgggagacaaaggacagagaagacctgggaaaggcatttttcatccaagattctcagactgagggcatccagtatggcgattccttatctccaaaaaatttgttaacaaactaaattgatggggaaaagttaaatatgtttaatggcaagtgaggatgatataaaaagaagaaattaggttaggtttcttagatgaattcaaagagattattcaactgctaggggactatggcacaataattgtatttgtatattggagtagcaattgtccaatgcagaagctacttatagggggttcttccttggttgaaaggtgctatgactttatactgacggacattcatttgtgatagcttatttctccttttctacttatattctctcattcagaaaaa

SEQ ID NO: 113339 - DNA, 1036 bp, Homo sapiens
tactttgtttcaggagttattatacatattggagaaacaacagtgaaatgcctgttagttttgcatgttggggagtctcagggggtgttgtatcaataaacaagtaagtagatgagcaagatagagataaatgatgtaaaaagaacaaaacagtgagatatgtgaaagtggttgggtgggcaggcttttgattaatttagatttcagagttctgggggcagaatgttctagggaaaggaaacataatgtacaaaggctctagggcaggatcaagcctgttgtgttttccagtcagtaaagcagccaggaaggccagagcctggtgatgtagaggaaaaataccatgtcctagcggtataaaagtaggcaggaatgaggtatgtagagccttataggccgtggtacagcattcagattttattctgagtgctacaggaagctactggagggattggaatgagagagtgatgtggtctgatttatgtttgcaaatgattcttctgatagctatgtgtagaagagatagtagaggggcctgagagaaatcaactcagagagtagtggtgaggtagcagttcaatagagaggaatgaatgtgtgccagatagattttacagtagagctttcagcagtgatgggtgaggaggatgtagaaggaggacagaggaaccaagcgtgacttctgggttttaggtatgaaccactgggtaattggtagcatcatttacttaagaggggaaaactaggttaggaggcatggtggaaatcaagagtgccattttggccagatttagtttcagagaatgaacataaaatttcaccaaaaagtgtaaaatgccacataaatatgatgacatcattttagagcaaaaatgtattatgcatatcaagaaccaatagttactgaatatctgccatgtgtaggccactcaaggaatacaaagatatttactcatttttgttgtcttctgggaacttccaacctagttggttataaaggacatatatatgtatgcctcctagtaatcactaaaat

SEQ ID NO: 113340 - DNA, 1047 bp, Homo sapiens
catttaaaaaattttaggccaggcgtggtggctcatgcctgtaatcccagcactttgggaagctgaggggggcagatcatgaggtcaggagatcaagaccattctgcccaacatggtgaaatcccatcctactaaaatacaaaaattaggagggcatggtggtggcaggcacctgtagtccaaactactcaggaggctgatgcaggagaatcccttgaaactgggggacggaggttgcagtgagccaagatcgcgccactgtactccagcctgggcgacgagcaaaaactccatctcaaaaaaaaaaaaaaatttaagaaattttaaacaaaaatactttatagccttcatgagtaacttttttatcttgcattctgtcttgtatgcatatacttatagataaaaattttagctatgaaaaaacccaaaattaagaactaactcatgtgatgttattttagtagggatctcctttcaggaatagttttcttacctttgtttattttgtttccttaatttttccaggagctgaccagtgctttggtgcatctaaaactgcatctttttattcagatctttactcttgcattcttcccagcaacaatatggctttttcttcagcttttatcaatcacacccatcaacgaatggcttttaaaagggtatgtttaaatctttaaaagtgggtccacttttaatggggcatctctagagacattattgtttctatggcaactatatacaaaagggcttatgtgtaccatcttaaaaggaagtaaaaacacatctttgttttcctttaaaacaatagtatttcatcaaggaggttcatcaaataattaacagaatcttaagatacaccctcatgcttcatcctgtggttttacgacgagcacttttctgagaattttagagtggtcttggaagaaaaatgagaaggactagcagatgtaagatctgtatgcaagtcaattggatgtcaattaattagataatagctgagtataatgtgtgttttagaaatgtttaaggaagaaaacatacata

SEQ ID NO: 113341 - DNA, 1089 bp, Homo sapiens
ttcagaaaagttatgccattttttattcctgtcagaagtatatgcagtccgggcacgggggctcatgcctgtaatcccagcacttggggaggccaaggcgggtggatcacctgaggtcaggagttccagacaagcctggccaacatgtcaaaaccccatctctactcaaaatacaaaaattagctgggtgtggtggtgggcgcctgtaatccccgctacttgggaggtggaggcaggagaatcgcttgaactcaggaggcagtggttgcagtgagccgagatcgcaccatcgcactccagcctggatgacaagagcaaaactccatctcaaaaaaaaaaaaaaaaaaaaagagtatatgcaaatgccttagtgtattctggctaatcatttcattacagtattttaaaaaataaaaatactaatatttgtttagtgtttatcaaatgcctctgagtatatttaaatgagatttggcttcaaggctgttgagaattctctggaactgctggtgctcaagttttctctggagtagagctctaagaattctgattcactgtaaggatggcttgctttctcttaggtctgatcccaggacctaatatgacttctggtaggctgagtgttttctagtggtcctaaattatactcagatcgctagaaattctttagatgtcatttagggatgtcttgtgacctaacaggaaggaactgctgtgtgtatctccacacagggaagtagacagtgggaagtgatgagactaatctcagaatgtggtgatgagcgaatgagtctgcattaacgtactgttgattaaactgataaactttggctaatgtccctgaggctgaggatctcttgaacatcttacctgaacaaaggggccattgcagttctatacttacaaccagtaactctctggcatagttgaatatgttttaatgatcacttgcttgttttaaaggactatagtttttctagcactttccagttttattttagttttccattttgtttttatttcaacacaatataaactcaaatgcaagtatttgtgagtttatatatatttgaatcctagaggttaact

SEQ ID NO: 113342 - DNA, 1032 bp, Homo sapiens
tcttgcttggaggtcttcctgctgaccttggctaatgctctttatggaactgctttctaacccaagtcctttacttggggcgttgctctatgtcccctggtggctgcttaatggctacagctgttacttgtgccatgggaaatccagaaagcaacttgatttctctcactccttagcttcttacttaatgcgattctgcgaagcagccaactttgtgggatgcaggagttgaagaaggaagaatgccacagctgtcagcatttctctaaggactgacttcttttgtaagcacctaagaaaccttcagagtcatccagctaatttggatctaatgaaatgccgtgatctcgtgctttatcgtggtatctaagcagcaatcaaagccatttcttccatcaaaagcccttttcaaaagaatacaacattaagtcattttcaaaagccatataacttaagatgtcctagattgtatcattgtgtaatattaaaccacttctaaagcctgctaatttcatggttaacttgtaacttaggaggtagcagtcatatttgtttactagttagtaatcctaaattcatttcagtggggattacgatttatatgtcttattaggtcctaaaatagttcatttttgcatacaagagacagtgaattattattgacttgagtttatttggaagcatttgtgttggtcccattcaagtttgatttatattgaacatttcttatatgactcatacattgatttaatgacatgtattctaaaatttgttttagtaatttgttaaaattataaaggacactgtgctaatgcaatgctgagtcttcagttttatgacaacttctagttttttgaaattttgttgtattgaagtgaaatatggttacatttaaaattcatatttagttcacttcaaacctgtagtttcagaggctttgtcacttagccgactgtggcagggcgaatttgtttaaacaagtatcaattaagtgcttatggccacaaggcacggtgctggggatagaaacaa

SEQ ID NO: 113343 - DNA, 1053 bp, Homo sapiens
tgacactgatatctaaagtaccatttgttgtcctgcagtagattattattgttgttattattattattattattattttgagacagagtcttgctttgttgcccaggctggagtgcaatggcgtgatctcagctcactgcaacctctgcctcctgggctcaggtaatcctcccactcagcctcccaaggagctgggaactacaggcatgcaccaccatgcccggctaatttttgtatttttagtaaagactgggttttgccatgttggtcaggctggtcttgaactcctggcctcaagtgctctactcgcctcggcctcccaaagtgctgggattacaggtgtgaacaaatagattcttcttttgtgccaagttatctactgaaattcttttctagcaataactcttttttctctttttaggaccactgaagccagaaataactgtatcctacattgctgttgcaacaatattctttaacagtggactatcattgaaaacagaggtactgtcatctatgggacacatgaaaagcagggagaaaaatttaatttgtacttacttaaatttaagagtcctttggtaaagctgtttatagctataatctgaaggattcactatagcagaagataacttggtcggcaaaggacttgtgtttcattcctacatatgtgtattataaaagctgtacagttgagcagcatgggccctgaggatgtggttataatgagtatgtttttaatatgacagctgaactgaagcatctactttagttcttcctcaacttatggtggtaactacagtggtgcctgctatgcctgggcacatttgagctgttgatgttcagtttggttttcataacttttgtggatcatctttggttcccaggactcatgctgttcaaataatgcttaatttgtcataacttttaattaatttttatttagaaaagcttattgttccttagcatatctattaaatattaatagatgtcttaagagaaatattgatgtttttcatttgacacatatatgtatgtgtatatgtatatgtg

SEQ ID NO: 113344 - DNA, 1554 bp, Homo sapiens
cgcttcttcgggacattacggcgcttccacgacgctagcgctgacgtatgcgcgggggggaggggaggccactctggatctccgagttcccagcctgagctgccggagttagaggtgtccgcgcgggaaagtggctcgctggtgggcggggagccttatctctggcggtgggttgaaaatccggcgccgggcagatgcccacgttcgctggacccctgcttgccggcgtccgctacaacccaaggaaggtgggcccgacctcgccaggtcgctcgcctgcgggtgggcatttggtccggatccccttccctctgcggcccacacctgtctccgggactggggagggctgcagggatcggggcagatctgcctttgcgggccgagagtgacagctgaagtctccccaccaactaagctactcgcgggcggagtggggtctgcgctggcaagcccctgggcgcgcgggtgcccgctctggctcgcccccagggctgacctacccaagccacaggaaaactctgggaagagggtcgcggattccaacgcggaagtggtgggggattgagtctgagaggttggggagtcctaccttccattgccacgagtgctagttctatctgccagtttcttccttgaaatgtcttgtggcaaccagtgacattgatggtttcatgaatggacttcctaccggtagaccctgcaagagcatgaactccactgtatcattcatccaaatgaagaaagaaagaaaatagtatgtgatattttgaaataacctggcatctgccacttaaatggttaaaaatagaacttaaggtttggaagagattgtttcgtgatgacagactttaattctgaatttattcaaagctggaaagacactcgtcgtgtcatttcctctatttaatttagctttatcttgatggcaagacttccagaaactaagccactttaagagttgtgctcccagttgtaggttacacagtaccaagtgtcatctaattatacatcaggcaacatgaaaaaaaattaatttcaagataaaaagaacttaacagggagacatagatgacattaagcagtttactctgaaaagagacaggtacatgaaatataaaatttgatgttagttgtcaggcagtcagaagataagtgaagataaatgaaagatagtttacaacataattattttcttatagtaatttcttagtaggttaaagagtcatacgtctcagtcattgaagggatagttttgtattaaaacatcattaaacattaagtttacagaaattgagctgttttaactgtacagctattcacaaattatttactaatacctctttgatctgtgtagagcagaatctaactcagagatttttttgttctgtttttaatggtacttaaaggaaaagaatataatgtaccatgaattatattctcttaaggcctgtatttgtttgctgtggatgctgaaacaaatactcgaacttggatgccttcaaacaacagaaatttattatctcacagttctggaggacagaagtccaaaatcaa

SEQ ID NO: 113345 - DNA, 1044 bp, Homo sapiens
aactgtatccaacatggcatctggtggataacagatgaaaatcatcattttttcaaagaaaataatctggggctgcggtctataccattggacatttctttataacatttcagcaggtagaatacaatgatgtcttgagaaatcttgacttggaaaaatgtgttatgctatatcactacactcatagtttagggtcttcaccttgcaaaaaagcaaaactgtacctaatgtattacctgctccatcccctcttagaaatgacaacacaactatttttgaaggaactagagctcattattcttaacttcctcctaagtatctctctctctctctctctctagatttagtcaaaagttaaatcaatttaataaagcaagtaatttgtgaataaatatttgtcactaagatctttttctgtgggttttgccttaaattatgaaaggactatttggcagtagtactttatctagtatataatgctcattatataactggttgacttttcagtagctgaaagggttatcgaatgatgcaacttgatatactttttttatagtagaagtttgtagtgacttgtataacaagtttattttccctgcagacatatttacaggtaacaactttagcaaatcactttgagatgctttcatgaaatagttgtagcagttgtgaccaatttaggtacagttttctgacataagagaatatatttaaggactctgagggaaatcttcctttgctcctatgagttactattttttttatttttttactttttttgagatggagtctcgctctgtcacccagactggagtgcagtggtgtgatctcagctcactgcagcctctgtctcccgggttcaagcaattctcctgcctcagcctcctgagtagctgggactacaggcacgcaccaccatgccctgctaatttttgtatttttagtaaagatgggtttcaccatgttggccaggctggtctcgaactcctgacctcactcaggtgatcccccgacctcggcctcccaaactgctggggttacagg

SEQ ID NO: 113346 - DNA, 1029 bp, Homo sapiens
gctggtgtggaaatgcctggtaaatttgagagaacaaggaaggataggttctcagctgcagaagatgggggaggagatctggcttgggacatactaccttcccttggcttgactcttgttcttcaaagccacatcttataaaggggaaataaatacaacagataaatgcctgagtgacaattagcgagatagaatgaaaggggaaatagagtgctatgtgtgaaaacaaccaaggttggaccctgctcaagcaagctgccaggcatttcaggtgacgttgaaactatgacctgaaaggatctggccagttaacatttggggaaagagctttccaagcaaagggagcagagtgcggtgtgtttgagggactgaaaacgtgtctgagatgagttgtgatagaaggtgaagtcgtgggagtatataggaatcagatcatcttgagccttttgcaccatggaaagagcttggattttaatctgaaggcacaagaaaccatggaaatatttacataggaaagtggtgtggtttggtttatgatttaccagatcattaactgatatatggacaagagattggagaggaagcaaagttcctagagtcatgatattcaggaataagttaaaaaagaagttggaattctctaaaattttaaagatatttataaattagagaaaatttacaaatcataaatgtataaactacaaaaatttacaaattatatttataaatactagaaaaaagtgatagtagtgattctgatggctatcaaaatcagacctaaaataatcattgtctcacttctaaagacccattactgggcatggtggctcatgcctataattccagcactttgggaggcagaggcaggtggattacctgaggtcaggagtttgagaccagcctggccaatgtagtgaaaccctgcctctgctaaaaatactaaaattagctgggtgtggtggtgggcacctgtaatcccagttacttgggaggctgaggcaggagaatggcttgaacccgggagcagag

SEQ ID NO: 113347 - DNA, 1029 bp, Homo sapiens
agcccgtctgaagttactttagtaaagtgactaagtttagtgataaaacaacacacacctgaagagaatgcctgatcgtcctggtgggtaatggggtcatgagtgtcagttttagtaacagtcgttataataaaagcagagatgaagagctcagccttccaaagtcacaaaataacagtacaatttgctgatttaatccaagcaatgttttaaaaacagaactggaaactcagagtttataaagacttacaccctctgtcatcaacatttttcaatcccacaggagcccaggaggttcaatgtataaactaaaaggctgaatataaataaagtgacttgtcccgtgtcacatgactggactaacaaatcatggaatctgaaatgaaaactgttcggtttcacttcagtattgtaatatccagtgccattattgtgatttcgatgctgcatgttgttcttaatcattgccaggttttgcagcacggaaggctgcataacatgaatggtgaaagatcaaccaaaaacatgtaattctggaacagtgtctcttattgtatgtttttttaattgaaatttttatatgctcagagccgaatttattttctattataacctcatagttttatgttcatggctactcaatagcatggttattttaaaagcagtaatcaataattatatgtccatagtcattattacctaatatggtaatgaacacagttaaagactatagacttgcagtttcatccagaggttacgtctatcttctgttaaaatgtgaacttctctttgatgtggaataatagttgagaaataaagatggctggccatggtggcccacgcctgtaatcccagcactttgggaagccgaggtgggcagctcacgaagtcaggagttcgagaccagcctggccaacatggtgaaaaccccgtctctactaaaaatacaaaaattagccagacctggtggtatgtgcctgtagtccagctacttgggaggctgaggcaggagaattgcttgaacccggg

SEQ ID NO: 113348 - DNA, 1025 bp, Homo sapiens
cctgcctcagcctcccgagcagctgggattatagatgcacactatcacacccggataatttttgtatttttggtagagatgggtttttaccgtattggccaggctggtcttgaactcctgaactcaggtggtgcacctgcctcggcctcccaaagtgccaggattataggcgtgagccactgcacctggccagaaagtcctgatttaaataataaagttcaagagtgtgtcctctgccatcctcgatttactagcttgctctgctttagtgtatccatctctaaaatgggaatattattacttacagttataaatagctgtaacagagcatacagtaatggtccttgagcttctcagtgtcagaagattcatgttttaaacattttaaattcttctgcttatctatagcactcaagaacataaagtgctttgaaatagtccaataaaaaggccaggttttttcctgctatagatatgtgggatgaggtacattcaagtggtaaatcagtgacacccagtggctgctgcttttatatttagtttttaaattttcaatttaactttctaaagttctgtcccaaaacaaatgaaagaagatgatgagagcatggaagttatagatgcctttaaagaaagagtttctcagcagtgatatgattttcctaggacatgagagctattgaatagcaataccaaaaatagagagagtgcaggacagtggaaaacggttctgggaatttccagccccatcatttgcatgctattaaagagtgtactcaagctttcctgtcactgttggatttcccaagaaacattctcatccttgaagtggcatgttaactgcccaaatccagcgaaatccttatgtgttagagacagttgggaacattcactggatattagacttcctaggtgtaagcaagacttaactggaggtttaatccatagcccgcaccaaaactcccctcagtcgtaatatgactcgctgtaactgcctcaaatccccacacacatgaagttgagta

SEQ ID NO: 113349 - DNA, 1036 bp, Homo sapiens
aaatatctactcatttataaactggttgggcatgggtgcatgtgttggtttggtggcagctgttataatttttactaggttattgaataagtgacgattagagtggagccaaggaaagtgatacgggtgatcttaaacacacagggtttctaaattttgcttagaatttccttggaatggatttagagacctaaaaaccagtatcatgaaatcaaagaccactaggacggcccataaattattgtttgacttgaaatgtttccagtaattcagagagggcagaggtgaatgtctaggtttccaatcttatgatctaaacttccttctttccccatttgctccatttgtttttctagaaaatttgtccctgtaggaggtagctgagctattggaagaatttgatctcaataaattactatagtagtaatactgtaacacatctttactttttaaaaacagagcttccttatccagccaaaaagcatgtaggtctttgcatacacaatacatttctacaaaagtaattaaaacaacatgaaagaaccatgttggtggagagccttttaaacagcccaacgagtttgtttataaatgtggttttctagatcatgctcagaattctttgcaaataaatatttgcatgatatttttgttcaaagattaatttttcctgggataaaatggggttttagaaatattcttgtgtttagcttcatattgcttttcagtgatattatggatttatagaactatttctattaaatggaaattgtacactgagcacaaaattttgtgaacttaatttgaaatgtgggctatattcaaactacagaatgtgctgttttaaataattcacagtagagatagacaaagacaaaaatacatctggacagcagtagttgagctggctattttaagaaatcaatctcagtggtagcaaactcactctcttttatgagattgtaatttctaaagcacagttaatattgggccctatcacatgcatctgggagtaactgcacatctgtgaaatgtt

SEQ ID NO: 113350 - DNA, 1021 bp, Homo sapiens
gacctcatctctacaaaaaactaaaaaataaaatacttagccaggcatgacagcacatgcctatactcctagttacttgggaggctgaagtgggaggattgcttgaatgcaggagttcaaggctgctacttgaggaagtgcaaaatagattcacattttggcattttgtctttttttgaaggggtcaaaaataattattttagaaaatggaaaaatgaatataatctgagaagaaaaaacacagctgtttatcttagcacttttgaaaagcaagtagagaaagatagcactctacaaacctagatttaaatccaaaggtggctgttatcttattgttgttctcataggattttattatctgtattgagatgttcctcgctgccattgctcatcattacacattctcatataaaccatatgtccaagaagcagaagagggctcatgctttgattcctttcttgccatgtgggatgtctcagatattagagatgatatttctgaacaagtaaggcatgttggtaagtaccagctatttaattcaaccaaataggttgggtaggatattgaatttctcctactagggcaatttattatctatttagagatgaaaaaagactttaaagcagtaccacagtgcaggctcatcaactttggggagtgggagagggggaagtggggagcttatttttagaatggtaagtttataatggtaaaaataacttttgactaacagaaaactttatattaaaggacggacagtcaggggacatcccaggaaaaaattgtttcccgaggatcaagatcaaaatgaacatacaagtttattatcatcatcatcacaagatgcaatttccattgcttcttctatgccaccttcacccatgggtcactaccaagggtttggacacactgtgactccccagactacacctaccacagctaagatatctgatgaaatccttagtgatactataggagagaaaaaagaaccttcagataaatccgtggattcctgaacag

SEQ ID NO: 113351 - DNA, 1222 bp, Homo sapiens
tgtcctgtttcgccttatacaaggaaaagtggtttttaaatgacagtttcctttgtttcaaatgaggatgaggctaaaaatcattagtattaatagtagcattcagttgctactaaacttgatagaacacttaatagtgattcacaactttgtacattggaaacatctggggatcctaatgccagatggtttggggtgtggcctgaacagctgggcttttaaaaacctccccaggtgattttaatttgcagccaagattgagagccactgccttctggaaataaacttattttccaaatgaaatcaactattgtttgattgaatctggcatcatttctgagacaattcaattagtgttgtaccattatttcataagcaaatccttgggttaaaaattttagagctgtttggcttaagaaaaaatttaatctgctctcatccaaatgaaagatctacaggtaatggaaaccagagcaaattatctaacctgcctaaaccttggtttgttcattctttttgtactggaacaatgaaagttctaatgaaagccagccttagcttgatgtgggaatataaaggaggtaatgtaaaaagcattctgtcaagtactattgagtcaagtacaaagcaatccctgaccacaaaaggaatgtgtaaaagtgaaaaacttgagccctgaccacaaaaagaaaaagtgaaagtgaaaaatttatactttctctaggtacctatacgtgtatttttggacctatcctcattgccctgtatacctttaagcaagccagtggaactcttaagactagatttaatgactccgtatttgaacacctctaacagagaagtaaaggtaaggacaacatgcaaaatgatttcgtttgttattgtttagaataattatcttaaattaggtaatacttttatacatacttttagctactttaaagatttaaatctagtgaaatgtattttaaatttttgtatttaaaagtaactaaaaagagacttatctaagtctactctatgcactctgatattttcctaatttctttattttcataggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttg

SEQ ID NO: 113352 - DNA, 1051 bp, Homo sapiens
caggatatttcacattgataaaacactattatataatatatagtgcatattaaaattttccattaccccagtaatattcttcattgcttttcttcccagtctagttctaatcaagagtcttacattgcatttagttgccatgtcttgtcattataatttaattgtccttgctttagatatcttttaagtggttataaaattgagataatcagtttagtaagagaccagagaattaatttaaatctaattcaagagcagtagtgccaaagtagttttgaggaatggggtgttttatagcttagcttgtttaggttttaatgatctatttagggagactacatagtatataattttggaaatgtatatgaattactttttaagatatgaaaaaatgtgttggtgaaatgtttagttctgtatttttataagtggattcttactctatttaacttaggagtaaaaacatactgtgaaatgtacatatgataatataaagttcacctgcctagtatcctgttctagaaattcaagtaggaacaagcttggaatattcagtaaaaatgtagatttgacatttgattgtaaatgtggcaaatgaaaataattatttggtttaaagtatcctccacctccatttcactggatgtcagtaggtggcccacccacccttctctcccttcacacatagcacatagctcaggtgtgaggaaacaagattacataggtaggtgtggaagctgccttgacttaacagcccttagcttcatatagcaactcttctcccatgggcacagcttccacggcctagcaatatgaacacctggttacactctcagggaagcccacatgtggtatgggttcccgtcaggcatttatcctttgttcgtagttctctccatccagatatagtctacctattaagaggcattctttttttttttttttttttttaaccataagcagtgttcctgataaacacagctgacattctattcttataagattttcagggaaagagaaggtaaacccaaggtcaacgtaggaagagaaa

SEQ ID NO: 113353 - DNA, 1032 bp, Homo sapiens
atattaaatgagtatttgtaatcctttctatagtgatctaaagaatggggggctagatggaggatggagatgtttatgtgatcctctggcttataagtactccatattttttttcttccttactatttaatgaagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtaaaacacaaaataataacttttggctttgttttttttttgaggtcagattttatgtaaattccttaagttctttaatcgcttaactgtaaaaataagtcaagatcactgtatgctcctcaagcattacttttcaggacgtgtgacttcatttgctgctaaaatcatcgctggtttggcca

SEQ ID NO: 113354 - DNA, 1017 bp, Homo sapiens
tatgttgcctaggctggtctcaaactcctggcctcaagtggtcctctctccttggctttccaaagtgctggaattgcaggtgtgagctgccaggcctggccaaaaatacttttttttttttaaagatggagtcttgctctgtagcccaggctggagtgcagtggcgtgatctcggctcactgcagcctctgcctcctgggttcaagcgattctcctgcctcagcctcccaagtagctgggactacaggcgcgtgccaccacgcccagctaattttttatgtttttagtagagatggggtttcaccgtgttagccaggatggtcttgatctcctgacctcgtgatccgcctgccttggcctcctaaagtgctgggattacaggcgtgagctacagtgcccagcccaaaaatattttttaaggaagaaaaaaaaacctttaacttactttatccttacttattgtctttttaggttttttaaattatattttcatagcttatcattatgcacacacatttttacatacatgtgataacataattcttattgttattttttttagaccaaaggtgaaagtgctaattgtgaaaagtatgggaaagttataccagcaagtgctgttatatttgggatggcagtagaatgtgcagagataagaagacatcataggtaagtgtattagtccattttcacactgctataaagcacctcccaagattgggtaatttataaaggaaagaggtttaaatgactcacagttctgaatgctgaggaggcctcaggaaacttacaaacatggcagaaggggaagcaggcacgtcttatatggcagcaggcaggttatggggggcagagagagagagagagacagcacgagaccacgtgggtgagtgtaggaaaaactaccatttgtaaaaccatcagatcttgtgagaattcactccctatcatgagaacagtgtggaagaaaccgttctcataatccagtcacttccctccctcaacttgtggggatta

SEQ ID NO: 113355 - DNA, 1004 bp, Homo sapiens
attatgttttttactataacttttatcaagaactggacataactgctaagaaaaatttgggattattgaaattttgaataatgaatttgagtcttttttatgttaacattctgatggaatctagttgtctaagttaaagcccattagtattcattaaagatacaatgccagttgtgtctttaatagagtagatcccatggtttattgtatgatttgtttctagacaagaatattagtttattttttaatgcagagtgagtaatggttgtgttaaagaataaaaggaaaaaccccacattttagcatcatcatttccttaaaatttgagaaaatacagtagattattttttcttgatggagaacttttttcccttgtagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaaggtattatcatgtaaactaattttagtgtttatacttctctatttttaaaaaactaagatatatttctagcttttagtccaaacaaaatgctacaaaacccttattttgtaaagatatggatataggataagatagtttattataagacatatttaaataaaattatattctttattaaaaatatttaaagatcttgagaaaaatttgtggcaagggatcaaataaacttgatcttagcaagttactttacctttgttaatttcagtgttctcattgtaaaaatggataattcatcctgtgtggtcaataactgctaaaaagttgtacttaaaaagaaaacacaagcagttcagattcaatggacttatcacattttgtgttaatatacttgtttaaaatgaaagctttggaaatgtcagctgtcagtatattttggcatgggccctttaaatgatttg

SEQ ID NO: 113356 - DNA, 1099 bp, Homo sapiens
aaatgttgtcatttctcagtttcaaaactttcatctcgtttaaaattttaaaggccctcgaattggaaatgaggtctcacgtgatcctcttctccttatatctaatttaagcatgccctggcttgagggcttttggatttgttatattgtgtgtagtaggaatatagtgggcctctagttgaataaagtgtgtaattagcctaaagtgattatcatttaatgatgcgttctttaaacttcaattattggattatttgcaacaattactctgttgaaatgctgttcttttttgaagtacttttagaatctaaattacgaaaaatgatttaacttaaaattgcaattactttgcttcatttagactgagggtttgtcaacctcagcactattgacattttgaatgggataattctttgttatgggggaggggaggtgtcctgtgcattgcagtatgtttggcagcatccttgatctctacccactaaatgtcagtagcgtctagatgtttgtagttcatgtaaacttagtgtaaatttcaggaccagctgtcctacttgaggaggagatgatatgttgagatacagtttgcttctcttggtaggcagcaatagaaaaatggatcaactcaagtgatctttcctcagttacttgtttcttagtttcctcttctgtgaaacagggacgcagcctctcttaaaaatgtttactgggtattaaaagtatatttagactgggtgtgctggctcaggcctgtaatcccagcactttgggaggcggaggcgggtggatcacaaggtcaggagtttgagaccagcctggccaatatggtgaaaacctgtctctactaaaaattaaaaaattaggccgggcgcggtggctcacgcctgtaatcccagcactttgggaggcagagacgggtggatcacctgaggtcagtagttcgagaccagcctcaacatggagaaaccccgtctctactaaaagtacaaaattagctgggcgtggtggtgcatgcctgtaatcacagctactcgagaggctgaggcaggagaattgcttgaacctgggaggcagaggttgtggtgagccgagatcacgc

SEQ ID NO: 113357 - DNA, 1039 bp, Homo sapiens
atcccccatctcactgttctcccgaccgcgccccgccccatttttcagtaagggcgattaaaacatattgattatactgtctcgggcacccagcatggtgcctggtacagtaaatatgcatttaatgaataagttgaagtacatttctgtgggaagaatttagtgagccatccctgtaattttggaggcaagtcactcaacttctctggatgatctccaaggttccttttggttctctgacctctttggtgttgcaaaatcaggactgggactcacttagggtttttttgttttgtttttaagtctctgctgcttgaatcagaaatgggactctgggacatgtgacaagtgggcttatttggttgagggctctccaggcccttggcatctggtatgtgtgttgggtgggaagtaggggggcgcctatacatatggaggagtgagcatagaaaggaggagttgggagcgggggtgcagagtgaacacgagagaatgaggactgaggactctttctgtaacttgatgttaaccagagtcagtggccgggagaatgtaccttctctctcattggttgtagtagttccctctggagctagagaggtgtggagagaggcagagggcaaagccagtttggccactggtagaaagctatttctgtgacagcatattagctttcctgccatcaggacacatgcgttaggttccagcagcagccagtgcatctggggggccagatgtcagctttcctccagactgtagactttcttgaatttgtgaattagtatcttactcattttgattctcgtcctttagcataagaaacataacttgtaatcatgctttgagagtaattgggaagtgtctttttttctcgttatgttcattaagaatttatgtttaaattctttcccagaaggtgacaggaacacagctgtagctcacatgccttttcccgcttgctccataaagtttacttctagttcctatcaaagactaagagccttggactaaagtcaggggacctgaatttaattcttct

SEQ ID NO: 113358 - DNA, 1018 bp, Homo sapiens
tagcaatctgcaaatatttagcacctataatttgctaaatactggaattagatacggatttataatggggtagaggcccttgcccttgagtttactgtcctgtagttgaaattacttcaatctaaggaacatttttgaactccttcctgcactgtgctaaattcttgaagaaacaaaggatatagacacatacctgtgacaaggttaaacatttagtgacaagtattctaacttttccagggacaagggtttgtatgttagagtggaggaggtttgtgaaagttttggaactcactggtgataaggagtagaaccttatcatattggaaaccagaagaaaccagaacactcgagtgtttgaagagactagtttggctggaatggtggtttttcagggagtagtagactgggatggatggagaggtcagttttagattatggagggccataaaaacaaggttaggaatgtggactttatcttgtggagagttactgaaggcttttcagcagaaggctgacataatagcaaagagatggtttagagacagtatcgcacatttgtgtgtagggtgaagttggggatagcgctaggggtggggaggaactccagagagaagagccagtcattttagtggtggatttggagattattcactcaattcaatgaattctttgttcaaatggcttttttagttttctttttaaagtactttcttttcttaaaataaccagtgtcttctttaaatgcagtttaaacttttgtaagccttcgtgatgtctatgtagtttcagttgcttatgattcatacaggtagatagcacagttgccagaaacagcaataaaccatatatgcttttctcataaattttacgttaggcagtcttgagaaaatgtatcttgttctttagagaaaattttttaaaactaacagtccttacagttattaagcactaatacagtgatataaaatgctctgtagtgaacttaaattgtctagctgtgtgtgtgtgtgtgtgt

SEQ ID NO: 113359 - DNA, 1077 bp, Homo sapiens
tatattcacatatatatatatatatatatatatatatatatatatatatttatttatttatttatttattttatgatggagtcttgctctgtcgcccaggctggagtgagtgcagtagtgtgatcttggctcactgcatcctccgcctcccagattcaagcgattctcctgcctcagcctccaaagtagctgggattacaggcgcctgccaccacgcccagataagttttttgtatttctagtagagatggggtttctccatgttggccaggctgatctcaaactcttgacctcaagcaatccacccactttggccgcccaaagtgctgggattacaggtgtgagccaccgcgcccagtctacctgtatgttaaagcaaatccagcagcaaagaaatctgttcagctttgtttaaacccatcagttcctaagtttatttaaccagggcctctcttctcaaagcattcttttctttctcaaaggacaaagattggtaaatactagtttaacttctaattaaagttggctgggtgaaacataagtgaagccttaatatgtgtgggctgcagaatttatctttttttttttttaatccacatggcaaaaatcatataggggttctgagtggtaacttagtttccctgcatgtctagtatcagaattttgaaaaacattgtgaggactgagagttacctaaataataactttaaaaaatagctggttttgctcctataaagaagactgagcctatattaaaagattatcaagaatcgtcttgaaaatctaggcataagtgtgcacctgtagtcccagttacttgggaggctgaggtaggaggatcgcttgagtctaggagttcgaggctgtagggtgccatggtcatacctgtgaatagccactgcactccactctgggcaatataatgagattacatacctgaaaaaataaaacatgttagttttcttctaacctgtggcttttgtccaactggagtcctttccctagcaaaaaggcaaaattgaaaataattgtgatggcagtggaggaccagtgaataacatatttgtattatcaagg

SEQ ID NO: 113360 - DNA, 1042 bp, Homo sapiens
gtatccatccataactcaagatgatcccctatttagagaataagtatacattctacaggcatctaaggttttcatgtttctctgttctgtttggttttaatggtataatatacattaaaaattgtgcatcaaggattttatttcaggtatgtgctgcattgcttctctttatgtaataaattccttgttaactgacattgtttcccggggatttccgtatgttaacaagttctttctacagagatgattaatacttacggtgatcaccctgaggttccacaaaaccctcttgaatcatcagagatgacattctactcattgtaactttaatgccatgtatttattgtcttttaattgttttgaaagttgggcatctgtttgagatatttttttcttttggttataatgacccgtttcctgaacttttcagataagaaactataggatactatcatggaacctgttttctcctgtaccctggttttaaaaccagtggctggaattaagacatgtgttgagggaggaaaagggaaaagagaggagcctgaagggactgccacttttctctagcagtggaataaggagtacttcattgagctaagaataattaatgtggagtgttgaaagatcattctgtattttatgcacatgttccagataacagcataaggacctatgaaaagcaagaaaaaagttttctggggctgtcatctttgatcacatagagatggagtgtgtgttcatacaccagccattcctgtccgtccttgccaccactgacttagaccaggtgacacatgggccttagtatgaatgttgtaattggagaatctgcctcaattttgagctcaactccagtctgtagacttgctgatacagtagtatttgtctatcacagcacttagaaatgatagcctgtggtcaggtgccagtggttcacgcctgtctgtaatcccagcactttgggaggatcattggaggtcaggagttagacaccagcctggccaacatggtgaaaccctgtctctactaaaaatggaaa

SEQ ID NO: 113361 - DNA, 1056 bp, Homo sapiens
tctaaaaataaaatcacaaggctgtagttttgcttttagatttcccagttttcaagtgatggcttgttgtgttttatttcttctgttgtgtctccaatccagtgctccatttttgcttctttctgttctctggtcccggatttgacatgtattggtacagattcccagttgctttcaaaaggtgccttgagaactttaggcataagtgaaagctgtattgtgcccgtcagatcaatagtgtgtaacttttagaacacaaatattgcaaagataatgtttatgataccataagtcctgccatgaattccctgagcatcccatgggtgtatgtatatgatatctaggacataaatgacatgtagtttatgctttcaaacagaagtcatccagacaaccttccctccccctacaacattatcatgtctgagctcttttttcttaaaatgaaaatactaagctgcttgaagaaatgtactgctaagaggacaggcatttgattttcactctgtcattgttagctgtgactttggccaattagtgtggattttcagcaattatttcatataaggaagattgtactctgagattttaatataatagatttctaaataattataaaggcatagctcatagttgacttaagtgatgctcattttctttatcctttagataggcaaaccactccctattttcataatttgtcaccaaatacatttttcaagtctctagtagtgaaaaactgagtgtattaactccttttacaggtcaaacttctttctgatttcgggaaaattgagatttgtgtgtttattgacaagaatttttctgaggtagattgttgaaaagctgttggtttcctaatttccaggtgcatggttgcttttttggttaaaagtaagacagggggagaccctgggctgaggagctgtgaaatctctaaagaggtctgtgaagtaggttattaagaggaagtaaccttattagctggtagctggagagcctggaagcctctcttaagcagctgcatcatatccaagaactgatttgcattcatgt

SEQ ID NO: 113362 - DNA, 1026 bp, Homo sapiens
gcccggtgagactgggaagtctaggagcctgctgcggcatcctgaaaagcagcttagttcttagcaatggcagggagaagtggcgtgagtctcaaaatctgtaggaaggattttctttttccgctttttcattgatctctttcccttaacccagatactttcccatctgcaggagcaaaaggggggaaaattccatgaaacgttgagtttcaatgtacagcagtaggaaaaaagttttaatgtttcaaaggataatggaggataaatggtaacttaaagcattggtaaatattatgcaggtcgtgcatatgggatggcatacatatgggatggcatagattagtttttgtgttggaatttattcaacagtgattactatcttgaacctgtaagacctgttaaagctatttgagggtatgggtggaggaaaggtgggttacagaaatgagtctgtattcagcctgtgctgtctttcctcctgccctttctttgttcaacactccctgctccacagttctctgctgtcctcactcttgtgacagtggccttctccagggtcacacctctgacctccctggactcagtttagaggatgcttttcatttcttatctccacctcttgggagcatgtgatatgttgtcagtcacttttttgttcctgaagtgctttcttctctattgtgaagggacctggagtgctcggcctgtgtgctgaagaatgtgcagctcttctcactagtcatatctcctcagcagatgaccaaggtggaagctagaagatcagggttgtcacataatcgggtgctggaggctttagaagcaaggagggtattttcagtgggaggatcaggtgtgacattctggtagaagtagtatttatttatttattttttcttttccttgggatttgagatgcacttggcacagtgagggctcaatatttgaatgaataaaggcagggttgaaacacacagatgagggaggagtattttcagtttaggaaacacatgaacacaacatcagcag

SEQ ID NO: 113363 - DNA, 1050 bp, Homo sapiens
caagggtaaggagatcagcacatggggctgggaagggcaggttcctccattaacctctaccagcctgctctgctcctttttacacatttgcggtatttggtgtgtagaatttgcacagtgggttataaacagtctgattatctcaaatgatatccatgcttgatctctcttgttggtaaaaatggggaacaatattcttgaggtatttgctgagagctctaattatcagtactttagcagattcccatgacaccaggaaatctagatattttcacatgcttgagaaaacattcatgctttattaagctacaagctgtacagcaacatctggaaagtcactcagatggaataaaaccaggttttggttgaaacatcagttaatattatgaaagaattataaacatgatgttcatgccataaacttatccggttcttgcagcagcagctctcttcagctaatgaaattttcacagaactgatgatatcactgaaaactgcaaggtggtgactgcttttgtgagtgtgacctcccctcttagcgtctcccactgtctttgggagtgagcactggggaaggaggctatttttgtgaacactatctgctgctttccattcagtcgtggagaagtcaattcaactgtaagcttaagttcagcatggcataattattatctaagcaatatttcatcaaggtgcatttctatttaagtgggctgagggccacttggttgtgttttccacatattttatttatgtttgagtcagagtctcactctgtcaccaaggctggtgtgcagtggcacgatctcagctcactgctacctctgcctccccggttcaagcgattcttgagcttcagcctcctgggtagctcgtattacaggcatgtgccaccatgcttagctaatttttttgtatttttagtagagatagggtttcactctgttgaccaggctggtcttgaactcctggcctcggcctcccaaagtgctgattacaggcgtgagccaccatgcccggcccacatgttttaaatgacatattttaaat

SEQ ID NO: 113364 - DNA, 1053 bp, Homo sapiens
gcagtgagccgagatggggccactgcactccagcctgggcgacagctccgtctcaaaaacaaaacaaaacaaaacaaaacaaaacaaaaaaaaccaggagaaaattgtggcatataccatgctggctattttggcagttctctgaggccttgctgctatacctctatgtttattgggcataatagcttctacctccatccacacccctacattctacttaatagttgtactgtaacaagtattggatatttgagaaaattccatttctgtttatttttgaagtctattttttcttcccaagtagccaaatgatatttcagtataataataatctacttgagaagcagatttcctaaataactttatgtgagacttgtctactttcttacatatatttacagcaggaatggctagaaattagttgataatcaaattgaaattgtgtatttgttaaaaactagtgatttgcttggagtagtaaaacgtatagtgattgccttttagatttggtcaggctgaaggaaatcattttgtgaccctagttacaacttggacgtccatggcattcttgtaagtgagggctgttgtcacggaatttttaggatgtctcttttccagccagaaatctctgtgtctggtgatgcctttgcccaagttttgctctggcccgctgggcttgttctgcctgctcttcctggcaggctgcactcggcttgtgctactggcctggatctcatgcctgccaagggcgagccaggcacggagtggcgaggagttcgtgagtgagttcagggtcatccggccactgtgcacagccgggcatgccgactgtggtggggcaggcagctccaggcacaggcactggctccgtgcaaggctgtggctggaccaggcatactgcaggtcgcttccattgtgggcactgggaacacggtggcacccggaaacttggagacaccaggaaccgcagagccccaaagaggatgtcacagccctggcttagggagcccctaggtctgggctccccgaagggccgcagctcttctctccttc

SEQ ID NO: 113365 - DNA, 1099 bp, Homo sapiens
attccttgccagccctggttttggcagtgatagtttttaggtaaggctgttctatgtttgtataataaaagcttatgagatttgttaaagcaaaagttcaggtcagaacccaggaatacaaaagtaattaatgctgcttcctctcttagatgatatagttgagtctctgggagtagtgcagagaggaaggattagtggttcactttgtaataaatgaattgaagaccatttattgtacataaaaacaggcccttaagcaccatgataagtttggcactactgtgaaaaggacaagtggttaaataagcgttttgccaagataggaaaaatatgaaagagaatgtcagtgaaaaagaggttgggtcttgctatgttgcccaagctggtctcaaaactcctggactcaagcaatcctcccaccttggcctcccaaagtcataggactacaggtgtgagccaccatgcctggcctaaatttcaagccagtaagaactcttccaaactttaagaagggaattagtcagtgtaacacaagtcgagcatacatctgtgcgcacacacccatgggtggcattggattcctttctgagtgccactgttctaaatgcttctgtgttttatctcagctaattccttgccatagctctctcaggtagttgttactgtttccattttatgatgagaaactgaggcacagagcatttgagcaatttccccaaggtcacgtagctagtgggtagttgaagagctgagatttgagcccctgcattctcctcctagagccccacatcttacctttttcttttttctttctttttttttgagacgagtctcactttttttgcccaggctggagtgcagtggtgtaatctcggctcactgcaacctctgcctcccgggctcaagtgattcttctgcctcagcctcctgagtagctgggattatgggggcacactaccagacccggctaatttttgtattttcagtacagacagggttttgctatgttggccaggctggtcttgaactcctgacctcaagggatccacctgccttggcctcccaaagtgctgggattacaggcaagagccactgtgcc

SEQ ID NO: 113366 - DNA, 1035 bp, Homo sapiens
catccctttccctccagtccctggcaaccagtgatctttttactgtctctgtagtttgaccttttccagagtgtcatctacttgaatcacacagtgtgtagacttttcagataggcttctttcactgagtagcatacatttaagctccctccatgtcttctcatggctcagtagctcatttctttttagcaccgaataatactccattgtcaggatgtactacagtttattcattcaccttctgaggacatcttggctgcttcaaagttttggtggttgtgagtcaaacataatttggtagttgtgaataaacatccatgtgcaggttcttgtgtagacatagttttcagttcctttaggtaactgccaaggaatgtgattgctgtgtcctacagtaaaaatgtttttacttttgtaagaaacaaccagactttgaaagtgtaccattttgcattgccaccagcaatgaataagagttcctgttgctccacatcctcttcaacatttggtgttgtcagtgttttgggttttggctgttctagtgagtgtgttgtatttcattttaatttgcattgccttgatgacatctgatagggtgcatcttttctttctttctttctttattttattattattatactttaagttttagggtacatgtgcacaatgtgcaggttagttacatatgtatacacgtgccatgctggtgtgctgcatccattaactcgtcatttagcattaggtatatctcctaatgctatccctcccccgtccccccaccccacaacaatccccagagtatgatgttccccttcctgtgtccatgtgttctcattgttcagttcccacctatgagtgagaacatgcagtgtttggttttttgtccttgtgatagtttactgataatgatgatttccaatttcatccatgtccctacaaggacatgagctcatcattttttatggctgcatagtattccatgatgtatatgtgccaccttttcttaatccagtctatcgttgttggacatttggg

SEQ ID NO: 113367 - DNA, 1107 bp, Homo sapiens
tttaatacttacctatgcctgggcacacacatgttagatggattttagttgtaattttggggtatttcttacagggaaggtattagaggaaaaaatactagaaatatggttcctgttcttaaagatgagcttcaatctaaattcaagacagagattttactctactttcatgttaaccagttatcctgcatagttccacggatactagtagaagacacaagactcctggatctttgacacaggacagtttattactgtcagtagctagagcagtgcattttgtgctcattccctgagccctgattcctcagggcactgcaaagatggccaggtgatacttatggatgatacagttggttgtgttataggaggaaaaactctgaatgcagaaaactcagatcttttataatggccagcaaggaagccttttgctctaggagacaccatctctatttgctaaggctgcaagcaaccctgctctttgctccagagggtagatattggaacagagggtgcttccaccatgctggggtggtgttggtagtggtgagtgggtggtatgatgtggggagatgtttgtgagcagttgtatccagagggtggcagatcccaggtgctgtgctgcattgtctgccttaactctttctgtaggctgtggtgagctattgacagatttggatgggagtgtgtcttgagatctttgacagagaatagaattggtgggaatagaatgggggtaagatggaaggcagggcggttgcttgaatttggggagtaattcagataagaaatgatggaggtttaaactagaatatttgcagtggaaagaagggatggataggaagagagacttcgcagacaaacagaatttgatgacctgctggatattggaagtcagggagagaggaaagtgaaaacgaactctaagcctcccagaccaggtggatgagacctttagccaaggcagaatgcaagatgagcagtaggtttgggagggatagagactggttttagatattctgaatgcaagtggcatgttataagaaatagaatgaaagcaagaggagagatggcaggaattatttttaaagaggtaaggttttgagt

SEQ ID NO: 113368 - DNA, 1014 bp, Homo sapiens
tgtgcccttctggcttccaaaaagaaggaaggattgaggctcaatcttttttcctgtatcgggctcaaaaggtctctgatttttgtgtttcttagcaactttcttttcttttttccaactcctggcagggctgtgcggcctccttttcctctcttttttttttttttttttttttgagatggagtcttgctctgtcgcccaggctggactgcggactgcagtggcgcaatctcggctcactgcaagctccgcttcccgggttcacgccattctcctgcctcagcctcccgagtagctgggactacaggcgcccgccaccgtgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcccttttcctctcttatagttgctgaatgttcgccctcaggaaggtgtgtctctgatgctgtgactccttagtgttctgagtagacttaggtagactaagggctagcctttgctcttctggttctttaagctctaatgagatggagagtaattattagcttgcttgggctgccataataaagtatcacaggctgggtgacttaaatcaggggtccccaatccccagaccgtggcctattaggaaccaggcctcacagcaggcggtgagcagtgggcaagccttatggcctcagctccgcctcctgtcagatcagtggcgacattagattgttataggagtgcaaaccctattgtgaactgcacatgtgagtgatctaggttttgtactccttatgagaatctaataataaatgtaatgctcttgaatcattctgaaaccatcccccccaccccaatcggtggaaaaattgtcttccatgaaaccagcccctggtgccaaaaaggttggggatgggggctgctgaataaacaatagaaatcaattttctcaca

SEQ ID NO: 113369 - DNA, 1001 bp, Homo sapiens
ctcattaaggtacaaaatgaagtgcttggtttaccacccttcttcttttttaatataggtgtttagtagcataaaatgtcatcttagtactgctttaccaacatccctcaaattctgatatgttgtgtttttatttcgttcttttcagaatactttctaacttctctttgagttttccagatatctttctgttattgatttttaattcagtttttgttgtaatcaaaaaacaaactctgtgtgtcttaaaccctttttattttttgagatttgtatcatggcccagaatatggttaatcttggaaaataaatggcctgtatgcactgggaatgtgtgttctgcttttgagtggagtgtcatttaggtgaaggacatgccagttggattaagttggttgatatttttgttcaaatcttctgtatcctgatttttctacttgttctgttactgaaacagagaggtgtttaactctctgattatagttgtggatttgcccatttctccttgtagttctgtcaatttttgcttcaagtgttttggggctctcttattagatctgttaacatttaatattgttttggcttcatgatgagttgacacttttgtcaatatgaaatgaccttctttatctctggcaatattctcggctttgcatatgttaaaaaattttgtttgtgcatctttgattttttttttaaacatttgaagcagaatttctgagttacaggattgtaaccttttaaaagttcttaatatcttgcgagattaccctccagaaaggctgtacagaccgacacttgtctaggtattctttaagtgtttataaagctagttgctctgatcttttataattttaagatatgtagcaaggtggactgaactgtagcatttctgttgatcacaggataaaataaactaccttatgtaacttgttttgtagactctgaaaatgctgtgtatatttttaaagttgtcatcaattttatttcatctctcatct

SEQ ID NO: 113370 - DNA, 1045 bp, Homo sapiens
tgtttaatcatcatagtcttctgaagtacactggtgttaggtatttaatagtgaaggaaatgaaggttgagacatgttaagtaacttgccagattatagggagccttatttaaaattcagaaccctagttctactagctaaaacctgcagtattggttttcacaggtgcactgacagtagctgtaattgtattttcatttccttttattttctcctcttggatgtattccatagtttaatctgttgaaaaacttagagcattccctttgggaccaatgttaccgctgcctgaacattgctttaaatgttaccttcttgtgaggtccttgctccagccagtgtaaaggttcctcctgtgttgcaggaaggaggagtgtgtaggccccattagactctacatataaaagaggcttttggaaaagcaaaaactggttctattcgtttttgttttcacatggggagaggattttttaaaaaagagaatttgtgagatcaagggagtgggggaaaattttttcggcaaaaactcaagtaaatgcttagttgttttgatttcttccctgtggcatttttggcaaactggggaaagagaaattaaacttagttggaggacaattgtttcatgttgtttgccttagagactggaaaaagcagaagagtgccaattttaatctagaatcctttgagaattagagaaagataaagtgattatggaataaggtttttttttttcctttttttttttcttttattattatactttaagttttagggtacatgtgcacattgtgcaggttagttacatatgttttaaatgaccacaatcattagtattattacgccccataactgatggcagtgtttttgaaatttgaatatcagtgtgttttaccaaatgaagaggttcctaagaggtaggagcttatatcttaagaggtaataaaatctatggtggtagaaaataagtttaaagagtttgttgaaggcatctttgagcagagtggtgaaaacgattgcagaaacgcagacaagatcatcacctgtt

SEQ ID NO: 113371 - DNA, 1011 bp, Homo sapiens
tgttttataaaataatcattactttgactcttcacaattagattcaagttacatatttttgggaggtacatagatgatgctgattgttctaagtgcatcacaacaagaggcacatgacatcagtttgttccattattggtgaaattgatcccttggttgggtgttactctggttatttatcagagcatagcacatcaccccaaaatttagtgttttgaaacaatcttgttattttcatgattatagagacaaattcaggcagggcagggcgagtttagcttgtctcttctccttgatgtctagagcttcagctgggaaattttgaatagctgtgggctggaatcatctggaggcttctgcactcacatctggtgcctaggctgggctgactcacaggctgggctcccctgggactgttgagcacggcacctatgtgtggcatcttcatgtagcttgagcttcctcacagacatggctgcctaagggctccaagtgagtgttccagcaaacaagctagagactgtagggcctttcatgattgagcatcagaagtcatatatagttcactttcacatcagctattgattgaagcagtcaggagcctgtgcagatttgggaaatctggggcagggagatagactccacctcttgacggaaagagtgtcagagaatttgtggccatgttttaaaattgccacaggtagtgactgctttatttcctaattgtaaatatagccattttctctttggaattaactgtaatctatcaggagacaccctgagaatatttaagaatcctgttccttggcatctttagccagttagttttagcattaattgttggctcctttatgtttattagttgggatttgaattacataaaaatctatgtgctaatcccccagtaactaaacgcgtaagaataacagatagtgctgggttcttaaaatcccttcttggacaaagataagcatgcatgacccaatttgacaggtgggccatgtcttactg

SEQ ID NO: 113372 - DNA, 1020 bp, Homo sapiens
gtattcttatgcgtaactgctttgaaaaataggtttagtaaaaaatggtgtagaatgtcttggtataaatagtgtatatggaaatagtgtatatgggaaagtcagtagaaagagagaaatagtaaatagttactaaaatattccatgtgcttagaaaaagaacagtcctataactatgagcaaagtacagctcatttttctccaatttttcctcacaggcacatatatccacgttcatccataggctcatattaagggatgggaggccactcactctagtgagacccttcattagaagccaaggatagctcacattcacggcagcggtgcactctgtaatctcagctcccaagagagcatctatagaatgcctctttatgaaaatgtgctttcataagtgaattgtaactactctgtctttcccacgatgttagcaggacacaaactatgtggaggtgtgagaaggacaactggaaaaccattgttggcatggattttcgttgacattctgtagctatagatgtttccttgtaaacatgtgatcagcttgatgcagattataatcaatccaggtaactggactaagcagacctttgcattaagatgggcagtctgtcttttctccatgcttaccaatttttttttggcatggcatttcatgggtgggctctggataataacttcccaagcccagaagccctttgccatctcctcacagcagtgttatgattccttgacatggaattactgtgttgtgaagtttaatctaagaccaggcttgaatgtgtgacagtatatgtagacagattatttcttaactcacttttacaatgatgagatcaatgggttggaaaaggcagccagaagattcagggctgtaattgagttgtggcgtgcctagaaattatgtgggatgcctcccctgcgttggtgtctccccagaaacctcccgtgaggctcagcatccccccccccaccaaccccaatgctagtgacaaagtgaaaggcaacttcttctat

SEQ ID NO: 113373 - DNA, 1049 bp, Homo sapiens
cagtttaagtatctgagtagttttgggttcccaagaataataacacatggctgttatattttttgtttatatgggcaaaaattttagtctttaaacaatgccccaggactgtgattatgacataaaaatgctctttgctttgtagagtaaagcaatttgctttgacttctattgacattgcaactgaactggtcttacttgctttataattgaattgctgcagatttccatcgacctttgcaagaggtagaggtggttcctggagttgtaacctgatgcctattagctgttgctataactttataatggggtctttattttttgtcatgtgattggttttaacagctgattctctcatcagcttttcctggcatgtacttttggcatattttagctgtcatagtagctttttgggcaagcattatgcttaatttctttaaatctttgggcaacagaaaataaaatgtacttattaagtttatggcaatttcattacatcttttcatgccttaatgtgacattttaatttatagttcaggagttgcctttttagttttggggggaatgcagagctgtatgtagttttgtttctgtgcttttgggattgtggagtaggaagctcttttcttgagaagtcacatttttctttttctagagagaatttcagatacattatattagccaagtgaattattatctagcaactgactgtcattcatctgtacattatttggcttcattatagttcccattttgtcttgccatgtttcagagggaaaatgaaacgggaggagtgaggtcgttctgccccttaccctggatggcattacttgagcttgcagtgtaactgagaattggactaagtggaattttaggaagctctaccatgcggcagttataacctgcatctcagtgcacctgcccgtgctgagaaacacagttagcttctttccttaatgggcagttggcagggttaatgtcttaatctttctccctttttccccctaatgtaagacttaaggaagattttctgatcaaagaatctggac

SEQ ID NO: 113374 - DNA, 1094 bp, Homo sapiens
agcactgtcataatttcatgttttggggtttggccccactgctgcacgtgaaagctacaaggtctttccccgaaattcaggcccatgtttccaagcaagagtgttgactctttttaaagaagagagtttcctcatcctttacacaaatgcatattctttccctgcttactgtcttcccagctcttccacccaccccacctaaacacaggaaatgcctccgtggcgtcaggaacagtcaggtagactttcagtctgtgcattttcaggaacgtgtttccaagttagcaatttgaaatcttcatgtgcttttagtgaaacactcttgtttctatttgtcccctttctttgagaaagaaggacggtgatgttggccttccgtgctgaagatagagaagaatcctgttttaggagatgccttttgcagtgtagtgtgttaagttgggaagatagcgaacagatattagcagttctgtatatttcttctgtcttggtaaacgtggtttctgagctttttaggaacagttgacttcttcctccattttcgcaaactgcaacttggctttcaggaaacttgtggcacttaggtacttttttgtacttggtcagtagcttggcattaaacagaattggtggtttgtgctcatgccagtcttactaatcaaaaatccgtagttaaagggacaacaagaaaaaaaggcaataaatagattttttaaatgtttaaatttgggaaatggtaggaaaggactctcaaaaatttcattatgttctagcacataatgagcttttaattattatttcactaatcacctttgatctttttcccaaagatgttctttgggaaaaagctggggctctcccctgaaccacagagtacaaaaaaaatgatctggtgagtgttttagttctcccaaggatgatactgtcaagaactgtgaagggtctgaaaccgtaccctgcttgcgagctaccaaattagcctaccatcgtttccgggatgctggcagaaggcgtgggactcgcggtcagagccaacagcctctattaatcacagcaatgacagtatcagtgttttcttgtgccagttccctgag

SEQ ID NO: 113375 - DNA, 1514 bp, Homo sapiens
cctctgtgcttagaggccattccaggtgtctgttcactgacctgtttacattaactttaaaaaaaaagggaaatattaagaaatgctctggtcaccagaagtttttgctgttcattggtttcgaagtctttggccctctctagaggaagcctgaatccagtggcattttcttctgaattgccacacgtgtaggagcaggtgaaagatctttaaatgtttagctgatcttttgcagctgccggtcatgtgcttgatgctagattcctgtggttttccttataattagaaaaagtgaataccttgaatgtcccactactcctttgatcaattagattctggttttctaattagtgaactcatagggtgctagcaggttggacagattggagaacctggagaaggacagtaagacagcttgagtttggggctgtggctggtttctgggttgttggtatccgtagtttgggctgcagccccggcaggatgcagagaggactctgtccctactggtcaggcatgataggggaattagtgacctagtcatctgggattgggatgttgtgcatttcgtgttctgtggcctttctgctattaatcctgtccttcaaactcctacccttagcccaggccagacccgatcgtctatggtccagtggcttaacccacagtctccaaccacaacaagctccaactcagctgtgacacctctttcacccgggtcgtcccctttccccttttctcctcctgctactgtagcggacaagccacctgaaaggtacgtggtttggagtggaatgtggaatatggtggcagcacacacagggggcttgatgaacctgagcaggttcttgtgttctctgctggcaaaagcttgcccagatacccccagcatcctggacttcatggacagcacttaccaccttgtatcagggccgtgcctcacccagttcagtagcaaggacgttctttggagaatttgccttacatgagacttgcttgagcctactctgtctttgtggtgctggttgtgcatttatgaagaagttcttattttggaagaacttcttgctcatgagtataaagcacattcttcgttttaaaagtaggcaagctggcactggaaacattcgcttccatggcatccagtggccaagtccatagaggacagagctgctgccctccagcagcctcttccacctgtagtggctcaggtgcttcttcctgtcagtggcttcccccacaccagtgaggtgaggcgtttcctttggatttgattagactggctaaaagcatggtttccgtcctttccatgaacggacacagaggttgctttaacaaatggtgagaagctgggcctggtgtgcctttcttggggcggaggcagggtgtaaatacagaagactcaggcaagagcaacaagccccttctagagcggtggccacccggagtggatctgggccagtggtttctcacctgtggagtgtggctgtgccgcctccttctgccggctggcc

SEQ ID NO: 113376 - DNA, 1005 bp, Homo sapiens
tcttcctgtctgacaactgacactgagaagacagactggcaggtcatctgaccacggcttctgtggagccaggcagtgttccaagtggccactctagacagctcagcccacaggagtactgccgggaatgctccctttctgcagaccagcaatacttagtgtccctggaatgcccaagacatttttcctgtgttcacttatccatttggagtcttccagcctccatagatgctcttgcagtgcaattcctttttgtacctcatacaggcaacaaaggaaattggtttatgccacccagtggcctttggagaaaacaaactggaggtcagagtgacccctgggcggcctcgtcagtagttatgcgtttgggatgtgtgcagctgtgagatatcctgacccagagtgtggttggcacaggggtctttagcaattgtgtagctccatgactgtccttgttctttgctcttactgggtgggcctggacttaagttatgagttccagttctaggcggaagatgtgtttctctagtagactcactaatgcctagctgtttctctggggctatgcctcccaactcccccgccccccaccctcgggagagggctgtgtttgtaaggtctcagggcagtgacgttcctgtgatggccagagggacctttcccttttctctgggcctggggaatcctggaaataggttttgctggtgaccaccagccagtcctgctgtgtctttccagtcaggtgcgctccagttagatgggcagtggttgcctcctcaggggcagggttgggaggggtgctgaggcaggtggtttccaggagcgaccccacgtggcagcggcagcagcagcgggactgctttcctggctgtcccaggctctttgtcaacatccacatgtagatgtgggggagcaggtgtggcccaaattaatccttaaaagcctctggcgattaaactttaaaggtctcagatagacacagaataatccctggaaaacaatttg

SEQ ID NO: 113377 - DNA, 1032 bp, Homo sapiens
tactttattatacataactatacagtgcatataaaatgaaagcataaacaaaccaaaattattcagttataccacagatgaccactatattatatgtatttccttacaatcctgtgtgtgtatgtgtgtgtactaacacattgcatataagtgagaccatgtttcatattacaattattttctgctattttgcttagcatatcgtaagcattttcgatatgaaaaaaattgtattaattgaaaatcttaaatcctatgtcatgttttacaacatgtttttctacttttaaccattctagttggcattattggttttccctcatataacttctataatgtgcaaatatgcatattatagaagtctggtctgaattctgaatctttaaggtgaattccaaaaacggagattgtaagaaagatttttggaagtatatatcacaaaactgttttcattactgcaatacaatttacattactgtcagcattgtagaaattgtattttaccatattctcatgaattttaggaatttgtgataacattttgcaacttgaaggtttattgtagtgattgattcatataaggcccctaaaggaaatttccaaaattctttggctaaagagtttattctaatttttcaaacagaatacgtaagtctttagggtatgtaatgccagctaagccaaacagcgttttattctgttgttcataaatacttctgtttctttagaatgtttgtcagaagaagtgttttggataattaagtctaaaaaaactaatttgcagagttacatgaatgcaaaacattctcataggctacatcaagaaaaatattcagagggtgtaaaatcttgcatcctgagagcatcgttgtgaagaaacattggttttggttagacagagagtgaggggttcagagtttctcagagaggtttatttttatcttcttcaagtttcatttaggagttaggaatactgagacaacttaacatagtaccttggagttgatgccacagatcattttgcatgacagg

SEQ ID NO: 113378 - DNA, 1094 bp, Homo sapiens
ttacagcatttttctttacttctattataacacttagctttgtagtctcatgatatattggatctgtttttgcactcaactgagagaagcctgaggtcagggatcttaaatacagtaaattcattgattaaataactcagacaatgattttacctctaagtcccttagttgtctagggaagttttgtatgagttaagctttaatgggattcctagatatttgtgaaaatatatgtttttggaaaattggattacatgttagataaacgtataattttgggtgaaattctgtgctaaccattttggagggaatgactcttccataatatccccttctataaatctggttgtcccatctcatttccttaaaaacaaggaaaataagatgtgctataatacagctgcataagaagctctttcccgaggtaagaggaaaattttcatttaaagaataaatcctaaaaggttggggaaggaaaggggatatgtgagagagcatttatgagattagagtatgacacagtgatactctggaagttataagacaagattaatatctaatgggtttttaaactatggaaaaggatatttttatggtcctgtaatatgaaataaaggaaaccagattctcttgggcagtgatcatctaactgctttcttcattgctcgtgaggccgagaggagttgctgcggggtgtgtaccgcctggctaggtcttttttctgtatcccttcctgcccatgctaccactgcatctgtgtttttatgtcttctactcgtaaagtaaaccattaccgtaaggattagagatgcttttcttctctgcattgctaccatttactagatgttttatgagcagtcattgtgtgaggtactttacatatttcatctaacccttgtaataccttctgaaatatggctgcattgtcatccccattttacagatggggaagctgaggctcagagatggtagagaaattgctgcattgtaccaatgtaagaggtagagctggcacttgagccctttctccctggcttctgaaactctgtgttcttaactactacattctactactacattctaccacctgagag

SEQ ID NO: 113379 - DNA, 1378 bp, Homo sapiens
atccaaattgcagaagccaagtattgccttaattacttcaattacattagttacattgtcacttaaatgtttgtaaatataaaattaggtatgcttatgtatataggttttacatagtgatacaacccaaacacactgacagtgtaaataccaacaaaagtgcattaccagtaaaaatgcaaaatagcaatataaagctagagatactctgctcaaactaaattggtgttcccagtgtgaccgtggcactgagtgctgagttaggtatgctgtatgtcagaatgccgtgtaatgagtcagttttgcacagctaatgagtattcctgtagagcaaaattttgtcctctcgccttaacttgctgtgaacatgtcttttatacgtatgaagtccacttccctttttccttgttgattcctggcatagttagagtagttgaagccaaaagactgttaacttagaagtagttgttcagatgttccagaataggattacataaacatttaaagttttatcatcaaaataaacgccctatgggctgggcacggtggctcatgcctgtaatcccagcactttgggaggccgaggcaggcggatcacctgaggttgggagtttgagaccagcctgaccaacatggagaaaccccgtctctactaaaaatacaaaaattagctgagcgtggtggcgcacgactgtaatcccagctactcgggaggctgaggcaggagaatctcttgaacctgggaggcagaggttgtggtgatccaagatcgcgccattacactccactccagcctgggcaacaagatcaaaactccatctcaaaataatgataaaaacaaaacaaaacaaaacaaaaaaacgcacaatgaaaattcccatagtgagctcctgtagattttgggatattcttggccccatgtatgaggagcaaaaaaaccagatcacagatctgatctgctggttccatcctacccaggagattagatacgatttcttcctcagtgggtaagctacaaagctttttggttactgggtgggttttcgtttttacatttagctaatttatttggccttaagttaaactcctcccagatttcaatgctaaaacatggatttgtggacatacctatttcttcatagatattcgtagggtcaaagcagattttgtacccccttctcggtagaaggtatcacagaccatacaactggatgtgactttaggagatgatttggttcagtcacttgcctgcaggtgtattgaaaaagtaatggtctttgaggtgatcttattttgtgtccccagccccgctctgcagaaataggtgttgtattcattgagcaaatatgtaagtaatggttcagagacaaggcaaatg

SEQ ID NO: 113380 - DNA, 1050 bp, Homo sapiens
ccctgtaatccttgttattctctcaaaaccaatctagactatttaaaagaaaggaaggtgggagaatgccaaaggaaaagggtgaacatccccttttagtgaacccactaaggttaagggttcacttaatgggtttccagcatctgttctttagaccaaatgcttctatgatagagataatcatgctaataaaatcaaattttgctttttaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggtaagatgcttctagctcccagctctccatctgacttttaaactccctgtgccatggtggctacatagtcaacaatagaaatttagtagtgtgctagaaatccttctgggagtcatacttgagattgtgtgtgtgtgtgtatgtgtgtgtgtgtgtatgtatgtaaaattaaccatttttgtgaaaaatgtaagcgacttaagtacctcaaaagtgattatagagaagtctatcatatacttcttttggttattggaaggaaaatgtaaatttctgagggaaaagtataagttgaggagacatcctacgttaaatggcatgtcatctatttatgaataactgttgatttgtaaagtcattatggacttgggtatcacaggagtcaaaattaaaagtatttaacattcttagaaaaaccttttcttccccacttacatataatagggaaaatgtatttcaaaagaaagtacttttataggaatgtctgtaaaagtttcataggg

SEQ ID NO: 113381 - DNA, 1046 bp, Homo sapiens
aaatttttttgaagaggtgcctaatctccattaatgatttggcttttcatgcagttgtatttgcagtttgtgtactaatatatttaggcgaatttggtgacattatattgtataatggttcctggttaatggcttatttgagctatatctagagcaatttagcactgatactgtataggaaaatgagagaacgggattaaattcgtggatgttttgcacggaagtttttaataggataatttatttgagcaaacatccagtctatttaatgaatctggaatgctgtggagctcagaagtccttaatatgtattcactgagagccccccttacctgcctagctcattcagatgaagtgaggtccctgttcttcaggcatcaaactctatttgatgaggaaatctaaaacacataatgagagaagtgacaaaaggctcgtggatactactagccagccagaagacagaagtgtgagccagaagagttgggaagtgttcgtgaagaaatagaatgcaaacagggctagaactggggagactgaagtagagagactgttcccatccatcacccagccacacccgtacccacacatgtacacgaacatgcatgcacgtacagcagtagcagcagcagaaaagcaagtacaaagatggttgacagtactaagggaaatgagaataatgtgaggacatagtaggaaataagctgggagaaatttggagatggagagttaagtttaaacagggggctatgtgaagactatatcagcttttgacaaaactgatataatgaaaactgctttggggtcattctgccagctgaactgaggctaaaagagaaggaagaccaccggcataaccagtcaggagacatgctcactctagatgtgatctagactagcatggcagaggatacggagcagagaatccagactgaaagcaagatctctaaccttggaccaccgaaactggagatcactgagagcaatatggaatttttaaaaagcttcttcattgctgtttatacaggtgccaagcctgtgtagct

SEQ ID NO: 113382 - DNA, 1025 bp, Homo sapiens
tgtgcatgtatgagaatgaccacgaaagtaccacaaatattgattttgagattaaagataaattttagcaagtagggtgaacttgtacttacagaatctgtgaataatgagcattgaacatactttgagtttcaactaataggtagcagtgagcaggtctgaaatgcaaaaccacctatcaacatggcaaagtaagtttactgtttggttttaaagggatgatatagcaggatatagtacattcatatataataaaccaaggcagtgttttttaaaatttgggagaactggttcaaaggatggaaaaagttcctgtgtcaacatttccaaattaaacatgaaatgtatatttttctctctgataagagaatgtgaacaaggtgttgtgggtttgataactgattgtgctaataatcattcagtgtcagctaattacaatgtgtaaacataaaatgtccatctaatagtaggttgcattagattcagttcatgagtcatgtaaacaagggttgtagcaaagcagggagatgaagagagtacagttgggataggaaaagggttctaaggtctttgcatgcttttcaaggaaactcatgtagccccaaatattgtccagttctaattatttgctaactaaaggagtttcttcagaaaacagaatttagtagttgtgatacaatgttgaaattcaggaaatgagaattataaattttgaaagcattctctcctgcatgtcatttttgcgtataaactcttttttttttttttttttttttgagacggagtcttgctctgttgcccaggctggagtgcaatggcgcaatctcgggtcactgcaacctccacctcctaggttcaagtgattttcctgcctcagcctcccaagtagctgggattacaggcacccgccactacgcccagctaatttttgtattttttagtagagatgcggtttcaccatgttggtcaggctgctctcgaacttctgacctcaggtgatccacctgcctcggcctcccaaagtg

SEQ ID NO: 113383 - DNA, 1091 bp, Homo sapiens
tgctcatctgtctcacaaacttgaatggagtgtacaaatgttaataagacaaagtgtctgctctttcaaagcttgaattccagtgtggcaaggcagataataggtaagtaaacttaaatttaacatttttcatagtgaaaagtgctataaagaaaatgaggaaatagctgatgtttagtaggaagaaagctctattaaccaaggaagctgcttgcttatggaagcagctttgaaagtgagatggaaaccatggacttattagtggcatcgtgaacatacagagctttgtggggtttctccagttgcattcactgacccaagtaaagtacaaagaatgtagagaattgtgttgatcaagatttggagtgttctcagttatgggcactcacaggaaagtcaagtcatggatttttgacccccttaaattgtggaccgtggagaggggagtgaaaccaaggatggaggaatctcgtggaggaagggaggaatgtaagtaagagactgaaattccagaggttgatgtatgggtgtcataagactgagagagtcagaagaacaggaagtttgtaatcatgaagatattttatttaaaggatttagaagtacggtccctctgaatgataaagtccaggatgtggcagtgggctgcagtggcagaagaattttagtggtgctgactacactggagctgaggaggttgcctgaccatcactgtgatctgtgatatcacccacagtaattgaagtacctgggatggagaagacatgaacccagttctaaagccttaactgaagaggggattgtcagaactgaagaatacaaactggtgtcattagatggcatgagattcaaaggaatggggtttttgtttttattaagggtggagaagtgattggaaaagtcactgtgagcaagtagcaagtgcttacttctcatcctaactctgaggaaatgagatatgggagaaggaacagcttccagggaacctgaaatgtggtttgagcatatcattctgtggtctgaagaggctgtgacttttctatgtggttagcaactggcagacactaagcttcaaaccaagtctccaaact

SEQ ID NO: 113384 - DNA, 1007 bp, Homo sapiens
accccaatggtgacgctgtgtgtggcagaccaggagcaagtggcagagttgctcacaaaacacactgcttggaagaaatggactttttcacaaaagcctttgcggtatccatgaagtgtgcactgccttatgctcatgacatatcttactgaagataagtcagtgtgctagtgagacacctactatgttctatttattcttcctattcttttcctatttacttttcacaggaatccatgtaggtgctacttctttattttttaaaatgagttttttataggttagtgtattattttagatattaagaaatactataaagaggttaaaatcatttgagaataacgatgcaatgattggtactagtaaatatgtactagattataactaactgtatttgtgtacttgattttcaaaagttttacagaatgtataaagaagttggatggaaacttatttgttattcaggtgttttcctacaaaacagtctacctagccaggggaaagaataatgccacttcattctgactaattctcttccttcaaatatggagattcatctaatccgctgttttatttatggttttgaaaccaaagtggcaactgtgtgtggctttgggtgttcttgttttagggtggcagaagttggcatggcatttccttagcctaagagttttaatttcatagtgtttcttaattcttaacactaggcaatatgtcagtaaattctctgaaatttaatcttataaaagttctaggatgattcatgctacccttccttcccccaaatcgtgactcattttcaaacttgtgtttgaaaagctttgtaagttagggtgaaatatttagagtttggcacttggatagttccctgaaaactcagttcgtttctgccagcagtgattgcgatgacagggttagattttatttctcaggtgtttctgttggtgtttcattttgcagatctgaaaagggggttaaaagggagtgctgaaacagaagaataagca

SEQ ID NO: 113385 - DNA, 1140 bp, Homo sapiens
ctactggggaggctgagatgagatgggaggataactttaaccatggaggcagaggttgcagtgagctgagattgcaccactgcactccagcctgggcgaaagagtgacagactgtctcaaaaaaaaaaaaaaaaaaagaaagaaatggagaccatggatacctgaaagaaaagaaaagaaagaaagaaagaaagaaatggagaccataagatacctgtgaaccaatctgaggacagaatccatttaaattttatcagaccccccacccctcaaatgtaagatatcttgacaacatttaattcagtagcagtttattttagtaattatggagcttttccaaataattttagttaatttctattgaaaaacttcatttttatattcatattttctcaatttatataattaaataatgttgtcaggcacaactggtgtaaacaggtttgggaggaaacagaactgactcttggtatatattaaactcagctggtggaagtgggtgtgtttgggtatcagaaagtagtctatgagtcctgggcatccagtgtccttcagccaggatgtttcacagagggaatagagagcattgtggagagagaatcagcaaggttttattgcatcatttgttttggcaattggctgtaaagatgcctggcatgaagggaggtattttggtttttggtttgtggagcttttttgcttaacattttgtgaagactaacttaaggtcatttggcagacgtgttatttcacacataaaagcttctattctcatgaggcaaggaagcaagaacacatttttctttgccaatgaatgtctcttgctctgttttggaattgtgtttaatacataaaatctgcactgattctggacttcattgaaagagattctgtaaggttgattggggatggaaatgaggtggtctagtaattttcaaagtgctactgaattacataacagtctttgtaaaaccaaaggaacccaaattttagagcaaataaaactttacattttaaatttgttcatgtttttaaatgaatgtctttttgcttttttgttcaaagagcattttgacaaagaacataattgaagtgtatgggagtgtgtatagaatatactgacttcttaaaaatggaggt

SEQ ID NO: 113386 - DNA, 1382 bp, Homo sapiens
tgttaaataacaaaacccagtgagaaaaacacacataatttgaaagcacttatgacataaaataactgattgattgattgattttttatttttttgaaatgggatctcactgttgcccaagctggagtgcagtggcacgatcttggctcactgcaacctccacctccccggttcaagagattttcctgcctcagcctcctgagtagctggaattacaggtgcccaccaccacacccagctaatttttgtatctttagtagagacggggtttcaccatgttggccaggctggtcttgaactcctgacctcaggtgatctgcccgcctcagcctcccacagtgctgggatgacaggcttgagccactgtgccgggcctgattttttaattccatattcagaatagagaagtgaaagcccagtaactgattcaaaacaataaatgacccatgtactgccctgagagaagcggaatgctgacttaaattttattttttggaagtgagtttagttaatggttaagatacaacccaaaatatgcattattgctgttcaaagaataatttttttaaaatcctacctcttttatttaaaaagaaaaaatactccttatcatgctggtgcttgaatatacaaaatggtgctttaagtggaataggcttgtggaacaaattcaaggccaatatcattcatttgtgagtacgaacagctgaataatgagcttggcaaatgctttaagatgttaaacaaaataccgttagaacaaaggaatgactcaatctgaccgtgagagaatcttccctcctctccagagttggaacatttaaagcagggctttgacaagtgagcaggacttccattagtgaaggagtaaatgagaattttattggtctaagcaaaggcatagaagtacatgaaagtccatggagtagtgggccaccattgaaggatctaccattgcagatcccaccattgctatgcatgcttgtttgcctttgagtatgggggtggggatggaattggtgacaggatgaatcttttaagggaggccagaaccagattgtgaggggccttccatgtggtgctgaaggcagtgagaagcctcaggagtgcttgatatgatctgatagccctgtcactggattggagtaatgctccaggcctgccagccttgatccctatttgtgcactgtcctctacttgacaaacttttttttttggaggtaggggacagggtcttgctctgtcatctaggccggagtgcagtggtacaataatgactcaatgcaaccttgacctcctgggcccaagcaacttacccaccgcagcagtagctgggaactacatgcatgtgccaccacatgcctggctaatttttaaataat

SEQ ID NO: 113387 - DNA, 1079 bp, Homo sapiens
cttttaaagattttgagcacaccaatttatgacaacacttgttttggtttacatgagtaatctctgattttgtagtgaataaatgggtttaaccatcctgagacaaattcattcataatctttagagaagattccctgagggcatgaacattccatatgcctgtaatgatggaatataccttcgggagaggaacttccttgtttaaaaacacttttaacaactgctgaggactatgggtgttgtgattaaattaaagtggtcattgagctgtggagtgtttaattctgtggtttcttctgatctttgtctgcctttgagtacaccagcactgtttctgttctatagatctggcagctgttagaaatgccatgcgtgtttgctaagaattgggtggtaattttatatacaataactgctgattgggttgcccagggttgagttttttttttgatttgtcttcccacatgaagttggttagattggaaaatttgctccaattgctaaagattgcttttaaatgtgcagcatattagccacagttgttgccataagcagctgcatgctgcatattagcttgaatacacaataaacattttatggttggaatagtgaatatcgctggaggagagaacctatttcaaagagaacataaattggcctataaaaaagtaagcagaaaccttaaaccttagattgttaggtttgtgagtcctctgcttagaactgatggaagggctaccttgttacatttacagtgttacctaggttcattttaattgtttcacctgatgctgtggtttgaatgtgtcccccaaaagttcatgtgttggaaacttaatccccagtgcaacagtgttgaaaggtagagcctaataagatctgattggataatgagggcagagccctcatgaatggactgtcattgttatgggagtaggtgagttatgagagtgagttgttataaagtgagtctggcgcctggtgcctctgtcttgtgtgttcacttccaccttcccccttcaactgtgggatgaccatctgtagacaccagtgccaagcccttggacttcccagcttc

SEQ ID NO: 113388 - DNA, 1023 bp, Homo sapiens
tgaagaaaacaaccatacgctgaacagaaccagcaattgtggtctccagattcaggagggaactaatttctgggtgtttgagccagtctttctcctgtggctggaggggaatgaaatgggtatttccatgggtcggagaattgggactcacgacagactaaggcagaacacgtgagaaatgcaagtgagggctgtccttcacccagatgaaggagcccctctttggtcccctgccagggcttgttgtcaaccggtggaggtggtggaggaaggacttggtgagtctttgtcccaggcctcacagttttgacggtttcatatttagtcttgaaaaatgatcatgtaatgaatgtatacagttgtaatttctgtgagcttaaataatgtgttgcacttactgtagaatatgtcttgattcctgtagctcattttggcgtgtcttcatgctttagtaaggtggaagtggccctgcctcttggcattggagaagccctctctcccctctctgtaccgtgctccttcctaactcttggcctattcttctgtccataatagagctcctgcactgaggtctacacgggctcccatttatctttgcctgtgctgtaagccagagtatctttaaatcgtgtaagttgcccgaggcaaccagctatggcagaagaagataggtggctggaatttattgcggaagtaacatttatttacgtttgggatcccactaatgttcgaatccttgcttctgtgctgtcatgcctccctcttgtctcatcacatctgttctctgcctaagccccatggttttccatagccatctccatgcctatccttgtagtaaaagctgtccttccgccatgaatctaatactatgagccctgagcctggagtccctgcctctgtgctattcatccactcacccatcactaaatattccctgagtgcctacggcacaggcgcaggcacagtgctgagtgctctgggtgtaagagcgagaaagatacggtctccaggtgctgggtgtct

SEQ ID NO: 113389 - DNA, 1094 bp, Homo sapiens
gtaccaaaacatcttcccggagaggggctgagaggccttaatgctgtggtaaggcagggtattcattcaggtgccaagatggattggaaaatatccaagaagtaaggaggctcttcttctcaggctaaataacagcctccttgttgggaagggaataatcagtcccagctggagaaaagagactgcattccctttgcttttccattcaaatctaatcttatgacatgagtttctgacatgagtagcattcttgcccagacttgtggccccagggaggggatggttatttaagacagctggctcctccagcaaagcatagagcttgatgataaatgcttacagacaacttcccttacttgctggtcccagtcccagtttaattgacacccctagagatttgcaaaaaagaaatagatgtttctttgaacggatatcatgtctctgaatgcaagaaaaagataagatgctacatgcatacagttcatcagtatttcccagcttaaggaattcttcagggagggattccttttatgcattccctgtgaaacaagtgtcctctgcctttaaaccctgtcttgtgttataatgtagaataaatctcatatgattttgtttttccttcctttgctttgtttttttaaaggaactctttctatgaatcagtgattttaagacatcttgcagggttttttttgttttctctagaagcttagatatagctccaacctgaataattttaggttttagttattttaaaatgcttttttttccgagttgatgctccttttggtcaagaagccctgtatggagtaacagctctgcataaatatttaggcccaaatgtcaagcatttgcttcacatttctttttcataattagagatgtagtctatgggcgaggaatgaattgattcaaacatcttttcctccatcgaagaactttggtcactaaaatggttataacacatacactaaattgaacattctgagaaaggcatttatttgaaagaatttggaagtattaagggtataaagaatttatctttgcagtttatgaaaagtaatgatattaatgatagaattatctttcaaaag

SEQ ID NO: 113390 - DNA, 1069 bp, Homo sapiens
gagtcttaagcctataaatttgtcataattttgactggacatttttaaacattaaaaacatacataaatatcttcatatattgattttatgggtttgtttatagtaattaagaataagcctgttaatatcatttcctctgaaggaaagaattgtgaaaaaccatgattttacagttggtgaatctagaacatgggaaagttgtatcaataacaatggcctcaagcatcagactttataaaagaccaagtttttcagacattccactattcgccctttcccctttcagcacccccccccccactttctgtagggcaggtcgttttacccttttgaacgcacatttagagctgctgaataaccactctccttactgtcttctactctgtgtatactgcatgtgtacagtaaagcggggtggccactactccagtgcctattctacagccaaatccccaggtgagccatgactattgtggctttgttgctctgctgggtttttgtttttgttttttgccacttttctgtttccttttgctccatttccatgaatgtatctggcttattccagtgcacatctgtgtggtatgaaatgctttgcattgcacaagacactttagcctcctctatttattagagaactggttatcatcagaagattaccaagtgcctgtctgtatagtcaggaatacaaagcgactgaggaggcacatcaccgcaaggggtccatcttctagttaatttggagcaatgttctgctactgaaaaaggctgaagtttgttggtaatgtgaaaatagccatagaagcaattttgatcttctgtgctcaccccctccccaccctggggttaacagtttagtaatcactgaaatcttagaattattagtacttcataatagcatatgccagcataggattatgaggtgtttcttatacatacagggaagcaacactgcaatatttctagttgtcaaatatttattttcctagagttatagactcaacctgttctctctaaaaatgtgacaattaacaatgagcatttttatctgaaaatatctctgttatt

SEQ ID NO: 113391 - DNA, 1073 bp, Homo sapiens
tacttagaaactgattaaggaaaatcgtagcattctagtacacacaattttaaattaagtccacatttggatttgagttaatagagtaagcctcaaactcatcaagtaaaagttgtaagattttaaaaccacattttagagagaaaatgatcttttttataagagattaattcaaagtgtgttcgacactttagctatagaaaacccaaagcctgagtcaaccactgggatttgagtgaatctcaagaaagctactatatttatctgtatagtgcttatctgtatagtgctatatagcgtgttctttccactttctaccaccaggaagaagaggattttgtattattaaaagccatggtacccaggagtgcttttacagattactttagctatggtgtatttgttgccattttaaaaattccatgggactaattggaactcaaactgagctggtaactttatgaacataatattgtaccttttcaatcttggggcagaagtcctaaatgaagtcttgagactgccttgagtgaagtcttctggttgactaaatccttcaacaaaactctgtcagaatagctaaatagtatgtaaaaagcacatagatattaagctaggtaacataaatgggtaaatggttactcttgcccaggctggagtgcagtggtgtgatctcagctcactgaacctccgcctcaggagttcaagcgattctcctgcctcagcctcccgagtagctgggactacaggcgtgcgccaccacgcctggctaatttttgtatttttagtggagacgaggtttcgccatgttggccaggctggtctctaattcctgatatcaagtgatccacccgcctcagcctcccaaagtgctgggattacagacatgagccaccatgcccggccattattttatgattttagcttgtgaatctttcttagtctgccaaggtagaaagtattcaaagaaaacaaaaaagcccccaagtttctttctttccttagagttgaggggagggggataaaatttcaggagagaaaatccaggggtgtagcagaagagtggaagcatg

SEQ ID NO: 113392 - DNA, 1055 bp, Homo sapiens
tagcagggtttctggtggtaccagcagactccacacaggtaaatctattacaacatttagggccaggtgcggtggctcatgcctgtgatcccagcactttgggaggccaaggtgggtggatcacgagttcaggggttcaagaccagcctggccaacaatggtgaaaccccatctctactaaaaatacaaaaattagccaggcgtggtggcaggtgcctgtaatcccagctactcgggaggctgaagcaggagaatcccttgaaccctggaggcagaggttgcaatgagccgagatcctgccacttcattccagcctgggctacagggcaagactctgacttaaaattaaaaatggaaaaaaagcacatgaagtccaagtgcctgggtttgatcttggcatggccactcttaagctgttttaccttggataagtcacatcacccctatctgtggaaaaagggattaataggacctaccgcacaggattgagattgattaaatatggagaaagcagttagggtagccttgttattctttcttaccgtaaaccttggcatttccaggttccattttcacgtgaaggcagttttacttgcaaaaaactaacatgcagtagcgtacaagggggaaagagaaggtgagagaagtcagactccagattttattacctcctctgcttttctatcaccaacttttcctctcaactctcccttcacctctgctttcctgccctcttcacatactccaaccctatcaataatctataaatgactctactaggaacagattatcccacctgggaggctgaggcaggagaattgcttgaatctgggaggcggaggttgcattgagctgagatcgcaccactgcactccagcttgggcaacagagcgagcctctgtctccaggaaaaaaagaaaaaaggttattctggcaaggcacagtcgctcacgcctttaatcctagcactttgggaggccgaggtgggtggatcacctgaggtcaggagtttgagaccagcctggccaaaatggtgaaaccctatctctactaaa

SEQ ID NO: 113393 - DNA, 1071 bp, Homo sapiens
caagacgcgtcccagggctgtagccgcctgaaggcttgactgggaatggaggatccccctctgtagtcactcattcacttgctggcaagctggtgctggctgttggcagaaggcctcggttactcgccatgtggacctctctgtaagttggcttgagtttcctcagaacacagcaggtggctttccccagaaccaagtgataagagagagagagagagagagagtgccatacagaagctgtccattctgtgacctagccttggaagccagaccccatctcttccataatatcttggtggtcacacaccagcccaactcagcatggggagagacatcacaagggcatgagaaacgggagctggggctcatgagggctattgtggagtctggcagtcacaccagccttctctccattttcatctctttatcagccactcaaaatttctgccctgggctggtctggcttcctcatcctgtcctttccaaccttcctgtccatcctcttttttgagggctgccagagtctcaccccatcaattttattgctttgttctccttccagtccttttgttcgtcagactgctgactccctactcattctttttccttctcttcaaatcctagaatcccacccctgtggacctcgtttgcttcttttaatgctcgtcttcctgattctccatttttctgcttgaccccaacctatgatcttctgttccctctgtgcaagttcctcagagtctcttcaatctagctgataacttttcccataggaatatttgctatgcttaaatcacagcattttctttgggacagataggcaataaagagtagtaaatgtgtcatcagctaccagatggatgaagaaagcatttccctgaactttaattcatcattcatgttccagtttaagacttttaaggcaatagtaacttcaggcttcagagtcacagcacatctgtggacactgagggataaaatgtttcgtgttttgatgctgaagtgtatgcctggaggctctctgctgtgagcattcttgccggttgaaagaaggaagaaaaaagtacattt

SEQ ID NO: 113394 - DNA, 1025 bp, Homo sapiens
aaaattaaattttgaaaaattgcagttgtccatcagttgtcatttatcatgaggaaataaaatgattaaactcctaggagtcacatggttagcctggaaccattagaattatctatagttctaagccttattgtgccactaataactatcttatccagctatcatgccatagagtcttttgattccttttatggaagtaaaaaataacataatttcaaaaaaaggtaactgatgatttttcttatgtctaatctgaatgaaatatctaaggaagaaatgcactgatgtgatgtgcataaggagagaggtgagatgagaagaaagggaacgcctcctcggtttctgtgacacatttttacattctgtaagcattttgtgtgtcaacggattagttagctagggatttgtaaattatcctgataaataatggtcattctcctctttcagcagatttctgctcatggcagatcttcttccaatgtaaacggtggacctgagcttgaccgttgcataagtcctgaaggtagttctcagtctgatcattactttgataaaggaaatcatgcatggggacttggtgctcacctaaaactcacttgtgctaaattacgatcttcctaaagagggatgtgatcacatcacctgtcagcccctttggccttagtaagaggcggggatgggggttacttcaagataaagaaaaatctcattgtcattaactaggttattgaagcttcagattttagacttgggcttcttttatttttgtggtgatctgatcacaacttctaaatatatttcctttctctcaattagataacaaaactgtgttttcttgatttggtgtcttctgtgtgctggacactgggacatgtagtgagaagtgggcagatcttaacccttcccccacatacctttttgagaaagctttgagccaggaattagccttaacaaggcatctatcttatctgggtagaattttctctactagaaaatgttgaagagaaatcttggacattttgaag

SEQ ID NO: 113395 - DNA, 1024 bp, Homo sapiens
taacagaattgaaatactttaaatatgagtttcttaatattatagttaatatttatgaaagaatatttaattaacatacagtatggctttgtttttgtttttaattttttgggtacctttgtcccctgactccactagatattttctttaatgcacagagaaagagccaagtttttccttcctgggtctgtgctgtagaatacaacaggaatgggccaggtgtggtggctcacgcctgtaatcccaacactttgggaggctgagacaggaggatcagttgagcccaggagttcaagaccaacctgggcaacataatgagatctcatctctacaaaaaaaaaaaaaattaaagtataaaaaagaaagaaaacaggaatgatggtatttaatttatgtctttaaatggtcttcctctgattattccataggtccactggaaaggagtttgccctaaagattatagacaaagccaaatgttgtggaaaggtatagtatgcataacccctagttctgaaagaaactagagtaacttggtgaggtgtttactgtgatgaaggaatttaagtggggacttgacacaactatcacagcaggagtagagaccagtaatagtgggaaaaacagttaagcggttttattcctgctatttttcagaaactttaatcctaaaacagtaaattgatttgatcttggtcctaactagaaaacgtagattcttttctctgggagatacctattttaacacccaacaatactcaaaaggtgcgtcaagaactctgagggacctgggactttacttgcaagctaacaaagccttccagcttcatacaggccagcagaacacaagatttctgagtcagagacaaaaggatttgttattcctgacacagcaggtagcatgagcttcatgcttgcattggttccccttaactcccaagtcccatagtggtgaggctgaggagcccagctggatgatttacacacagtgggtttatgtcatagctggggaactctgagcttagga

SEQ ID NO: 113396 - DNA, 1033 bp, Homo sapiens
tcctttaaaatgtggttattatcgacacctagaacataagattattgtgaaaattggttgaattaagccatggaaaacagagaagtgctagtatataataagaattcaacacatgttaactgctaacattattaatatgccagaggagtttagaatttataattagcaggatttgatctgatagttgtcattttatagttatggaacccctaaactggtcttcattggacttctacaaaatagtgtatttttaacaggaaatgtaaaatattctgctcgaatggtttagaaaaatcttctcagaactccagaatggaaaatccaggaggcaaatttgtcatttacttttttttttttttttaaccacactgtgataattactgaagcatagactgcatagactgtgcaaaatgccccttttcctttgaataaggttttcttttgcttaattttctttaaataatttgatatgcttttacttattgttctagcgatattactaatgtttttcactgtaatagccttttctccatacatgtaagggttctgctttcgatgtggtggtgtgtgatttaagcagaacgtatcataatttggtgagccaggttctgtagaactacattaaaaattttttcaaaacagtaaaaaaaaaataaaaaggtgctatggtaaggatatggtttacgtgattaaaatttaaacagctgtttccatggttggaaaaaaaaggtctttgtatgcaaaaaatttacactaagggctgaggcaaatggataagtcagttctaacatttgaatcttattttttctagtctgtgaatgtcattctatttttataatgcatgatcaaatatttttccacttttacattttgcttatctaaacaactatttccacattaagactatacaaaattataattttaaaacttgattagttacaaataagttgatttttcccattacattttatttttagaaaaaaattatatagagaatttttgttaatttgagggggtggtattcagtcactgt

SEQ ID NO: 113397 - DNA, 1023 bp, Homo sapiens
ccaaggaggtaaatgggcagacattggtgattgtgggtatattatccacccgaaaggaggaatcggtgcaattcctgtttctgcttgggacagccaggtttgttgaataagatggagaacacagaggaaaggactgctttatgggctgggatgggttgagacaagatgattagtctggtttgagagagttgttttgtctcctattatacccccccattcctctctctttgtacgttaaaaatcaccatgtccaaagataaggcagtgtcctttgccaagttagcagttttgtcatttactctcactcagaactgtggaacactgccatgaaatgattcatatgtaaattatttggagttagaatcatgaatcacttaacatatataatggtagataattgaataatgtaagttcagtatggctcaagacaaaagagatattcatattatatttagaaatattctcttggaaaatttagtctagagagcattttttacatattagaaacaaagactacatacaggttgcacaagaaatagataacgtttgtaacgatttttatgcagtactttattttgcttctgatgatgattagtttcaaaagtggattgttccttcatagacaattttacagggacagcaagaggttgagaaaggctaacagctcccatgttttaacaaaaacattcactctgtgcttagaatattagccattgtcaagtagaattcagtaggctaataagtggtggaggaaatgttgctgcagtatttgaaaggtaacactgctgatggcccttaggagaagttccacaatgtatcccagaagaccttctgttgtgccttttattgaaaaagataataacttttgggagttgtagtctccttatgtggtagatatcttatttacttcaatttgagagagattcttggggtactggtgaggggattatcttacagatatcactaaattagcaacacaaacacagcccccagggagaggcgaatatatagactcttctaact

SEQ ID NO: 113398 - DNA, 1055 bp, Homo sapiens
agcaggaaggagaattgaagtgatagattcatttagctttaaaataaaaaacctatttaatgacagtagcaactgttgtctttgcttcacacggagggaaataaattgatgtgcttgcttatacatgttcacaaaagtgtatctaaccctgctttttagtgtgattgaggatatgcttggtgcagatgatccaaaagcttcaaaatatgtgaatcaatggagagggtttgccaagtcttttgtctttgcaaccatgaggggctggctgtacagctgcttcccaagggaggaaacggggctctgtctgctgctctgtaacttagacagatgggcttggagacagataggagaccctgttcttgacttcccagctgtggtttactggggtctaagaaacaccattcttcagattttgaagcgtttgttgagtcctgagccagtcaaagacttcctagccctgttcattaaaagaagcatagattctcctccttgcacaaaccctggtgtgattcttaacccccaaatcagtgtggtgctactgcatgctcttatctttttaaggaattaaatattttcagcttacagctataatttttattttgaagaattccaacttggcatttactgaattcttcccctttggaaggtgataatgtgtgtataagaaagatgggcttggatgtcagaaacctagtttacattcaacctccagtgactgtttccaaggataaagtgttcaaacattacacaagtaccttacacagctactaacaaacagtgactagattcctagtaaatgttggtttctttctttcccatacttctgtttagcaaatttgcactgtcactcgctaagatttattgagtgactgcttggacaagcacagtgcattcagtgctcaagaaacacaacctaccatgtgcaggagcttgaaacagatttttctccacatgttatttattcatttgttataatttctatttccagctattgtccaaaagggtgaggtggctcttagcttcatgcatccatgtgtaaaaatacatgtacacat

SEQ ID NO: 113399 - DNA, 1090 bp, Homo sapiens
catgttctgttttcttctgagttttcttgacctcttttcactttaatctcttccctttgttcattttgtaactgtctaatgagtagctactgtgtgccaggcatgattttaagtgctaggaataaagtggtgaacaaaacctgaggttgtggtttcccttagtttatttgactagccataacaaaatatcatatacagtgtggcttataaacaccagaaaattcatccttccagttctggaggttgagaattccaagatcaaggtactgcagatttggtgactgttgagggctcacttcttggttcatagacagccatctcctcactctaaccacatacagtggaaagggcaagggaatctctggggtcttttgtaagggccctaatcttattcatgagagctccacccttaacaatagcatggctgcccaaaggtcccatctcctactaccatcacattgggcattaggttgcagcatgtgaattttggggagacatgaacatttagcctatggcatggtgtttatagtgttgtactgggtcactatgtgaaaaatggttttatcttcttttccatccaacattttattgtgaaaactttcaaacatacagaaaagttgaaaggattatctttttaaaattctcggttttcccattgcgttgaacaattttctaattggcattgcagtaaacataagactgacagatgttagtctctacttttgaaagccttatgctatagataaagacacacctcacaagactattgatcaaagagaataagcagagcatgagggagtgcttagttcagggctggaaatcacaaggatgtagcattcatgaaagatgtagcatttgagtgagacctttgtggtattagtggagtttttgtaggtggaaagatatttccatctggccgtcaacatcgtggtcttccaccaaagtcattaactaggtgggttacacagactgtagaattactgtacatttcagttagcttttgctgagtaacacactacccctgaagttaggagtgtgaaacaattgcatggatcagttgagtgaatcttctgagctggctggctcagca

SEQ ID NO: 113400 - DNA, 1032 bp, Homo sapiens
ttcaagtttttcttaatggacatttttagacttacggcaccttggtccaaaggctatattgttttagaatttaaaaatgccatgaaggatctcagccagattgtggagtatcaatgcgataccggatccagtgtggatttaatcagaacagcttttcttacatgactgctaagaaagataaattagctttctatttttctagtgcggggcaggccccaactgtcaaagctcttgcaacttacagtggatacttcagggtcccattctcattgctgagacaccctgtggttttgtttgttgactcagggtattttgccaagaaccagctgctataaatgactgctgtgcacacacttccagctttttagctatttattaacaaaataaaagctgtatacattaacaaaatataagatatttgagattccagaaaaaataagggggagttgagtggaataataggtaaggatgactaaaaagaatgattgtggaaatagctcattttaaatatctttttctaacatcatatgttggagccctctggttctctgaagttttccactaaatctaataatcttagatgtattctgtactcactttgaaggagcagtaagctgagttcactcagcagggaaataacagtgaaaaggaaagaaaacattttgacactaagaaacgcgtgtgcattcacaggaaatcactctttgggacagtagtggtaatctctttctcttgcctggcccagttatctgtcctgactttcactcctcagtgtgcctcttcaccaaactctgtggaccagtgggtgtccattcagctgggcttgcttttttttgttgtttttattttatttaagttctagggtacatgtgcccaacgtgcaggtttgttacatatgtatacatgcgtcatgctggtgtgctgcactcattaactcatcatttacattaggtatatctcctaatgctatccctcccccttcccctaccccatgacaggccccggtgtgtgatgttccccttcctgtgtcca

SEQ ID NO: 113401 - DNA, 1132 bp, Homo sapiens
aacacaccccacataacccccacataccccacacccacaccccccacaccccccacacccccaccccccacatacacacccacacaccccacacccccacatagcccacacagcctacacaccccacacccgaacacaccccacatacctccacacaccccacaccccccgcccccacgagcgtgcagcactctgttatatgcattgagcatacaccaggtacccccacacacccccaacacccccacacaccccacacccgaacacaccccacattccccacacaccccacacaccccacgagcatgcagcactctgttatatggattgagcgtccaccaggttctcagcacccactgggccgtcattctcttctgtcccccggctgcgtttatgtggccaccctctgtgtgtccttgcaactccccagctgctcccctgccagaaagtgtgctctccctctctccctctctccctctccagacagagcctgggtttgcaagctgagtcttttgatggcttgcaggactttgggggcgctctgtgccaaagcagtgagaaggccttttgagttgtggtttcccttgaattttagcagtgttttgctgaaagcctgagaaagtcagagttgtcaaagaattacagcttagacactttgaaaagaaccatcttgattgagccaacagcatgagaatgtttccagcgattcccttgcgagagctagcattgatggatgggctcagtggtacacagtcttgctgtgcactgcgttgtaaggcagcttcttggaaaatttagaaaaataaaacattaaaaattggcatactcaacgtgtcatgaaaaaaccttaagaagagagattggttaggatcaaaatttaataaccatgttaagtcttctgagaggaagaacctttaaccgccctgtgcccagggcttaggagagtttgctcggagactgtgaagggagtcattgctggggtcactttttgactcaggggcccagataggaatcagtggccataggcctgtgcccggcctctttatggctggctctcagctgacattctggaatgattagctgttctacaggctctgtcctagataatgacgcttagaccccctcagacaga

SEQ ID NO: 113402 - DNA, 2281 bp, Homo sapiens
ctctgacagggtgtttgtgtgaacaaacaacccgttattgtttgcagctctgatggtgattgtaaatgttgtatgtttatgtgtgttcagttgtcattttgcgcatgttggcagggtgtcccctctaaccccatgttacctacacaactctgcaggctgttagctcagaggaactgctgatgtcatgatcccattcagtacctacagggaaattcaatcagtcttgcctctggtggcacccattctcgatggccaaaacaccagcctgtgacttttgggctgtcccaaaaagtgggaggggaaggcctgctgctgatcctcccctggcgcaggacctggtctggggcatggttgtgtgggggaacttgcgatgctgctgtattgtcctcctcgtcctcctcatcctcctcgtcctcctcatcctcctcatcctcctcatcctcctcacgtcactgtgtgtcctgtcttcggaacagttttaagtgtttttacattaaaaataacctcaaaatgactctccctggtactcataggtcctcataactgagactgtggggccaacctggttttctgcagatacaaatgatagtggaaatagtgtcaaccgtctggaggttgaatcatcagataacttacagacaggaccttcccatctgctgtcaccctagtgttctcatccccagagctggggcctgagacttcagtgagaaaatgatgggctagaaattggtccataaaggtgaaaaaaaagtaaagttgatggtgttatctgcattttgtttgacagtttgatttgacagtttgagaggcacctcagagtttccttctttaccccgctgagacagtgggagagcctgaagcagaatcctggtattcaccacgctgcgtccgaccagcgcgccccatcctcagcccctctcacgcctgcatgcttgtctcagtttctgatgccgccgtccggctctcagctgcttactggtgtgggtcttttgtacctactcacatcctttccagccagccaagcaggcccctggaaaactttattttcaaacttctcagcttaccacactgcctgcctttccagaccaacagctggtgagagcacgggaggagtcccatagttctcctaccgatgctgtttcccacttaggtgaaaagtggcttttcggaaagagcagcttaagatggtgccttcgtgaaggcttttgttctttctccagctgcatttccaaagatgagtttgtatcagtaagtgtaatctcagccagcctttgggataagagaagataatttaatgggtgaggccttggtttcaggcagggctgaggtgtgggattacagttcccattttcttggacttgtccttagcatgcgtaagaaaggacagagcagggtgcatgcaggacggcctcccatgtaccccggggggctcgccccagttgcagagaccaggagagaccatcttgtggtgggaagggaatgccgagaagccgccgtcactcggcgcctgcggtgcagacttgagaagggacggattcaagggcattgccttcttcgctgggggattatgccttgtttcagggggaagttggggaaggatttgggtttattgccttaatttaagatagacaaaactgtttcactcgtgttgcttctgttgaaagtaagtctagtttctgtccctgcttctctcctgccttctgcctctcccgccgcctgcattgcttccctctggctaggtccaaggccatggtatgtactaaccgcactgccagcctgccttctgccacacacgcccctgtgcttctgacaggaagagaaaaggagaaataacggggggattgttttcttgtacccaggagacattttgtggtaggaaaaacctgtatgctggctctctgcttcccatgtaggtgggagcatcttttagtggagttttccacagttaccctttctccaggtagttgaaattgtccttggaaattgtagggatttggggagttttgtttattgagacaggatcttgctctgttgcccagactggagtgcggtggtgtgatcctagctcactgtatcctcaaactcctgagctcaagccatcctcctgcctcagcctccaagtagctaggactacaggtgcacgccaccttgcccggctaatttttaaattctttgtggagatggagtctctgtgttgcccaggctggtctcaaactcctgacctcaagtgatcctccctccttggcctccggaagtgctgggattacaggtgtgagccact

SEQ ID NO: 113403 - DNA, 1001 bp, Homo sapiens
tggagattctgccctgtggtgtcttggattcccagcctgtggcttccttcctcgcctcccgaggtagtgagctgtgaaagtatcagtctctggagctgtgggcaggtattgctcattttaggcaagctcgctttaatcacacagttgccacttgcaagttagcatgataaagtgcaggagtgctgggaaaaaggcaatggattgtttaagcctaaaatccagtgggaaatattaaagagggaaaaagcaatggctacagggcagagaggagaagcatgtgtgtatgaatggtctgcagaaagcctcccactgctgcctcaaggaacttcccagagcccctggtactaactgaaatgccacagaaattgcttcagtcagccagggatctcaaattattttacagatttattagcgtagctgacaatataatcgcaactcaaagtgacagattatccacattattattgtaaagaaaagaggaaaagaaaatcctctgatgtgtacttggtttaaatgcagcattatgggaaggtagggaaaaataaaagcgagtacgagtgtgtctctgtgcgtgcctcgtggaggccggcagaatgtgatggagagaccgcagagaacagtggagacaagaaggaagccgtccactgaatcaagaaatgaatcccaggagacagagcagcaagggtccttcatttcctcaatgtaacctatatgtaggagctttgttccctgagaccagtatttacttaggagaagggggtgatcagactagatctgggaaagtgggagaatttatgacatctaagctgcataggtcagaatagcaatgagtgaaatatccagagctagcccaacgccagggtagaagcccctgtgaccctactcctgcccccaacatgtcctgggtcccctcattgtatacagctcacatgccccgccctccagcctgattctggaaaatgaggaccaccccagctttattttactttaaccttcaccaa

SEQ ID NO: 113404 - DNA, 1035 bp, Homo sapiens
tttctgtttggaaagcctagaaacaaaatcttggaaccatataactcattctcactgcagtgttctcagaaatctgcccctcccaactacttgtcagcccacatagttaatacccagggagaaataatcagctcaaacaagatgattctggccatatgttacttttcaaagatgccaaaactatcaataatctctcattgaagtctctaaaccaaacgaagaacaagaaaaaaaaatcttctgaaaaatatcaagttaattcttctgataaaaatttgcaatagttaagggatacaaaaagtctttacctttgctttctgagatagtaggatctcccaaaggctagaccataaagcagaacagattcccttaagaaccttttaaagtcttactgcttgaaaaattgtcatggccttcaataatgctgagagaaaaatttatcttgctgctagtttaagggactacatttcaaactcttcttaaagaaaaataaaaagagaaagaggacagacttctaggactgctttgaaaagcttgagcaattacttcaaaggaaagggtgtctttgtccagagagcacgtttatgactactgatgcaaatcctaaccaaaggctgaaaaggatacccagtgcatctttatggatggccttaaaggaagatgaacaagtcaaatgagattaaagacagcccaaattctgctgcaaataccagggcacatcaggttttacagaggcacttctctcagtacgtaatactagatatcaataccaacttacagagacaactataacaacctaacttgcatttaagcaacacaagatctctatactaaccacttagcatttatattggacttatgttttatttatttattttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccac

SEQ ID NO: 113405 - DNA, 1032 bp, Homo sapiens
ttaaaaaaaatttagaatgccttaaagttagaattcatttttaattatagcaggaatgtctcattagggtgatactagtaaaattaacaacagtaggatttacggtaatgacttaagtgattgatgagcgtataacaaaatgaagttttagacagagaaaaagcagggcagctatggcatacagtactttaaaaaacagctctgtggtctgttagtgctagccttatggttaataaaaccttctttctaattaacggtgctgaaatattcttaaagaacagaatcttgttgttatgaagaaaagttaggtttttttctcagtagacgccaatcccataaaggagaaagctgacatagattagcatgtctgattgcaatgaggaaaagaaaaaaaatgccacctttcaatcaaatcaaaaccagaatgcgagaatggaaaatgtattactgaaatactacacacacaaatctgtgcaacaccctcacagttagcaaccatttgcttctgaagctgatcgaatgtggctttaaaagatattattcagatatctaaaaatacctaataaacatttaattttttaaatccatgtttatgaatataaaagtgaataaataataactgttttgtatatattcatcttgcttatctaaataagatcatgtcaaagtttaaagtatttatttatcaatggaatgcactggggaacattttctccaaaatttaaaaatgtacagtctggagagcattattctgaaggtgaaataactatctcaggaaaagcactttggtgacaaggctcagtcctaaaacacagagtactaggacaaggagagagagatgccatgctttcatgtacaaaacatctctcagtgaaatattcttggttaatttcattttttaaatccctaattaaatggaatcctatattcatttttcttctcattgaaaaaactgcattccacaggagataattattacaaaacaatagagtcaaagatgaaaaactatctggtatacaggaaaataagcct

SEQ ID NO: 113406 - DNA, 1157 bp, Homo sapiens
atgactgtctgccccacaagactgtaaaggctatgagggcagggaccatgtctatttgttcaccactgtatacaggtaagaaggcctaatgcttggcacttaataggtgctaagtatttgttgaatgaaaactaattgtgataactttttggaaaacaatcaaaacactaaaaattttgaaaaggaaccaccatgactgaatgtatgtttccttacactgacattggagaaacagagcagtgacttcaactcatgagaattaccatgtgactcttgtaaaactctgcccctatatttaatccatcccacctttacagctacattttttccctttgtcctcacatgagttggaaattaagttaccaagtgaatagctgttctttgcaagcctcctactgcactaagaacacctgggtttcctctatgtcgtctacctcaagtacctggttagttatttcactcctcctcactcctacaacccactgattgttgggtttcaaatctgaaataagcctgcccatacataatctatttaaatcacacctatattttatgtgctctcagcatttaggcataggctaaagcagaagtcatatatatactctatgatcacatcactatatgatgtattcatgatgtatgatgtatatatgatgtatttctttcagtagttaaaatacatggatttaacctttgattttctagttattaataagactgctttcagctacctaacttttgtcttatcctatgtaaggcctgcgtgtaatctgatccccgccagtttaccactgaacctccacattctgtttgtcatgtaaattggaaatgaagtaaaaattattatatatttcacatttaatttgctcaattttttttagttcttgaaggtcttggattcttttttattctttattgatataagcttattttttaatgaaatgttttggtgtcaacttaaaaggctgaagaaattcaaaagtgaacatcttgaacatttagcagctagagacacttgctttgaagtctgctctcccttaatcacaggagaaaaaaagtactatattagttttgcaacttgagattgaagtgaatctgattttaaatttattagaagtaggctatatgcaagactgccactcatgaatgaaaacatg

SEQ ID NO: 113407 - DNA, 1021 bp, Homo sapiens
cagttcagagcggcactaatctaaaataaatgtttaataagctagccataaaagcacctggatttttgttctttaaatttcacaaaactgcatgaaagatttagagattggaaacaattctacataaggtttgacttatgcatttttatgtagtttagtatataaaaaataatgccttttttctttatcttttgtgaattccagctcatcaaggtgctgtacaagaccagccataccagctgccagtggaaatcgatcctctcataggtctgtcacttccttctctctttgcgattcattaagctctgtatggtggccctgaagtgtagattacagttgtttttcacttgctggttgctgggaatggaattttcctgataaaccatttgcatgcaaattggaatgcaatgagctgtggctatgctggtatttcatcaactccccctcgttggtttgcctaatttgaacaggcctaggacgcgtgtcactgaaaattaatatggatgctgtaataatgtgtgattgagaatgcgcatgaagtactgtcaggataatattggatcttttcatcactcagacttgttgatgagcaggagcaaggcacgttatgatgaattggtgcaccggtaatgtgatggagctcctttgctaggaaaattttcataataacagtggggttcttagcagcactgcgttatgaaaaataaaactgtagtgccagggtttcatcattaaaggagatcaatcctttcttcctagaccttctgttcagtctgaggggattaatgtgcaattgcagagcagtttcaaagttgaaatatattgcccagccaatggtagtgttaagatatttgtattcattttcctagggtcctacagcccaataaattgccattggaggttaaatttgttcaggggagaaaaaaatagggaggcgaccagaaagagccattgggatgaaatgagcatctgcagcagatgacttagaatatttaattgctgttaggctttttgagtagat

SEQ ID NO: 113408 - DNA, 1040 bp, Homo sapiens
ttcctccaagaagcactcagaatgcatcaggtaactggaaacaaatacatatcatgatggaatggagtacataaaaaataaagagaaagagcagcttgttaaataaagtaaaacatattttaaaataataatgcaaagaaaagggggagaaggaaaattagggagggaaaggagtatttatactagcatatctactcaaataatattattatggaagttactaatgtaaaatatgatgtaattataatttgtgaaaatgcacacagatttttccattagtgcctgtaacggagcccgtacttttcaggcacattaaactgagtcccaacccagcctcactacaatctccagttcttgtagctgtccatctactacagcataatcccagctgccaatctgaaagaaaccagctagtcagagcagacacaaccaacagaaacaaacgtcactcaataatgttcagcggcactgtgttcatggataatttcaaacagtatctctgtctagaacattgatgtgctcattcaaaacacctccatctctggctactggaaatgagtagataaagcagcctgcctagaaaaataagtggaatgtcttcaaagaggttgccaatgctaagaagcaaatgttgagaaaacacagtaaaggtcttaaaggaaaaaaactcaacaatatccagagagttaattttcacattaagaaggttaaattatttctcaaaaccaaacaaatatgtttaaactatgtcatgaaaagcagcagtcattggttattcatttgctaagagtgacctagatgaagtaaagatggtgcctgaaaggaaacaggggttcatgacaaaagtcatcagtataatagaacggctcagaattctgtaggtagttaataggaaaaaaaatcataaaaatattaatattttgcttcatgtccttgagtgtataatttagttacacctaacttaactagtaagtctgcaaaagacataataatgagcaaaatacaaagagtagctttactgacaactttgatgctcattt

SEQ ID NO: 113409 - DNA, 1017 bp, Homo sapiens
tacctccctgatctcatgtcgtctgttctcttcctcatcgatgtgtcctgtcacactgacatttctgttcctgattacatgaaggggaaggcctttgtaagtctaatatcaaagctaaaaatccttaaggaaattaatatattcacgtataaacactacatgaaaaggatgtttctgtacatctaaagcaacaacaaataacaaagtacaggaatagaaaactcatgaaagatgaaatgcaagtcacatatgaaaagcactttaagctgggcacagtggttcacacctgtaattccaatgctttgggaggccaaggtgggaggatcgcttaggcccaggagtttgagaccagcctgggcaaagagcaggacccagtaagagaagtagttcatcctcactattaatcaatgacattaaattgaacacacaataacatttgtgtccactagattatctaagattaaaaataataaaaattttaatgttggtgcagtatgagaaaacagatactgtcatatatttggtgaggatgaaaataggttgaatctttatagcaatctgtatcaattattaaaatgttcatgtactatttacttagaactctaaccaaaagtaataattgaccaagtgtgaaaaaaatattcagttatatagttcatatgtattagtctgttctcatgctgctatgaggacatacccgagactgggtaattctaaaggaaagaggtttaattgactcagttccacatggctagggaggcctcagggaacttacagccatggtgaaaggggaagcaaacatatccttctttgcaaggcggcaggagagagaagaatgagagctgagcgaaggaggatgcccgttataaaaccatcagatctcgtgagaacttaccatcacaagaatagtatgggggaaaccaccaccatgattcagttacctccgacggggtccttctcacgatgtggggattgtgggaactacaattcaagatgagatttgggtagggacgcagc

SEQ ID NO: 113410 - DNA, 1112 bp, Homo sapiens
ttcatttttttgtaactaaaaatgtagatctaaatgagaattttctatatatgaagaatttttttaaaaaatcttaatatataaaaaagctattttaatataggttttatgatttatgtttttaaatcttaaaaatgggagttataaaaggcaacctcagggtattccattttgaattacattctgtttgtattttttcccttaatttcttcctgcctgtccttctctctcccctcaagtcttaagtgcattacctacttttggttaggcagttgtcattcactgatagcaaaaggatgttaaagttcggagctgactttgtactgaaatgactttgaaacttcttggaattctcttatacttaccactttgttcttttaggtccctttttaaagctttggtatattgcaagacatgcttgaagctgactaatggaatttttagttgagtgtttgagaaattatttaaagtatattcatgaaggtaacgtgtttatcaacttctggaagtgattttgccaatagttccgcgaattactggtcaactccttaaggactgacctatgacaatgtaaggtgaggtctgaaccatggcattgtggtgatctctgcatgtgtgtttgcagcatgatatgagcacacggtagctttcctttcagcatttttgcttaaaattctgatgcagtatcaagatgtaaagctttaagcatcgaaatctaaccaactttaccattttgagtgtgcataaagaagtagtcaaccgtaaggaaaattcaacagttctttgtttggtgacacataaaataaaattgccctagtttttagagctttaatattgagaaaattcatttgtactttgtcatttgctgagccttctagaattttatggtctcaaatcacaacaccatggacactcaggagactcctgactgttttatcttattaaacaattttgaaatcattaatttttaattagcttggatgcagggtttgtttattgtttcaatagtgtgtgtatatgaactacacgttttttatttaaactactggcaagagtactatttacataaataagtataagttctttctaagagtatatactgtgagtatata

SEQ ID NO: 113411 - DNA, 1030 bp, Homo sapiens
taaaagaataaaatagacatagttctttagttagcatatctctccagatgaaaaagacaggcatatataaaataatttttagtacaaattagatagtgataagtgctatatcttatatagtaagatataaacaaaattaaattaattctgactgggggagatgggattgcaaatgactttacagaataagtgatttttaagctgtatcttaagggatgcaggagagtctaacagacctcccacatttatgtctctagcctgtgcatttctcctgatatctgactccctcctcgacatctccatttgaatatataaactgtatcttaaatttaacatgttcaaaactaaattcctgatcttcatttcttcaaagctattcttacagtcttccccctatcgtaaatggtttcctatttgagtataagctgaaatctttgcaacgtaagaccctacactacctaactcctttccaaaatcctattacatcttgagctcttctgtttgccaccccgttcactctgttctagctaaacagggtctgcttggtgtccttcaagtacttctgacctcagcacctttgattttccttttcctttcacctgaggcatttgttttagttatctttaagaactcattcttcatgcctttcaggtttttgctcaaatgtcaccttttcagtaaggccttctctctcctccctatttaaaattgcccccatcacctcatgcacttttacttactccctgacttcatatttctttatgtcactcaccatctgacatacttatctcatgcttattgatttgtttattatgtcatatcccacttgaccattagctccatgagatcctaaatttttgactgttttcctcattggtttatccctacaatctacaaaggtgtttggagcatggtaggcactaaattaaatatgtattgaattaataatgtgatgaaatgaggaagagggttctgagcaagggaagtgacatgaacaaagctcagaaaagacgtttggcacattgcttat

SEQ ID NO: 113412 - DNA, 1033 bp, Homo sapiens
ttgagtcactttcctttaaaatcttgctttttaagaaaaatactttgtcaagcttgttacattgtacagtaagctctatgtaggatgatggtgctagcatcttcccaaactgacttagaattttgactcttaatatactatataagtaagaggatccgtcagcatttacttttagttcttttgcagagatgaataaacatcctgaaatgctgatttagacaatgttttaaaaatgctttgatgcactttggtatatgactgactcttgcttagttaaatgttttgcagcattataacatagttgaattcagatcatcttttaaagcagttgtcagaaaaatgtgggccagcatggtagaatgtattagctcaatacattgtctccattttattatgaagctgctgaggaagctgtgatatacagcactgtcattacagatctattgttaggatggttccacagtcttctttgcactgccattaatttatagcagtaaacaatatgtagccttccaactgcagcaaagcagaatcttttaatgaggtggatgttattaccacaataaatcagtgctttcgcgtaatgtataattcaatgtgtgtattcccactgtaacttctctgagtaagctgatagtgtatcattgtcattgcacagctccactggtcttttttttttaactttcttttatttggggacttcttttttatatgcttgcaaataaacgtggtatgtcttgatagctgtcgtatagcaggcttcagaaaccaactgtaacaataacagccaaaatcaatactgtgggttctaccaatatggatctctgcaagatgccattttttttcagatgctagtgaaatcaatcctaattggttttagcattatattcaagaaacgtgattctataactattgattttgggggttactcatttggagagtaataaaaataggagcagataaagtgaatacttattatgcttcagaccatacaaaaggagcattgattctatttttaattcatataatttgt

SEQ ID NO: 113413 - DNA, 1089 bp, Homo sapiens
attccttactagttttttcctcttactttgcagtggttttcttttgtttcctgtggcctaccctacttttagggaagaatgaaataacatataacctctaattgcatgcaccttcttcagtactgtaaggcaggctttatctgtcatcacgaaattaaaggatgtttctgatttcccagtcatatcaaatgaagattacattggcagatggctttcagccagtcatcaggatcctaagcagggttgtaaagcagtcctgctcttttgcctccctttcctgagcttcttttcagttttgacaacttttcttcactcctctgtatacccacagaatgtatcttgataaaatactatgcttaagcattttcaagcaccctatttattagtgttttggtttagagttacctttttttccttttctttaaccccaatcttttctgcttctcatctccaaacgttggagtttaatgattttccaaagaaagcctttacagaaaggtgtgaaaaactcccttgagacttttgggttttaaaagagaagttagctaacacaagcaaatctctgctttgtaaaaaatctgagatttcttgccaatttcccagaactttcttaccttcaataactataagtatagtccagtagtttggaatttcacttctgaaaggttgatattaattgtaatcattcatatataaatttcagaaggaaagaaggaattatagttatggtatataagcacattaatagcagctacacttgttaagtatttttttgtgtgtgtgccaggaactcttctaagtgcttacttatattggcctttaaatcaacctgttaagtaaagaaatatttgaaaaattgagattacagcacatttttgaaattaggaaaaccaacttgtaatacaatagttttaaatataaatacataacatggcccagagaaggacttttgagtactaggtttgagtcttctaaatttatgttgatttcgagctaggttactcaattcatttctttattattaaaataggaatatctagattacctatttattatgagaatgtataataatgtttaataaattacaaa

SEQ ID NO: 113414 - DNA, 1026 bp, Homo sapiens
agatcttgttatatcagcattctttatcattttcataataacttaaaacatttttagtaattatccttggattttttggactgtctatggggtcgttataggcatttagctcagcagtggcattggattaatagattatttttaacagtttatgtgattttctcaaaatgagataaacacctgtagaaaaattacttaatacttactgtgtagctgaataacatagaactatgaagacatcactagtaaatctatcagtgcaagcatttgaaatgatttagattctacataggcacaataagtaaaatggaatactttcttttccccaagatgtgtttgttaaatcgaaatggtgtagtgagtatatatttaatgccacttgtaagaagatgtgttttcaagggattaaaaagtgttctggtacttgacaacaaaagtgcttatttgttaactctaaaagccacggtggtgtgctgatgaaatttttttcttgacagtattaaataaaatctagagcatgtgaggataagtgccaaaccatttcggccttatatagcatataacgaaataccctaaaagccaaggttgagtgaaaatgctgatcaggctgcctgttatacttgtcatttagatgaaagagcgctacagttgaaagaaaatagttgctgcaccccctaacagtggcaatgttgctgaaatgacagacactatttatttatttattttcttcactagagtggtgggggaggaaggcaggtgatggagacactgggaatcaaattcattggcttctataaaaagcctcagcaacacagaaaattaagggctctcatttgggttcatggaaaagatagaaaagaaaaaaacagaaaagttaaaaggaagataaggcaataaactttggtgacaacatttaccttttttgttcacattttttaaaaaaactgtatttgccaagcatgtttttgatgtccccaagataaaatacgctttttaaaaaaattcggttttgatgccttcttctaa

SEQ ID NO: 113415 - DNA, 1035 bp, Homo sapiens
aattaaaatacaaatttttgaggttggttgtggtggctcacgcctgtaatcccagcactttgggaggccaaggcggtcagatcatgaggtcaggagatcaagaccatcctggccaacatggtaaaaccctgtctctactaaaaatacaaaaattagtcagatgtggtggtgcgtgcctgtaatcccagctacttgggaggctgaggcagtagaatatcttgaaccagggagttggaggttgcagtgagtggagatcgtgctctgccctccagcctcggtaacagtgagactctgtctcaaagaaagaaaaaaaaaacttttaaatcgttttgatcgaaacattcacatgaaatattcaagtgaaatatgaaggactattatgaattcttacatttagggttgaatttttcgtacaggaaaaggaagaaaagaggtttaagattagtcagtgttaaatgtataacacttgctggtgtcttgttggtagaaaggaagatgaagatgtgccagttgttcccaacctgtgagctctggtcacttgaggggactgtgggtttgttgcaagagatctgtgaatagatagtgtacgtgtatatatattagagactgtcttacaggaaaagttgaaagctgctgatttagattatgtaattgactatctacttattttgacccaatggtgttaatgggttttctaaaaacaacttggatcaaacagaattattactattcttctgtattgtggctgctaatgctacttattttttgtctagaatgtattgtaagttcatggtaagagttaaggttcatttttttgtgtgtagaagtccaattcttctaacaccatttgttagaaagactttttctctggaggtctcctggaatctttgttggaaatcaatcggccatatatgtgtaggtctatttctagactctgttcttcacaattaatcagtatatccttatatcagtatcacagtcttgagtactgtggttttatagtaaatcatgtaataaagtcatgtgaatcctcca

SEQ ID NO: 113416 - DNA, 1053 bp, Homo sapiens
tcattcatttattggttgttaattgagtactgtaatatgccatggactgctagtttctgaagatgtgaaagaataaaatgaagtcattactatcctagtaaaagaataagctgaagatttgggagaaacaggaatggccaagataaagcaaatacttactttttaataattacaactcacatttttaaaatgaaggaaaatagagagtttgaggaacaaggtaaagaaaaatctgtttttcatctttagattgtaaccacaaaatgagctgttattttggtccatagtgcagaaacaggaaaataaagagtagaagaaaatgaacctgcaccatgatctcctgattcctatcttgcaacataggaatcagaggaaaattgactaaaactgaattttaaatttttgtctaagctctaagaaatcatgtttgttttgtttcgttttgtttttaaacctatgttacaatgctagactattcacactctgttaacctagcagtttacattgccctagtttggatccaaatagttctaaagagtagattctgacaaaaccgaagagaactgagtgacagaaccatagtgaatttgttattcattgctgagttgctcctgtttgtgcttagtatatgtttctgtttctcgctctctctttcaggaaaagtaagtgatttttttttctctccttcatgtatctcctaccatttggatgtatatttttatgtgtgagatatttctgtttaacacacacatttaatatacagcatgcatcttgacctggaattgactaccgacatttaactgttgttgatcagacagcacttctttatctctttaagttttaagtgctgtttctgatgaatgccagtccttttagtctgctctgtaacagatacactgggaatcaatataccatctagatgtcacagagggaaaagaacactcttgggggtggggggaatattgtttaaacttgttaggtgttatggcttttacttcatttttctatttattgggcttcagtgaagctaaaggaattcaagcttaccaaaag

SEQ ID NO: 113417 - DNA, 1072 bp, Homo sapiens
gaaccatgtggagatgtgggagaacattccaggcagagtggaaaacaagggcaaaacaaagccctgaggaagaatgagttgaactcatctgacagtcccagatatgaggctttatgcagtcataaagagcttaagagtttattatacatgtcatgggaagtcactggatactattaaatataggaatgatgtgatctgatttgtattttaaaattttgaggtgaagggtcctctggtcatggtagacttcagaggtaagaataaaagagagaacaaatagatgcctctgaagaccttggggccatagaccaactggtggtatctctggtcaaagtgagagaaagggatacatgcaatctctgagagtaatgttcatatttttgtcctctcgtttcctgttcatttacctttattttacataggcgttgattatattactgaattagtaggatttctctctcatccatttcaaaactgcacgcatgattatcttgtcttttgaactttttgttttgtattttcaagaaacactctcccttagagttatacccattctatttctagattctgtggtgtcagaaatagaatcatttttgtagaaagactgaaatacatacttactgacttaaataaggtttgttactcttttttttttttttcaaaaaaactacattctgcactggagaatgtagatttatttgccattaggattttgaaaataaaaatgagtaaagacaaaacagtttgagaaggataaatttttactactcgttattttacctctttgctcatcccatctttattcctacaatgtagtatcataatcaaatgtttcatttgtaatttttaatagtggttacttttgagatatatttcttaattttttaaacttaatttgctgtcatagaatatcaggttttgatagcaagtgcatctcattttcttatgtattatgtatagtactggtgtagagaaatgctgagtctggttttcccttaacgctttcacaattaagcttttgaaatgaacgttttgaaaaacaaaacttgaatcaaagcaacaaagtgggtta

SEQ ID NO: 113418 - DNA, 1083 bp, Homo sapiens
aaagtgtcttttgattccatgtcctgtgtcttattttaattaggagaatccaactgtttggacatcagttacagttaagcatggagtgccacttaactttaactgggtcttttcagtttcatattttgtattggtacttttgaagattatttcagaaaaccaaaataattttatggaggttgttgatatcatgacattttaaatttatattgtgcctatccactcattcatcaaaatttgttgagtgcctgttacatgctagaaaatttattctaagtgttgagaatataccagtgaagaaatgtggacaatcttctcctcttgttgagcttatagtctagtggggatagacatggaaataaacacgtatgtcatatggtgataattactaaggacaaaggaaagcaataatgtctcttcaataaaagagatctgaatgaagtgagggaagaagccatgaggactgtctaatgaaaagaacattctaggcagagggaacagtaaatggaaaggcctggagggaggaatgtgactggaatggcaaggaaacatggtgtttctggaaaatcagcaaagtgggattgagttgcaaaaaatctgggaaagatgagttacaaaatataagccaaaatattttgattttaagaatcattctgaattattcatttagaaaatattaatttgtgtctaaatgtacccatggctctggagatatgccaatgaggacaaaagtccttgatcttatgtaccttccattctaaagtgggtgggagagagagacaataagtaaacaaatggatatacaagataatttcaaatactacagtgctttgaggaaataacactgggtaaaattggcttgggagttggggcatatggaaattcaggtttactgaattcgtgtcgctggtgcttttcctagtctttatttctgaattcagatcccagtggtgagatcacagacacaacttctgagcttccctatgtgtataattcttacttcacattatcattataagggtttactaaggtaatttttgtaaagtacctaatacaaggtctttcttttccttttttgctcat

SEQ ID NO: 113419 - DNA, 1047 bp, Homo sapiens
gccaaagtttttctgaaataatttgtatgcattatttttaactgagattaccttgattatggtattaataacaaagatgttaattcattttattatgaaatgcttcatcgtttttaaaggctttcatgagcataattttattaatagatcccagctctttaaggtttgtgggacaagcattaatattttctattttacagaagaggaatatgaggctttgtgatgttaagcacttcacatcatcatataggtaacaggcgatacaatctgaagtcaaatctagggttctgactccagattcaccacatgaaactgaaggcagtgtagaaacaaattgcaattttttcactttttcttgtttgttttggttatcagaacattttatattcatatgaaggaatttataacgatggaagagagtattttaactgaatgttgcaatgcatatgagccctgccttaatttgatatatgtaagcccaattttagaaatcaaatgagggtgtgagggtcaggcccatatgtttagaccttgggaattcaatagtgagcaagacaaacatggtttttcttaatgttacagagcttacatgccaacagggggtgaacaacaagcttcaatatactgtagaaattgctgtggcaaggaagtgtggagtagcatggaaatgtatatctgggcactgaatctatttgggggtcagggataggagaagggaattaaaggaaggcttcattgaggaaacgacatttgaagtgtgaactgaaagatgagcggttattgtattccaggcttagggtaaatgtcagtttaaagagatagtttgttgagatggaggaatagaaagaattatggtatgggaggccaaggtgggtgtatcactggaggtcaggggtttgagaccagcctggccaacatggcaaaactccgtcactactaaaaatacaaaaattagctgggcatggtggcatgcacctgtaatctcagctactcaggagactgaggcatgagaatcactggaacccaggaggaggaggttgcagtgag

SEQ ID NO: 113420 - DNA, 1066 bp, Homo sapiens
cttagttctctcttcttcctataatttgcataccaggaggttaagaccttactttctcctctgtcctctaaacatttactgagaacatacatacatagcagggtgtgggaggatgcctatgtatagagaaaatgaatatgtacttacattgccattatcatagttgcccatagcaatgagagtatacttgtaactacgctatcattattcctgctgctgtcccattacattttgcagataggctgaatatatatgtatgtatgtatatccttctaaagaaaaatttaatgcttattgcaaatagagggagaaatatccctggaaagcaaccggtgaatactcagcaacaatggaaagagctgaggtgcacagaatattatatgttgattggtagatttgtagacaagggtaaaaggcattgaatagcctcatgtatttaaggacagtcttctgctagagccaagaagctcaggagatactgtgtgagcaaatataaaataattgaaggagaggctaagggggaaagagaatagtggacatctagggtagtcagtggtgctgagggtagagagagcacagccattcacagtagatgaagggtagtaatagataatagatagaacatctctgttatcaaaagattacatgaaaactatattatattctaaagcatagatgtgggaatctatatatgcttggaggtagggattggtagggtgttgtttagtacaggaattgattcctgcaatgatttgctacaggaagttttaagatcaaattatatttattacactttttgtaagagaaaagaaaatagaatatatattaattttctgttgctgctataacaaatttccacaaaagtaatggctttatgcaggcctcacagaagtaaaatcaaggtgttggcaggactgcattctcttctagagcgtctaggggagaattcgtttccttaccttttccaacttctagatgttttccatggtccttggcttgtggcttccttccttaattcagcaaagtcagtaaggacagattgagtgcttatattgcatcactctga

SEQ ID NO: 113421 - DNA, 1048 bp, Homo sapiens
cagtgcaactgaaaatttctcaaaaaaaaaaaaaaaaaaaaaaaaacaactaaccagtaggttaatgcatactaaaggtatgaatgcttaagtattttcttcagtttatagtgatatttctgtgtgaatgcccctgtctttttgtttacaaaatggagaatacaaatttgaaacctagtgaaagatggcaactatcaaagtgttatcttagttttaaagaagcttgggattatgttaatatttagggaagttttatttggattccttgaattagttaccttttgaggcttatggattcttaaagcaataaagcaatattccttttaaaatcattgtttttcttctgtttattaatcattgatttaatctgtgtttttctgttggattagagaaaagatttacctgagaatcttgcaatctctatatcattagctatattataggtagagcttctttgctttatctgtaatctctcctgaacacgttgctttttcaggaatgaaaaaaaaaagaagctgcagaaaggggtacaaattaaattttcatgaaagaaaatcctaatcagcagtgacagtgtaagagaaagatgattgccacttggtcattgtggagaggcacttagatttggtgtcagtgcttctgttaatgatgactaatgtctttcttggagcaagtgcatgctcaaacatactgctacagcatatagagggagaggcctcagtaataggcatcagtaagcaaaagcattagttgtcttaaaacaaagactttttaatacagtcaatttgacactctgtattattagaaaaatacaaacataattctaaggcatttaaccacaaattttgaactattttatgttcagtactaagaggtaatattttttaattaaaaggtaacgaaaccaaggaatgttaataagatatgctctctgttttgtcacttacaggaatgggcacctacattgcactgcacagaatcacatgtgctgagaaagttttaaaaagaagccaacttacaacagatttttttcataccctagtgatgt

SEQ ID NO: 113422 - DNA, 1032 bp, Homo sapiens
agtaatttggcattgatcatctgctaagattacaagaaatacttaatggactttgtgttatttttaatggaaatgttaaaaatctagcctgcctcatcctttaaatgttatgaattagagtaaaagtgatgtgcagagaggtttctctgattgcttgtagtggttaaacaacaacaacaaaatgcttcattggttgtaatctatgtatggaagacatctgtgtaatataaatgaaataatatttaatgatctaaggaatggaaacttttcctttaaccatctgatataaagctaggatataaaacagctgtcttggcctatggatatcaaggttctgccagtctctttcctgaatttttccttcctatcttcccttattatctttggatcataaagagtcattctcttattttctgactgatttggtatataggtaattaggtttaaaatcgaggttagtacgtttagatccatctagactgagtagaaaatctttgacctgtagctatgactgttttcaaatgatttgcttgctgggatcagacactatccataccctttcactttgctatcagctatgtacacacaaaggagcagaaagatgaccagatgcttagttaatcatcatatttggtcagtaaaggattccaaccatacttaattgggccttctatttctaatatttgttgggtaactttttggttaaatgctctacgaataatctaatcttttctgctaatcaaagctttctataaactttataaattaaaaatgaatgatacaaatctatagatatgtattttaaatgtaaggtggttgctatccagaatacctggatagataaaaggagacagtgtgaacgtatcagcaaagcatcaatctaggaaacaaaaagtcccaaatttttgtcctggcttggttacctgggtgactttgatcaagtcactatctttatccattattttctcaattgctaaatgagtgggttggactaggtaatcttttctatctcttctagttaaaaaagtctaa

SEQ ID NO: 113423 - DNA, 1034 bp, Homo sapiens
aaaacactattaagttctctgaatttaaaaattatttcactaaaaacagaaagaaaagtaaataacccagatatgatttgttagtgtattctagttgatgaaattttattgaagtaattatatttaaatatatgtaagatgtgttaatgacagtcatcaagattatactgtccacattataagtcacagtaaaactacattctcttttattctctgtcaaaggatttaattttctaaaattccaaagtgttaaggagattgtttctaagctacttgtaattattattctggaatcaatctaaaataaccagtaattgaatgtttgccttgaacagttcaccatagtgcctgttaataattttatatggtcaagcatgctgttgaaacaagttattcttcccccctcacaaaatagccttaataaaaaaaatttttttttactctctttgattagtaacccaagggtattgttctcatttgaacaggttgaacttcagataattttatgtcaggtaaaagcagtagctttaattttgtacagtaagcctatcaaactgtactgaaaaataaaatgcttttatgtacttttgatgagtattgtttgtgggccttttaaatttgtttggattgccttagataatatatatgattagagatgtttgttacctattagactttacaaatataattcttgtattatatagtggaatgagaaaattgagagtatgctgtatatcagggttttcccccaagttgaatagcaactgcataaatgagtactttattaaactatacataatttgatgtcaccaaaaatatacaatgatagagtaagggacttgtgctcaggaaaattaaagtaagcagcttttagcctgactaagaagtaaatgccattatattattgcgctagaatgtgcaatgttaacatccaagttaattcagcaagtattttttagaaagtttctttgaacttgctatattcacacttatattggcatatgtcttttgaccttaccaagaaatcgtgtatc

SEQ ID NO: 113424 - DNA, 1555 bp, Homo sapiens
atttaaaaataaaagcgaaacattcagtggttcattcttaaacttctcttccacgctgataggacttcttcgctcagtgtaggtgagtgccttcttcctcaccctcccccaaatggaaggtgcaggaggtaattaatgtccagagagctgcgaagtacaactcagtccgccgtgcacttggaggtttgctgacgccccacagtctcagcgtgttggtctcgtctcttctcggggggtcgtgttatcgcagttttcctcttttcctactggaggcgttgtttggactgggtttgtttgtttgtagtgggttctccttgtgtttctttaggtgcaaaccgctggaagttgtttgataatcatttctgcttcgtaatttatacttttggccctcacaaaatccgttttagtgtgacgaagtcgttgcttgcgttgcatctggggtgtagttataacgattcagggttttccttcttctcctctagcttgcttttacagattccactttctgagtcgtctctccccctcctctcccctccgacctctttctcgccccgctctccccctgcttctctcccccgccccccttcctcgtgctcgctctctcttctttcctctaactctctctgtctctctctctccctctctctttctttctctctctccctcgctgtttcctggagttatttagtttatgaatggtcccagggccatcatgagggggtggagcttcagttcctacaatcgctatccgagctgtcagtgctttagccaatccgagagagaagacaggcacgcttggcgaacggtagcagccaccactgcacttgataaagaaacagggtaaagagagaagtaagaaaataggaggagataatgggagtcaaatgcttgcacacattttacagccgttcctctttatcctcctctcttatcagtagcaaagaagaaaaagagtttatatagaagggactctcctggagatggctggaataacgcgagggagagtagcaatggttcagaaaggttcactttttttttttttaaatgattctatcaacattgtgtagtagaaggtgcaaactgtaacaaaattactttggcttgaaggcaaatgggaagcgaaaggggaatctgggaaaggacctaatttttccaggttttttcctcctttaaagtcatcctcctttctcttcccctcccctcccattgttgccaagaatcagagcagttgctgtatatgtgcaccagtgagggttggagtggatataaggtgagggtttataaatctctttttagtaatttcgatatgctgtttaaaaacagggcagggcaaaaactagtccaagcaccttgtttgataattatttcataattaagattcacatgtatttaataccattattttatcgttacaagaattaactagttacgagagagaaaatatctaagttgtgagaaatggtgcaaacttacatgtcgtagaacttagtaggatatacttttaaaataagctactaaaattgcttcaaacttaatgaaaaacaaggcaagtaaa

SEQ ID NO: 113425 - DNA, 1040 bp, Homo sapiens
attattttgtttagcctttatgttttctggatatgatgccaatatatcactctccttgctttgtccccatgacttactactctgtcgtgcatgcaagcatgttttgtgtgtgagatacctctgtttcccattacctatagtagattttacaaggcactgcataattttctattcttaaatgaaaatgtaatttcccctttaaaatatatttctcattacttttcagaccctggcaactttgtttttactaagaaacatttgtagcacagtcataaaaaccaaaattaggtttatttcaagaaaaagaatggtataatttgctctgagaggaaacagtttcttttaaaaatgagcaaaataagcaatctgtagaaaaaggtggcttaaaaagtggaataatttattttgcaggctgatagcatatgttatgtacatgtatatacatacacatattttgagttttttggtaggttctttgattttgtaatcatgtgaatttttaaatctgaatgatttagaagtatttcaaagtagtagctcttgatgaaaatattataattttgtttaaaactatacaaacaaatcatgtctcacacatatttctagcactttgtttcaatattgctgcctttattaagacaggacttggtagattgtatgaaactgattgttttgagcttgataagttaactaatccaatgtagagaaaacttgctaattctgaaattctatcaattaaaaattttttctactttgtcccatgactgaaatgtctgaaaatgcattagtttctttaggaaaggaaggttaccaaaattaaactctctgatttctggtaacttctgaatttaagaaagactgggatttaattcaagatattctatcatgcttttaaacacatatagagcaaagcctaaaatttgatttaatttaaaagtgtctaattaattgttctgaaaattagaatctctgccaatgtgtgagattaggttctttgaagttatttgctccttttagagaagttacaagttttgtctctc

SEQ ID NO: 113426 - DNA, 1050 bp, Homo sapiens
ttacattttggggaccagcctctctctcttaggcctttcattgttcttagcctcagtgaatcaaatcatttttaaagatgacatttctgacagatttctccaattttatgtaacaattgcagtttaagtattaagttaggataaatattaaactagaataaaaggtgaaattaaaccagaataaaaggcatttcttaataatgatatgaaaaatttaaacagcaatcatgttagtaacaattttattagccagaaatatctgaattgagctttaaaatggaacccaaagtatattctgacttcatccaattaacttttagacgtgtgtagaatatgctcacagaagatatcaaaatacttgtttataatggttgattgagaataaggcaaatgaaagttaaaaatatacttttccccagtacatataaacatgataataatcctttattttatgcttggaaaagttttgttctaatttttttttaaggttctttagcagaaagctattagaccactgagaattgaacaccagcgcatgtggtgtatattagagtactgttggtaattttactgctgctaacttaaaatcctcaagggggagttaattacaggaaaaccattctaaatatcagtaagctgcatattttccatgacaagaggtttttcagtggagcttgaacaattccagaatctgagcttgtaaaaataagtaaataaataaattaaagtgggtgtgtgtatgcatacagtacacctatagtatgtaaaatttttaatgaaactttaattcagaagttaccttactgtgttttaatataggcagcatgattagaacatatttaaaaattttttaattgcaattggaagggataattatatttctcgtggtcatttataaatgaatgtgaatttattttttgagctattttaaaccattacatattgccactggggactctcatttttttgtaaatgtttgcagattaaagaggtttcttcttttttcctttcacataagcttggtgtactttaggacatgtatggcaataa

SEQ ID NO: 113427 - DNA, 1043 bp, Homo sapiens
tgccctctatagcctcttgtttgggcacttcttgctttatgccgctccaaaaattctggaaacatttaactttagcttatacccaattgtttcttacttgtttggctttgctaatgctgttccctcagaaagaatgattttccttttcttattctggttaacatctgttaactctttgactcaatttgtggattactcacttctaagaaggcttctattactttggataatgcccttcaactgtgtccctaaggtaccttttgcatatattgtaattatctcttcatatatctgtttctcttattggattttgaggaccttgagaataatgactttctatcaccaaatgaccgaatctcctgtctttactcattgttggtattcagtatgtgtttttgattaaatgaacaagtgagtaaatgagtgaaatataagcttattagtttttcattcctgattttttatgttatggctctaacttatctttcatatctcattttctattggaccggctaaatgagactgcttccaattttcagacctctatacttttacttaagatctcctaaaagcctaaaatgtcatcgtcttctttgtgtatcaattgaaaattggcctcttcttaagggtatttctcaaaaatctcttgctctttaaagcttcttggtccctttaaaacaaatgtgattactctttgcctttctatcactctgggtttttacttttcttatggtgtggattttatgtcatataattttttgtttgcttattttatcccatttattagattttaagtgccttgagattagagacttgtgttttcttcatatgagtatttcttaaggcacctcaaccagttctttccacacggtagcaggtactcagaaaatatttgtaaatgaatataattaagccaaagtagagatggtcattgagaaccagaagaaatgaaatgtagcaaagaaagagaggaaaataaatcactttagaatgtaaataattgcttcaaaattgaaagtactagaaagtatctaggagatgac

SEQ ID NO: 113428 - DNA, 1029 bp, Homo sapiens
atattttagttcttgaaattaacatagatagtattgctgcttgttagagctatttcagctcccatcaatgaattttttttcaggaaccattttttcttaatctttctcttaactttttgattctcctcaaagttgaatattgatacttgagtgtcagtatttgaagtataaaccctagttgacaagcttgctgacaaaatgtactaaacttgcctttgcaggttaatgaactgaacatgaataagcccttagaagtttgcaggctttgtgattttgactttttatcttttcaaattatatttctctatatctagtgtattcttacgatgtgtcagggtctactagaatctctttatgttgtaaaattctatggcatttgtaaagtaccatttggtggattatttgcattcatgctttcccccccaaatgtttataatgtactaaatccagtatataatttaagtgacttctgtactacagttgaataactgaaagatttatttctacttgctgagtttctcttctcctattctctcttgaacttgcttcactcaagctcttttcccaccatatactgaagctgttcttttcaaggtcaccagagacatcaatattgttaaatccaatagtcattgactagtctttaaataaataaataaataaatccaatagtcaagtctcagttttcttcttacttgactttttgataccctttgatatggttgattactaccttctccttgacacatttttttcatttggtttctgggacactgtatttttcttgttttcttcttactgccaatatgagatgagtaaacaggtgttcctcttactactggcctctcttcaaaattccttgctggttcttcctcgtcttttcaatctctttattgttgagctggtacaggccttactctttgtacttttacttttccattttcttctccagctttggtcacttgcttgaaagtctgagccagtccacacctgtattatgtaaacactagtcatcaatgtctctcgaat

SEQ ID NO: 113429 - DNA, 1099 bp, Homo sapiens
ggctgaggctgcagtgaatcgtgattgtgtcactgcactccagctgggcaataaagtactgggattacgggcatgagccatcgtgcccagctggatatatttcctagctttgtccactgagggggcctgggaatagtgacatcctggtagcaatgaatgcacctaaagccttgatcttctccattgaaaccagggctctgtggagcaatggctacttccaggactgtggcagggaaactataagatgagctcatagcacctttttgtgctagaatgtaaagaagtgctcaaagaatgatggagacatgtaagaaggaaaaagaatcagcttgaaaagaatcccactggccaaatcagtgaacagtcaaacgtcaaaatagataatattatctaatagatagcaataaattataatccgttgaataaaatagaagatcatactaatataaataaatgaacaaatggaaagtttgatgaagatcagaaaatttgcatagttccaaagtacctcctcaaaaaatattcattaattacaaagggagaaagagtaattcacgtaaaaaaaaaaaaaaaaaaaagcttggtaggtaccatgtcatcaagtgatcaaaatggacatcattagtaattagagaaactgaaaccatgtgcttccttttaggctatatctattaagaagatcatagtatcactctgtgatatgcccagagtgcctagtctgagtctaatcatgtagaagaaatgtagaagaaatatgagttaaacccaaattgagggacattctacaaaataattgacctgtaatcatctaaatgtcagtgtcttaaaatttcaggaaagactatagaactattctgccagattgttagagaataaagagacataataactcaatgccagacatgattctcagctgtgtcatcttgctataaggattactggggtaattagtaaaatttgagtggtgcttaaaatcggaaggtaataatgtatcagttttagtttcctgactttcagttatattattattatgtagaacaaagtccttgtttatagaaagtatctgttgtcaatggggcatcatgttaccattttccac

SEQ ID NO: 113430 - DNA, 1056 bp, Homo sapiens
agcccatagtaaaagtatacactaaacatgtgctttacagtataataattagcatataattttcaacgtttcaatgaacttttgccataaaatttaagaggattttaattgcaagtaataaggtttgcttgttaataggctgtagataattagggagctatttgcattctctccccacaaattttcttagtgttctgagcaccacttaattcataactttacctcatgaggattagttaatcccatttagtcacagtaataatagacatgatggtttctcctctttagttctctccccaagttctaatgattcatgtggaaggattataatatggattagttttatttattgtaaatagaagtagacttttttttttggtctttttgtctaatgaagtaaaacatcatggtaagtagtactgacattcatggcagttaatttcagttttaccaacataaattttattttttatagcattttaacataaacttcaattcaaatattaacagtttactatctgaccagaaacttttataggaaagtcctagcatgagtgggttggtacaatttatacattttgttgtatccttttgctgactctgtgagtgttttttaaaataagaagatgtttacaatgcttttcagttttgagttttgagattccttactctatttggtgctttgttacttattatatactactttcattgttcatttggaaacaaatattcattccaaataacaagttttaatgtctgcttagagatattaggaaaaaatagaatgttttcttggttattaaataacatattacattttatagaaattgggaaaagtagaaaattttctcagtttttaaatgccttattacgttttgtagatgtccacatgttaatattaataaagcaaaaagaagcacttgcccaaatttgtatttctttcaagcttaagctgtttgggccttctcactaactactctagagcaaagaatttaaagccagaaaggctggctttatgtgtatcctggctttgcaactttgaacgagtcacttaac

SEQ ID NO: 113431 - DNA, 1972 bp, Homo sapiens
ctaagcctgctaaaagaaatatgcacaatgagcaaaattctagtgaagaggattaaattaagtataatttctttgcattttatctaaagaattatagtagcattttgtcttttaactcaatcatattagaatatttagaaatttcatttgtggcattttttttattttgaccctcctttggaatccacgtaatttgcttgtagccatggttatgtaggcctgatactttcccattaatgtcatttattttgtttcactattgatggcttttctaatgccacacgatcagtgggctgcaatgctggcagctggcctgggatcggcagtggttttaataaatcacaatcagacccatgccattacatcaatatttttagtcaattatagagaaggtcaggtgctacattcagtataggagcctcagcatgtggcatttgagaaacatctggtcctgcgacaaaactgcaagccggggaaaaaagaatccaatttatcccatctaaagagaccaaatgaaatctgctgctttatggataacacaatgatgattatagccattttgaacatgttatagttggtagacttaataccctttataaagacatattcccaaaagtttccattcaataaaaactgaaaatgaaaatattattttctcagaggcagatgggaattgttgtttcctcacagcaggcatctaatatcttttgacacctagtgacctgcctgaatgcaatttgtgtcttaatatctcgcttacaccagcttttgccatgagagttctttctctctctctcttttttctttgatgcctagactattgcattggtaagtaaaggaaagtattcctcccttggagctctgataactgtgccctttactgtcattgcattttttcaaatgcttagagatttcaggaaataatgggacagacaagtacctgttcatccatacattactgtcacctggagtgaggctcaggtgaaaactgagagagcttgataagaatagtggaataagcaagaaagaagccacaaatgaacagagtggcagaagtaatttttttccggtgcatggagcaggcattgtgtttatttgggtcaggagacaaatcatctttcatgtagatgacacctggtaaagtggctgaatgtaagaaggatgaggagagatgatggagaatactggatggaagtctcagaggacatactacccttttctcatatcgtccttcattgcattctaataggctgactaatgtaccatggaaattcactcttggtattagtctgggaaagaggtggttctcatctctaaaaaatgcataggtagagctagagacataaattattttagaagtaataaggtttaggaatttttaacggaacctcatatcaaaattcttgaatgcttttgattagtttaggagactgtttaggtttagatttctgctgctttaagaaactccttttcagattgcttgagtgtgttctaatggatgccctcaagctagaggcgtctcttcctgaaagacattcatcttttttctgtgtcacaggcttgccggtaaaatctttgtgatgctctctccaatttttcttcagtaaatcaaatcttccttctttcagaaagatgaatgctgtaaggttggagtgttataaaaaaaaatcaatgcagacaaaattgaaacagtatgcctctgtattgattggccttgtgaaatcgaaactaacagctttgtaactgttccagtggacagttagctgacctgtaatggacaaactatcaatattagcattactattttatcttgtagtatgtcattttaaaatccagagtccaaggaaaggcaggcctaaagaatttttaatcttctttgtaggaaatatcccactttgtttttatgtaccattgtttgcagaaaggagtagctaatgtacttgacccgttaaaagctatggctagggtggtg

SEQ ID NO: 113432 - DNA, 1033 bp, Homo sapiens
tcgtctccctttgccatgctgcagaagccagtttagctctccaacagtgagagctcttttgaccagattctttctcgagttcaggatcacctgcttcctctcttagagaagaatcttgctttttcctcagtccagtgttacccttttttcctgcctcaggttgagtgacaacggcaccatcaaatttttttaaggaaactcttaccccaatttatcatatatgttgtagcgtctatagacctggactatgcagtaataatatttttcagttttcatatccaaagtcttgtgtatttagtctggaacacactatttttagaggttcttccatgatgtgttttacttgtcatactctcaactttagctttttgaaaatgaccaggttaaaagaaaggcctcaatattttctgctgttactcttctgtaggtatcttttgaacatcatattcttacctgtataaaggacaggtatatacatacatataacaagaaataataatttttgagctgtttgtgaaactaaaggaactatcattggtgggataaaggaagaccacttaaaagtgaatcgatgagattttgtttgcaaattgttaagtgatgctgcaccaggttaaaaaaacagctattttactcggatgcttactattactatatttctattaaagctagcaagctagaaaaagcaaaaggtttatatgtaggtaaaactgttgcaggcattgttgatcaaattaaatccaaactggaagagtgttttttcattatcttctcagtatgttcttgtaaaatatattttgaaaaccagaccttttaatgcattgaaaatctcttcaaagaaaatgtctgaatatatccctcatagatatatcaagcctttacttaagctttcagtttatggtatcttctggttatcttaaccatagaccaaattatgtactaatgtaaagccttccttttcttaatggattttaaaataaagattaataagaaactaagctaattaaaaatctttacagtgtattttatacaa

SEQ ID NO: 113433 - DNA, 1092 bp, Homo sapiens
ttggaggtactggcacaaatgctaatactcctgctattgctatttctgaaaatttggtgaaacagttgtttgaataatttatttttatatcatctgttatcattttcatagtaccctttctctgattttttacctttgcttttcttattctgttgagattttttagcttcccatagttagaaactgtcttctttacttcagtgcttagcctatagagaacactcagcctttatcttttacgtgtttgaaataaacagtggtggaagctaagattcattagtgaaatagtggaggtaaaattggaaattttcgttctctctttatttacagtgtagaatatattttaaaggaaaattttagtggtttatttttctaaatcagtggatttggctttccttttataaatatttagtgccttgaggttaaatgagttttcataggagtagatgtgtttgtgaaatagtttggagtgtttgactactagacttaatcccaggggcaggaagaataataataatgattttcctttttactgcaaagactaacctttttttcttcttattatgtaagtctgacctgccttgacctcatttatagagtagctgctataaattttgcccttgattaatgtcgtatttgtgtaaataacatgaagacctttatagacagactacagcataaggtctaacagacttgtagagtgtcattagcaaatcaattactaagttcagacataagtaattgttgtttggtagaaactgctgatgttgttctagctatgatcaaggcagctgctcgatgagatgttactctgtgaaatttatagtgatttgctgatggtctctttaacttacatttgtttaataagatatttttaaatacattgttttggtaattttgagttcaattattggtatttttcatgtaaacaacactccattttaaacaaatttattttagagagctagaataattgataatcactgacgtaattgttacaaccttgatgactttaaagagaaaaaaatacatatacttataataaaagatttcagttaaataattaaattttcacaagttatgagcaagaac

SEQ ID NO: 113434 - DNA, 1375 bp, Homo sapiens
acctgaaaaactgtaaatacagatttttagaggtacttgcaaatatattaatatttcatgtgcctaaacataaaagcaagaggattttttgattatttacaaataattaaaaatgtgtttatagtaattacataattgatttgcatggttatcttaattttttggagtttaagatatttatatattttgtgaatgccatgaatagttactttctctttattcagttctttactaactgacctgtaatatttatacaagctacaggtacatattagatgaatatgttcacaaaaataagggaaaccaaaactttccgaagggcagtattctattttactatttcacagagtgattaaagacacaatagaataaaatctttcctttattgttacactatattcttttgtggtatgtgattatttaagtttgtgttagatatgatgttgagagagtgctgacacaaagtgcaaacattgttgaaaagttaatgatagtttactttgagcacttaagattactgtatcttgagcatgaacagttttgcctagtttttttttttttttttttttttttttgaaacagagtctcactctgtctccaggctggaatgcagtggtgtgatcttggctcactgcaacctctgcctcctgggttcaagcgattctcctgcctcagcctcctgagtagctgggactacaggcatgcactatgcccagctaattttggtattttagtagagacggggtttcaccatgttggccaggatggtctcaatttcttgacctcgtgatcctcccaccttggcctcccagagtgctgggattacagatgggagccactgcacctggccagttttgcctagttttgacctttagtcttgtgtgtaatgtgtttctcagttttgtgttaatacattcccttcctcatttgagctatcctccctggctttctccctgaactcctaggagtgtttctgtcaactatttaggtaattggaggtacatccatccaattcgcttcgttttacaagggcatagataactacatcttaacaaatcaatgtggatatttcattgaagaacctaaacctttaaatttttatatttttataataaggaaaatgaaacagtttgacatgagttcaggtttaaaattttttttttctttattctttaatataaattatgtttggtttctgagagcaaaacttataaaaaagggtagtattactacgagtagaaatggaaataaactcaaattccatttggtaggttacaatattgaatttagatccggtgcagtggctcataccaatattcccaacactttgggaggccaaggcaggaggattgcttgaggtcaggaatttgaggct

SEQ ID NO: 113435 - DNA, 1030 bp, Homo sapiens
tattgctgatatgcaaacatgctttattgattcaaaattttataacagataactttctattataaggtggaaacatttgtcttgaaacaatagcaaaaacattaatacaaaataaatcggagtaaagtactttttttttcttttcaaaaataaaataggttgatgggttggtgagcattaattgatctttatttgagtttccataatattgatttaaaagtgctgttacaaccaaagaaaaacataatttaactttagattcaggatttgacctgaaatacaggcgtcctatggattcaccagcacactaggatttagaaaacacaacctttgaggtaaattttgtggaactggcagtacaccctgtggcttggcagtctagtcagaaggatgataccatgctgactatataactagatctttgaacattattctcaagggtggtaaatgcaaaacaaagtaatatcaactggcacttaattctgcaagttccctgctgattggggtattcaatgaaatggaactcttcctgacaggaagtcagcctgtgagtgtggagacatctgaaaataaaatgtgttttaatttggcaccctactgttttacaactagtcttttaaatttgggattaagaagagagttaggaaaagggagaaatacacaaatgggaatattctgagcataacatttttctttggttttaatgatgttgtgcacatgtaccctagaacttgaagtataaaaaaaaagaatacagatcagtgtctctgtttctcagctatcattgcttgcttttacttagtacttttttttcctattctaatcaatctactgaagttaaggaattatagagaggctaggttaaaagtgtaaattttgagattgcctttgtttaataccaaactctctgataacttttagaagttttagctatattctcatactatatagtttttgatgaatagtatataatttaatggattttagtcagagtagtcagagttcatattaggcatcccagcttctcagg

SEQ ID NO: 113436 - DNA, 1026 bp, Homo sapiens
aaagaataaaaagacaaagggaatggatagggtacctggaagagttttcttcgggagaaaaaagaaggcaataggatgtttaagagccatcaggaattattttagatgttataccctggaacctaagcctgtgtttgcttagaaaaatgtcgaataaaaaaattgtaatttttttgattactagtaatgcaatttaataatttagtccctttaattattggcattgctttgttaagatactaatgaactactttatattttattggtaattaaaaccaaagacttctttaaataggtattaattatataaaatatccattctaaagatatttttggtgaaccaaaatgaaacataaaagtaaatgaattaatttataagaaatcaagaatatataacagacaacggcttgcatttctgttaaggtttagtgtgaggtcagaggtcaaggtactaataagagtgtttgggatgtctgctgccatgaaacaaaatggaaacttgattgatagctagagggttgaagggagagagtgtagtggagaaagcaaaggtcagggagccatttcccttctctgcatgtataacgatcaactctctccaaaacaaaatgtagatgatattgatcaatatggcatatgttgtgcacatttctatgagtattgtgaattgtcattatatatgaagttgtaataaatgttttagtattttgaaagctgaaatgaaatactttacaaaaatggtggtagttttgaagccagctttgaactaactatagtgtaccttatttgatcatgtgattaaatgtgcactattaatagtctgaaaaaataatttgaagaaacagtttggatgaaattgtaacaaatcctcatttgttttctttataacttcttttttaaaattctctttaaaataggtctggtttgcatgaagtcgagtagttcagttgtggaattggttatgctactgtgttctcaggtgagtggcaagaataaatgttgaattaaaagtagattatcacatga

SEQ ID NO: 113437 - DNA, 1020 bp, Homo sapiens
aaagcatttagttgttaattgttagattttaatgttatccaaatagtaatggacataaaaatacgttataatgcttttattgactggtataatgacattctttttatttaaatcttcatatctaaaagcagaaaattcctatagatggttatttttcttttataggcagtagatcatctaatgcaaaattgccctcagttccaacagttgattcagtttcacaagatccggtttcaaatatgaggtatttaagctactaacttgaatattgtgatttataccttttgatgactttttaagctatctaggtttattttacttcgtttcatttcatttcatttcatttctttctttcaacatatatgacatttagaggcttgggaacattttagaagttcattttcttttgaaagattataagatgtacaagtcatttgatgatgtacaagtcatttcatgatgtacaagtcacttcatgagaagtgactatttgtggtaaaaaaataattgctgcatgcataacaaatatttacataagcttatgactttctttcaaatgattgcaaattgaaagtgtggaatttgttgtttctcctctataaaatactgatataggccaggtgcggtggctcacgcctgtaatcccagcactttgagaggctgaggcaggcggattacttgaagtcaggagttcaagatcagcctggccaacatggtgaaaactcatctctactaaaaatattaaaaaaaattagctaggtgtggtggtgcacacctttagtcccagctactcgggatgctgaggcaggagaatcacttgaacccgggaggcagaggctgcagtgagccgagatcgcaccactgcactccagcctgggagacagagtgagactccatctcaacaacaacaacaacaacaacaacaacaacaacaaaatgctgatataagtgatagccagtcagccaaagccacaataatactgaattgtagatagatttttattgttacttaccttgttt

SEQ ID NO: 113438 - DNA, 1043 bp, Homo sapiens
catttttaagctataaaatatttttaaattatgtgcgttttttttagatacaatgctgttgtacaattaatagattacagtatagtgtaaacgtaacttttatatacactcggaaactaaaatatttgtgtgactcactttattgtgatagccactttattgcagtggtccggaactaaacctgtggtatctccatggtatgcctggatttatctgatagggaacagtgttcttcatgttcttattttaaatttaccttctgcttgagcctttggttttcagaatttgatagataaatttgagttttttctttaaattaacaagttcaaacatatttgggaaagttagtagaatagtggtgtgtgtaggttctccttgaagatggggaatttgacaagataaagaggtcagtgatatataggtgacctgtagagctagaatggagcctaggcccttcaagaggtcagtctagtttgtcttctttctcatagatcctttttttttaaatcttgatatataattgtttgtactattttaaatactctcaagaattcctttgtggtcaggtgtgggagctcacacctataatcccagtgctttgggaggctaaggcaggaggattgctcgaggccaagagttcgagaccagcctgagctacataacaagaccctgtctcttcaagaaattaaaaaacaaaaattagctggatgtggtggtgtattcttgtagtcctagctacttgtgaggctgaggcaggaagatctcttgagcatgggagttcaagggtacagtgagctatgattgtgtcattgtactccagcctgagcaatggagtggggccctgtctcaaaaaaaagaaggaattcctttggcatcctattctgtatctaatagcttcagtttttttcttctgcatgtttattttttggcacttttattgtgatattttatgtattttagtttttatgattacagataaaaataaccagttatcctcatatcattgtttatttatttattgattgattgcttgattgagatag

SEQ ID NO: 113439 - DNA, 1050 bp, Homo sapiens
ttcctttagggaaatctgcagcgaaggtaagtatacagattaattaattttcaaaaagcatactcctattttacaattaagatttttatttgttcatttcaacataaagttaaataaatctggcagagattaaaatagttactttaggcctgcatataacattcaaatatttgtgtttaaatacacaataaagatttgtttatatttaaacctctctgcttttcccagtgtttactttgattgtttctgtgatgccttttccttcaaatatgtcattttttcctgcatgccatctttctccacctctctccccaacccctcaaagaagaaggaagcatacacacaaaaaaagtggggaaaggaatgctatagctttgcttttctggttctgggaatactgtgtttatttttaaagaatatctgtgtaatgtatatatgaatatatatatatacaatttttttttaatcttaaatagagcccagtggacattgtgactggcggtatatctccagtaagagatcttgacaggcttctacaggacatggatattaatcggcttagggcagttgttttcagagacatagtaagttacaatatgtctttcacatactctcttaactgatgcatatttcctcttaggcctaatgtattgagattaaaaattctttgtgatatcaaatagtggagcagagatagaaaggtctagaaacgacttcttttgacaatgattttagaaacagaatattagaaaagatagtttatataaagcgagctagcagatcagcatagtgatattaaaaggaataatgcattattacatagtaagcagtctaagtgatatacatgtattaattaagtccaacaacttattgagctgtactattgtaatttccattttatagatgaataatctaaggcacataaagcttgagtaacatctccaagctagtgttgataaacaatgataaaatcaggattcaaacccagcagtcttaattctaaaattgatgctctgaatgtaataaaatgttcaacttctgaatggcata

SEQ ID NO: 113440 - DNA, 1704 bp, Homo sapiens
catcccccaccctttttagatgaaataataagtataaatcactctgtgttactaggtttctgaaagtctgactacttatgcaatttataaattttaggactatatctggtaaaatttttttttcagaatatatatatataaatgtcaaactttattctttacagcatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactaggtgagctgctaaaaaccgttgggaatttactaaaaaaaatttttcagtaattcagagatgacattgaaaattatccgtcttctgttggtgagaaaatatatgttagctaatttgtcatatggttactttttttaatgtacatagtagtagttggtaagttggatgggcaagaaggaggatgtattttgaaaaatttactaaggtgattttggtcaggagtttccactctcccctatcttttttttttttttttttcttttttctccctgaaatggtggttctgctttcttgccaaggctggtgtcaaaatcctgggctcaagtgatcccgcctccttatccttcctagtagctggaattagaggtgctcccctatctctttttgctctaaagtagtgcttctgaaattttaaggagatacataaacttaaggtgattaaaaaacacaaggtgattcataaatttgatgatcttgttaaaatgcagattagattatataggtctaggctggggtggtggctcacacctgtaatcccagctctttgggaggccaaagtgggtggatcccctgaggtcaggagttcaagaccagcctggccaacatggtgaaaccccgtctttactaaaaatacaaaaattaaccaggtgtggtggtgcacgcttataatcccagctacttgggaggctgaggcagcagaatcgcttgaacctggaagttggagattgcagtgagccaagatcacaccactgcactgcagcctgggcaattgagcgggactctgtctcaaaaaaaaaaagggttatagaggtctagggtaaggcctaaaattgactaccaagtcccaggtgatgttgatgctgcttttcttacaaacacactggaataacaacgttctaaactagcatcattcaagtacagcctttattcaaaaaagctgtggtaatttgttaatgcagttaataaaatcatgaaatctctgttcttctcctggaaacacttcttccctaagtaaaagtaaaaatacatgaaatgactttttaatgttaactggacttcttaggtgaagcaaaaaacaaaacaaaaaaacccttttttgcataattttccttctatatagttgtaaatatcgagactttgttaaatgatttgattattaagtgaagagaaggtggtgaggagagaaggcacaagaaatggaagcaaaccattaggagccatggtcatatgaagagataaagcacctatgaaaacataacatggaagtggaaaatgtagttaatgacatattttttcatatttagcaagaatgtctgttacataaactaatgtatacctgtgctttttgccacaagtataatt

SEQ ID NO: 113441 - DNA, 1007 bp, Homo sapiens
aatacaaaaaaattagctgggagtggtggcgggcgtctgtagtcccagctactcaggaggctgaggtaggagaatggtgtgaacccgggaggtggcgcttgcagtgagctgagaccacgccactgcactccggcctgggcgacagagcgagactctgtctcaaaaaaaaaaaaaaaattgttataacattatcaatatttccaatgtatttttagcattaaaaaaaatctgtgtacttcaagttatcccccattgtatgatttatgattttaaagtgacctaatttatttttttttatttgtgtaagattcttgttatgtttaaaagcattttataggcattacagaagaaaattcatttttaatagcacatttaccagtatttacctcctaatttttgtcacatgatttcttagttttgttcccagtaaggataattttcttcaactttttatatccagtgtaaaatgaatagtatttatgtttcagcactgaaggagggcatggatagtaactactgatatggaatggtctgtttcttctgaagaagtatacaccctccaaatgcctgctgcatcatcttccttcagttttcaagatgaagcaaaagcaccttcttatctttcctcccctcaagtaggcaaactgtgatttcctttctttagctttatcagtaaatatcatttatctttggacagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacagtaaggacttaattactatagaaaattggtgtgaaaacatgagtgttatgcaactttattgactaaaacttaaatgtggtggttactatgcatcgtaggtgctataaataaaaaacaataggatcttttacttgagaggaccttagaatctgttct

SEQ ID NO: 113442 - DNA, 1110 bp, Homo sapiens
gtagaatagtgtatccttttcctatacatgtttaataataggctaaataattatgttcttcttgtggtttcatgctgtgttacttgttaacattaaaattggctgtagtttttaatgaatatttagatttctgtgattgacttacatttatcattctactaaaataaaatataggaaaattaagttttattgtattatataaactatgtatttgaaaattatttagttttatattttgtattctgtcttcatttctcatgcatattttaactgattgtacatttttcacctaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaacta

SEQ ID NO: 113443 - DNA, 1035 bp, Homo sapiens
tagtgcctacttttgaccaagaaccacactgacttaagttttagtattcatttataagatgggataatgctaagttaatcatggagtctttttatctgagtaaaactagacctaccactttttgctgtcaaagtatacttttaaaaatacatgctaaaacattacttatgagagggaaaacaaaagtttaaagttgtaagttggttcttacatttgttcaccttttattttagtgtttcatacatgtcttttattccttcgtgtggattttcttcatttttaaaaggcttttctgtttcatgaggcttatacaaagtaatttatttgaatgctgttaagttttttggaattttaaatctttatagctatttttaaaataagacagaaacttataccctaaggctcttcaagtcattatttaataaagcttagaatagagctgtagtgattcagtaagtaggtgaacaatttttagcagctattaaaaattccactggaattattggaacaaaattttcttttctctaaaaatataagttctgaagattttataatacttttatacatacagtgttaaagtgatgctttttcctttttgcagtcattttgaatctcaatatcccaaatttataacatggttcttgataaagaactgatgtgtaaagaactaatgttgcagaattggatagcttttgcagagttacatcaggatacatgctgctgctataaaaagccaaagaaactcaattgcagttttattgtccagtttgatagatttcctgccacctttgtagcagggaagctgtttgtcactatatgcctctcctccagcagctgaactgggttttataagcagtaataggctcttctagtataactgcactatgttggttactttgatctcagggttttaaagagtgcacctagtaacgtttgtgatttcattgtcttatttgttgtctaggttttcatttttttttgtttgtttttggcttcaaattgaacatttttctgtgcttaagtaatacttttttt

SEQ ID NO: 113444 - DNA, 1136 bp, Homo sapiens
agtagagatggggtctcaccatgttggctaggctggtctcgaactcctgacttcaggtgatctgcctgccttggcctcccaaactgctgggattacagacgtgagccactgcatccagctgcctcatagatctttaaaaattaaattagattactatataatttttgagaattgaatgagaaatttatttttagcagttctttggttgtaaatctttttacttttgtaattatttctgataatcatttattattagcctactgtcttgtttttcatggcgacaattatttagaaatttaaatatgtgctaccattagaaatgctttctttctactgacttaaaataacaagttggtaaccttcagaacatttacaagcctgtagcagaaggaaaaaagtatctgaaagctagcttgatacacacgttacatataagtatgtgcatggaaaagtcacctcatttcttatattccaatttcttctcatttcttagttttcattgaaaggaactctagcctgagataagcagattttttatatacagaaatctatattaaatttccttccatattatttgaaatagatttataataatatgaaaagtatatattttaaacctttccatttaaaaattatactcaaaatagtttgttttaaatttttattcattcagtgttatctacaaacttctggcatcgaaaagtgaaggaatcagggtacaagctcttaaggcaatgggttattttttaaaacatctggccccaaagtaagtatgccgaaatctaagatggactgttgtattctacttatttattttataaatctttgcagtagtaattttgttctatagtcctctagtttttcttttatttttattcataaattgctgtataaatgtaatcccactagtacatattttaaaaattaagtgaacaggattaatttttttgtacataaaattatttaaattattcatgtatttaatgtgaattatgagaattagtttggacagcttgcattcaagaagctatggagacttgatttcaggtgactcacaccatttttgctttatctgtattataaagtaatacataacctggatgtttgtcacatagtgtgttctgctgtatgcgtaa

SEQ ID NO: 113445 - DNA, 1017 bp, Homo sapiens
tattggtatatgcaacaaaggtagtgaaggattttcatgaagtttttttgggggtctagaactcgtttcttgtgctggtattctgtaaatgttatcaaatactaccacatattagtggtatgttgaccgagtaaacatttattggttatctttatctttatagggacaatagataataccgtatatgaaaatgatccggttatcatttcccacaaagtgttcttttagaactagtttctggagaggcacagtgaataaaacattccagatcagataagtttaagaaatgatacataatatcttagccctaccactaccaccagatttgcaacatttagtagcattttagaagctctaatatatttttctgtaatagagaataacccttccccacaatttcttgatatataagccttccttaaaaaaaagtcatgttggatatactgtttctaaaggttatgttttacaaaatcttgattcaatataacataaaaggtattttatttctttgatgaagaaattgtttcgaggccgggcgcggtggctcactcacgcctgtaatcccagcactttggaaggccaaggcgggtggatcacgaggtcaggagatcgagaccatcctggctaatatggtgaaaccccgtctctaataaaaatacaaaaaattagccgggcgtggtggtggccacctgtagtcccagctacttgggaagctgaggcaggagaatggcatgaacccgggatgcagagcttgcagtgagccgagattgtgccactgaactccagcctgggcgacacagcaagactctgtctcaaaaaacaaaaaacaaaaaacaaaaaaacaaagaaattgttttgaggtcaggtgcggtggctcaacttgtaatcccagcactttgggaggctgaggtaggcagatcacttaaggccaagagttcgagaccagcctggccaacatggtgaaaccttgtctctaccaaaaatacaaaaattagccagatgtggtggtgcactcct

SEQ ID NO: 113446 - DNA, 1429 bp, Homo sapiens
atcaggctcagcatcttactttttggaagaagcgtggtgaaaataaaacagcctggaagtgttactggaaacagataaaatgctggtggggttctctaagttcttcatttttattctgtaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattaggtatataatttctgtctgtatattactttacacaaatgcaaatcaggatttaatttttctttttgttttaaccagtactatcatatatttgggcagtttttctatattccattatggcaaaattttattttaatctcattgataatgttaatagtttgtcctaaattgtggtttctagagtttaataacttgctacttgtgtggaagaatactacttgtgctggtgtgagttgtttggggagctaatatgactaggatggttgttgtaagacactgaaaatgccaagaaattcttaattagtttttagtaattgatgctgagatggattgtcacaatgagattccttgaaaatggtgttttgggaatatggtggtttcttgcagaagtaggagttatctgcttctcttaaagagataatgaaattacaaaatgttagcaattattttcttacataatgaggactaacttgctgaaagggtaatattcattcatcatgtctagcagttcatataaggggtcaaaataaaacttttgacatatagtggctcttttggttgtaactataacagtctccttggaactggcttacatcaaaaagggaggtaatcagctcatataaactggcagttccagatacaacttgataaaggtattctgagtatgaccataggactgaatttgtctcactgcacttgccaattcttctgtgttggctgttttcacatattcgcttcctttgtagtagcaagcagccggtcccctttcacatccgtaacaacttaaattcagtgtaagagcatctgcctatataatgtatttccagtgaaagtctcttttagtctctctgttgctcattggctttgattgtatcatgtgcccatttttgtggttgtagttgccctgattgcttagaaatggaggcatcccctaagttgaaagacattgtctgaaagtgaagatgacttcagtcacttggtaaaaattaagagctgttgcttgaaattaagaaatagatgctggggagtcaataacatacattctgattgcagtaagaggctttggttgtttagtgatttacaaagattttcaatttgcatactactttttatatcactttcaaaataagcttggtttagcc

SEQ ID NO: 113447 - DNA, 1037 bp, Homo sapiens
tctatatcatgaacatttgtcattgtttctaagtaattcacctatcaatgtgtttgagataaagtatatgaaataaatatctgagtaactcctaatcctacattaaaaatctagttctgatgtaatgttggaagcagttttagtggagcttcaatttctttgaaatggagaactttttattaaggtgaatggaagggttacatctatctaacctaatttaaaaaaaatagaatatgtttttttaatcatcgcctttttaaaaaattctagttcaaccttgctggcctttatcatggaattgttgaagaactcaattgctatgcaggaacagatgcttgcctgtaagggcttcttggtaataggatatagccttgaaaaggtaaagtatgaaatattttatgtttttgattcttaatttacaggccatacatttgttctctaagtggctaaggaattctgtctgcaagaatgtctccttggttacagaaaattacctaaactaaaataacattttgttgttttaccttgcctccattcctctatcaaacaaatgtgatagtgagcttcatggcatctttaactttgagcataatttgtgggccagtttttttcctggtagggacagcctgtaattcacttactttgacttgaatttgtggtaacatttgaactactttttttgcagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggtaatatatatctatatattgatattgttttactatctttgctgtttttgtgcgtgaggagagtgataattaagaggattttcttttttttatgtactattatgcaagacttcagtggattgctttttttgactaagcatccttttttactcttcaggaaaaattgcaaattgtgtgtgtgtgtgtatgaatatataca

SEQ ID NO: 113448 - DNA, 1065 bp, Homo sapiens
tgaatcatctcctaaggacaacccttcaatttttgttcattcaccacatgcactcatgctccaggtactaactgtgatcttttaagaacatttataatggtaatttttgatgtgttattgagatgtatttggtagcttctgttaaacacatggaatgtcacgtttatagtgtttctgcatttattgttgtgccttatttttaattgttttggaaaaaaaatcattgaactctttactgtgtttttgatcttacaaggatgtaaaggcagttttaacacattccatccaaagtgcaatgcattcaattggaggagtacaagtactatttccactttttgcacagttggattacaggcaatatttgtctgatgagattgatttgactatatggtgagtgcctttatttgtttctttaattggctgtgagggttaatttcatcactgttgagctatacaatattttgcctttcaggttttgttgtgtcaaaataatttaaacttgtgaactataaactgtattacaagtccatattaattatgtcagtattaacttaagttcttgtttatcagtaggaaatatggaagctgtaagaaacacaataaattggttttagaataacattataaatggcaataatgggttactcaaaaataaatacatttttttgtctaaattaaaaattttttttactacccattactcagaatgcaataagaaatttttaatttctgaaatatttaaaattatttggtaatgatttattatggaacttaacttttcatattttaattatttattactgattgcatttatgtaattggaagtcaaaattttaatagtgttatcgaagtgaattagtctttttgaaaaaaattagattgtacatttagcacatttttgtctcttgtgttgtagtcctgagtctaaaaaagaaagggatataagttatagggtaagtcataaaatgtaggaaaggagtctcaatttctcatggctatatattctagtgaaacaatgtatagtgaaattattgtttcatttgtattgaaattattgtttcattt

SEQ ID NO: 113449 - DNA, 1047 bp, Homo sapiens
aatttagttatttatggagattaagggagatacaagtaggaaatatctacggcatttattttagtattgcaaatttaatatgtgtttgcttttgtaccttaaaatttagaggttaataaatggttcatcaacaaaatgtataagtagataggtagtcagatagattaagcaaatatggcaaaaaattgacaattatggaatctagttggtggaaaaagggggtgtttgtacttgattttcagatttttggggtatgtttgaaaatttccataataaaaagctggaaaaatgatctagtgattaagttcttatcagttgaaaggcccatgaatagatattgttccagaaagtaaatattgaatttaacaaaggtagtcttgttttatttttaggttgaattacaacttatcatttaacttttactcatcagtatggttgcgttattgggataattgttatctttgtatttttaactgttttttgcttctgcagtggtatatggttaccatagtacacatctataaccgatggaagaatagtgaacttcgatgttatgtgaatggtgagctggcttcctatggagagataacatggtttgtcaacactagcgatgtaagtagtttcaaaatgttgcaatgaaaaaagtgattttaaaagcatgagctttttaaacaagaaaaagttttacaacttgaatataaaattcaaagtattacaatggtagatttttataaacataatttggctagcatgttaatagaacttaatatgtcactgaaatattagtccttgttataaaatcattccatataggtagaaataaggatttatagctaacagtggctatatctggggagtgggtcattggttcatttatcaaaatgaacaagagctccactatagggttctgatcatttttctgaatgagttaaatgatgcatgcttataaatcttgcatataattctaactgctatagttaactagtatgttgttaacgtttacaggtttcaaaaataaatctataggttagaatgaaatttaaaatg

SEQ ID NO: 113450 - DNA, 1004 bp, Homo sapiens
tatctgtaatgtttcgtaatgttatagaagcacattctataatgtatatatgttatttatggaagtttctaaaatctcctcattattacattggtcagtctgttacaagcaaaacaaactttttttttattttgagatggagttttgctcttgttgcccaggctggagtgcagtggtgcgatctcggctcactgcaacctctgcctcctggtttcaagcgattcttctgcctcagcctcctgagtagctgcgattacaagtgcccacgaccacgcctgactaatttttgtatttttagtagagacggggttttgccatgttggccaggcttgtctcgaattcctgacctcaggtgatccacccacctcagcctcccgaagtgctgggattacaggcatgagtcaccacgcccggcccaagacaaacttttaaaaaagatatttcagtctattcttttcctgagcttatctttcattcttttttttatgttagttctcataaaatcttatattaggccctgtgtagcctggcagtatctgcagaaagataagaatatgttttaatatgacatttgtgatatttaaatgttatatacacaatatacaactttctttgaaaagttttattgcccaattttttcctttacagtttttccttacagtcgattttagatttgtagcttttcagaataattttactttcttatcatagcctatcattgcctctaacattaaaaaaagtgttcttatgagattaacctttttcatgcctcatgttataattttattatttacagttctgagattgcagtgcatgcatttatcttgaaagtagggcaggtgagctgaacagcttttgaaacttgaagagaatagatgttttaaatatgtttagtgacttcctttccttaaacatagcttttactgggaatttaaagtagtcatgaataaagtatttttgcaaagcttttacatctttgctatcgtttttggtgagagagaaca

SEQ ID NO: 113451 - DNA, 1025 bp, Homo sapiens
atattaaaacagtgttgcattcctggaataaaatctacttggccatggtgtaaaattcttatttattgccgaattctacttgctaattttttgttaagaattttggtgtttatattcatgagggatattggtgtataggctttttttttttttggtactgtctttgtctggttttagtaaaatagtagcttcgtaaaatggattgagaaatttaaaattggcattaattttttaaaaaatatttagaagaattctccagagaaaccatgtgaactttgagatttcttttttgaattttaaaattatgaacttaatttccttaataattataggattattcaaattatttcatattgggcaagtagtggtagcttccagttttgaggaattggtccatttcctctaagttgtcacattatatgtttagagttgtttgcagtattccctattttttttttttttgctgcctctaaggcctgtagtgatagtgttttctccctgatactagtaatttgtgtcttatttcttgctgctttttaagtcctgccaaggtttgtcaattttattgatcttttcaaagaactagctcttcattgattattgttttcctactttctacttcactgacttctgcttttgtctttattatttccttctttctgcttgttttgggcttattttgcttttctactaggttctttaaaatggaaacttagattattgatttgagacttctggttttagtgctacaaatttccctctcaggtatggcccacaaattttgatatattatatttttattttgattcagttcatcgtatttaaaaaatttatttgagacttcctcttttgacacataaactatttaggagtgtaatagtttccaagtgttcgcacatttttctgtgatctttatctttctgttattgattcctagtttgatttcattgtggtcagagaacccactccatatactttcaatatctttaaatttgttgagtttgtattatgtcccagaatataat

SEQ ID NO: 113452 - DNA, 1047 bp, Homo sapiens
aaaaaaaaaaaaaaaaaaaagagtgcttgcttcatcacccaggctggcttgcagtggcatgaacacagctcactgcagcctcaacctcctggggtcaagcattccttctgcctcaacttcctcagtaactgggactacaggcatgttccatcatacctggctaatttttgattttttgtagagatggtttttgccatgttgcccaggccagtcttgaacttctggcttcaagtgttccgcttgcctcagcctcccaaatgctgggactacaggtatgagccactgcacctggctaaaaacttcacttttctaatctcttatttaattttgtggtagaaatatttgagttttataatgttgttttttctttttctttttgtttttttctttgagacagggtcttgctctgttgcccaggctggagtacagtggcacagtcactgcttactgcaaccttgacctcctgggctcaggtgatcagaaagttttaaagtggaaaaatcatcagactggataattcctaggaaataatttggtatacagttttcttctcccactttccagttctgcaccttttgtgtaaatccatagatcacagtgtaggttttcagatggttgtcccagctcagtgaatttatggctaaatttgttccattacattcatagtctcctgattcacttggttaaactgataagcattgccctacattctgtggcttctttgtttacttgttgtcctctgttgttacttgacccatcttagtaatcttcctttaattccttccagaaggggaaatgtggtggtaaaaaatgcaaattacaagagaaactggtattttttattctatgggtgttttttttttttttggcaaatacaaatgaaacaaaattaaaaaatctctgataatcctagcattcattttcctagcattacagggagtttactgacagttgaattgtcttcttactgtatttaaatcccatatttactgtaaccttacattgtttccttttgttacacattttattttggatgatcacctatta

SEQ ID NO: 113453 - DNA, 1224 bp, Homo sapiens
ctgtcgcccaggctggagtgcagtggtgcgatctcagctcactgccacctctgtctcccaggttcaagcgattctcctgtctcagcctgcagagtagctgggattacaggtgcctgccaccatgcctggctaatttttgtgtttttagtagagacggggttttgccatgttggcccagctgttttcgagctcctgactggactaagtggtctgcccgcctcagtcccccaaagtgctgggattacaggtgagccaccacatctggcctgaatgaacttgctgactggcacttttatcctttctagtagagatttatatgcatacttctgtaagtaccttattttcagtaacctttaaggcattagcacaatttcttcagtacttactgtattggctttgagaaagacttgatgtatttttgttttgctcttgtcattactggagtaggagtaaaatattcttaattgcaaatcaaagtctgtttacaatcctgggagcttttaatcattgggaccactgtgtaatttaagttcttatttctagctggaaatgccaattaattggttatagatgaggaaaacccttcttatgtaaatctgaagacatgaaaacttgatatggaacaaaactttaagaatgattttgcctgagacatgtcaaattttgactctaatgaggctgttttcagctagcttctctactccctggccccagagggtatattgttggtcgaatggaatatcctatgatttttttctgttctttagcagaaggtggaagtttccacagattccctttctctcctttcacctatcgcacgagtatcattttctttactgccttccccctcacttccttgccccttgggctgttgcttttccttgggatctgtattctgttcttctgcagttagaagcttccttggcatcctgtgtcaagtaaaaaggcctgtaaaatctttgttttcagtcaccacaacatgagtagatctctgttttgtttttatggtacgtttgctaccctttatggaatgacaaaaattagcatgatggctttgatttgtgtattggagatttcagtgattggtttggaaacagttgggatagcagtctacttccttccctttattttaaccatcttaccagattgacagattttgtcagatttgtctacattctgtttcagaccatgttttagcatcctctgatggttaagaaggaggcc

SEQ ID NO: 113454 - DNA, 2690 bp, Homo sapiens
gccggcttgccggcgcgactcggctggaatgttagttttgtgggctcacgagctgcctcaattctgcgagtgtttgatggcactgcgacagcaggagttgaggaaagcacccttctatccattcaggacccgtcaatctcgcctttgcttggtcccgctggaatctgcgagctcctgctaagctttggggccatgcagtctcttagttaccagtacatgccattacgtgccagcaaagttaatgagattgcatgttactcgtgcctgtgtagtggaaggaccgatgcatgttattctaagtgcctgtgtagtggatggaccgatgagggtgggaagtggacataacctttcaaagtctgatgcatgcagtgaaacgtacagtgggaagagctagatttatgtttgttcccctcacctcactgtgagatatactttggtatcaaattgccggttagctttttaaaatattaatgggaaataccattaacagtgaaaaatacagtaagaattgatctgcaatggaacttaagcatcttcttaaaatccagggttgatccattttctaagaaagattggtatgatgtgaaagcacctgctatgttcaatataagaaatattggaaagacgctcgtcaccaggacccaaggaaccagtaagtagcttattcttggtttgtattttccttaagttggcgcttgtatattgtagcaggcatcttggtctgttgttggtcctgtggtgggagactttaaggaaatgtcagctcttggttgcagccttggcacctgtggtgatcatttttagtacagcacttggagagaagcaagatggtgctttttgaattaagaaaatgtgccatgggtagttctgagcttcaaataagtactgttgataagtcactggtgtctggatagatttgataacaaaggttaaggtctttataatttaccattaacttaatttctaccctcagtttacaggcttgactttgcttatatggttcctaaatgttaagatacttgtttttttcttttgtagaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcaggtgagacccaaagttccttagagtggttgtgctatgggtgtttgaccaaggatagcatggtttgatgactggaaggagcaagttcattttatttatttattgagaccagtgaaatgtccacaaagttcattttaaatttttgttttcttgccgttgttgagtgctaactctggggttgccacaccatattttacttactatttaaatctaagatttaatagtggtgtatcatcaaagtcagattttcttgctgcatagattagtggttttttgaggaacgtttaggtgcaggtgggcggttttgcctgtcttaaggatgttttttgacctcagaattgagtgaatgttgattaactgtggcagtagagcataattgtggcagagcctctggagtgaggttaaaatctgggctccatttgcctattgtgttctcgttggaaagtaacttgttttctaagcctcggtttctttatttgtaaagtgcagataagagtgtcattttattgaattgtgaggatgaaatgaaaatatttcagatgtgtctggctaactatccagttggaatattttgtgggagttttttgtttttgggagattgagtctcttatcgtccgggctggagtgcagtggcgccatctctgctcactgcaacctcctcctcctgggttcaagggattctcatgcctcagcctcccaagtagctgggattacaggcacccgccaccacgcccagctaatttttgtatttttagtagagacagggtttcaccatattggccaggctggtctcgaactcctgacttcaagtgatctgcccgcctcagcctctcaaagtgctgggattacaggtgtgagccactgcacctggcacagttcgaatattttgtatgtgggaatgaatgatgacaaaatgtttcagtcccaaatgatacatactgattataccattatatttatcctgacattcctctaaggctttatggtttacatttctagaaatattttaaggtcccttagctgtaaattgtatttgattagtttttttttatactaaggtataaaatttacaaaatgcaaacaaggtaaatcagttttcatcactacccaagatgttttttgttttttcaatttaggcaataatatgaccactaactaggggtttttaattatattttagctctgaaattgggtatttaatcatcagcatggctttagtttggaacataaaagacgtctttcaaagtgtgcatttagagttatagcagtcacctatttacaacacagttttttgaaaaatgacataatcactgtagatgtgttcataccatagaataccatggatcctctcagacctattttcctctggtgtagttttacacttgagggggtatgagctgtttaaaggggtatatgtatatgcaatggatgtgggtttggatgccgtcaagatagtggtagtgttaa

SEQ ID NO: 113455 - DNA, 1775 bp, Homo sapiens
cactgtaaccactgcttcctgggttcaagcagttcttgagcctcagcctcctgagtatctgggaatacaggggactgccaccatacccagctaatttttttaaatttttagtagagatggggtttcatcatgttggccaggctggtcttgaactcctgacttcaggtgatctgccagtactctaaatgataacagttttttcgtgtttatttattttgaatgaagctgtctcacagtagatggagttgaaggacaggaaatgtttttcccctacttggaaaatacactgaataagttgagtggggtgggatgtgcctggagtcccagctactcaggaggctgaggtggtaggattgtttgagcccaggagtttgaggccagcctgggcaatatagggagaccctgtcccaaaaaataaaaaatatacgtatatatatatacacacacaaagaaaaaatacactgaatagacaaaacctttcatgattaatgatgcacgggaataagtgatgaaaaaagtttcggtcccagatgatggccagtgataacaacatttttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaatgtaagtgagaaatcacatgattcctgtagggccaaatacattgtttttgggtggaggaggagtgtggggccatatcatggccttctttttcttcctgtcatgcttgcatagtagtgatgaccattatttcaagatatactaacagttttttggtttttttttttttttttttttttgccttttagtgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctgaacattctttttttaaaaataatctgacagcttggtggattagacagtaaatttgacagctggtaaacttttctgacccagacaaattggatataaacatactactatgcacctttactgtgaagctgaaatggggcggagaagctgttaccaagtgggcatttagtgctatccacctatagtcactcattcattcagtttctacctcttctcaagccttttcagttttctcatttcttgcttagctgataaccttgcttcctttaatcactaaaaaagtttaaagcagagaaaagaaccccacaaatttctgttacctatattctgccacctatgcatgtgttaatcatactaccttctgtcataccactggatggattgtgctaagacataagacagccttttttttttttgcccaatcagcctcatggcttcagcaattcacaccttt

SEQ ID NO: 113456 - DNA, 1054 bp, Homo sapiens
gatcccatgtgatcttgcatctgacttgtctcttactcctattccccttgctcttccctgtgcttgaaatattctcctttacatggccacagtgtttatttcacctccttgaagtctctgctgtttgttgtttatttttaagcaacctgaatgaggaattgaagtttgttctaataatgtctcctccgtagaatctggtggtgccctctgacacttgtgatttttttccagttttgtttactcgtgtctatgagaaaaattccatgaggacagtgtttttggtggtggtagggcactgattaattgtcagatcatcattgcctagttcaatatttgttgaataaaggaatgagtgatattccctattaatgtcccttagccaagaaacaaatgccttactttctactaaaggctggtttagacatagatatgggtcccaaatggcaggggctccctccccagggtagaaaaagaggtcatgggatgaggactgattattacataaatggtggttttcctcttgatgcactgaggctggatatcatttagtaaggtaatagtataatccataatcaagctctaatctgctacaccttggaataggggttggcatagtattctatttttagaagggctcatttgaaagaggttccaaaaataatgctttttttttttttttttcgagacagagtcttgctctgtcgcccagactggagtgcagtggcacaatctcagctcactgcaacctctgcttcccgggttcaagtcattctgccttagcctcccaagtagctgggattacaggtgccggcctccacacccggctaattttttgtatttttagtagagacggggtttcaccatgttggccagggtggtctcgaacccctgaccttaggtgatccacccgccttggcctcccaaagtgctgagatcacaggcatgagccaccgcgcctggccacaagtaactatgtttaatgcccaccaccagtctttagattgatggctctctagttattttggttgtctgaagcatgtcctttggtaggttc

SEQ ID NO: 113457 - DNA, 2259 bp, Homo sapiens
atcaaagtgcagcaagggtggcagtggcaaaggaatgagatttaagggatagaggcttacaagcaaatggcatcattaggtatagatcattgttgtcatttaattctcaacaatcaagataaatgagttatacagagaagattattcatgctgccctaggtaggccactatttaccatgcttattctcaacagaaaccagtaattctaactccttttgtcttacaggctggagatataataacagagctggaatctgtagatgatgactggatgagtggagaacttatgggaaaatctggaatatttcccaaaaactacatacagtttctacagatcagctagaggagaagcttgtctgtgttccttggcacaagaactcacttgaactatcaccttgactatcagatatgtttttgcactattttttttaactgaaaaagaaatatctaagctgtacatggtacactagaattttctgaaagcagaaaacgttcagattttgtagttaattttcattacaatagaaacatgcacatggaaacccatgagctaggattctaccgaggaaaacatctagtgggattagcaaggtgaagggaaagcatctggtggcatggcagcatggggaggctcacacacagaagttgcacgtggacatctgttttaatcagcacaagtgaattaaccatgcttcttcatttttttactttagttaaaaaagaggacatttaatattctacatgctgtaactatcaggacatggttagcaatctcaatttcatttttgatattcaaattaattcttacagcttgagcatatcagccttattaccagagcaaatccttccttcagatgggatagtttactgactagttggagcatttgtaagcacatggtgaaatcagcccctgcccaccaaaataatctttatgttaccaagtgattcccatttgtctaaggatttgaagggggtctaaattggatgtatcttacttagtctaaagaaccaaaaccatccctgaaatgccttgctaatacaactaatccttccatatatgtgccatacttatttttttcctcagtgtatactttatgttaacagggttattacaaagcacattttctgaatctgcaatcattcctttgacaattactggacccaaaggaaaattcattttctttgcattattccagtaatatataaaaactgtgtcttgttatagtagtacattatgaatcacatataaaatcttacaatacagaacaactgttaagatggaaaacagtgccaaacctccacagctcatttctttgtaatataatcagaatgaaaaataatttaagaggacagaagactggtacttttttgttttattttttctctagcttatccctgcacaattattagagtgaatgaaaaaccactttcctgctttccattgttataaattctaagcttaagataaaagtggttctttacatgactgaatcaattacaatttatgggctagagccaaataggttgaagacaatcatccaaacagatcaatggaatagaatttcattggaaatgtaaaacactttcccaacaatggtcatgactttcttctgtttttgagaagagtttcatatgctggaccacattttagcttttattgttttttttttcccattgtccaaaaagttaagcaacaagtggccacacttttacgtgactacaacctggagttctgcaaagaaggtaatatttacttggtctttgactaaagttatctccccattctatggttacattttattttggactatggggacttctaatacgttttggtaaagaagagagtataaagaaaattcttgtcaaatttcactcaaaagtaatttcatgagaaatcaatgatttaaagcattatccaaattaaattatcatttgcagcaaactgtacaacagcaggaaggatatggaatggaacatgaggtatatatctttgcctttataattttaacatcttatattgaagattctgaaaacctatctttattagaggaaaatctcaatcttcagttttggccttctgtcagcagaatgataagtgcaatagttgtaaatctacttgacactgtaataaactgaactgaactttcaaagtccctttctcatactagactgagttttttgagaatggaggtggtatcttttttttttttttttttgagacaggatttaattccctttgaccaggctggagtgcaatgc

SEQ ID NO: 113458 - DNA, 1052 bp, Homo sapiens
ctagtcagtaaactatcccatctgaaggaaggatttgctctggtaataaggctgatatgctcaagctgtaagaattaatttgaatatcaaaaatgaaattgagattgctaaccatgtcctgatagttacagcatgtagaatattaaatgtcctcttttttaactaaagtaaaaaaatgaagaagcatggttaattcacttgtgctgattaaaacagatgtccacgtgcaacttctgtgtgtgagcctccccatgctgccatgccaccagatgctttcccttcaccttgctaatcccactagatgttttcctcggtagaatcctagctcatgggtttccatgtgcatgtttctattgtaatgaaaattaactacaaaatctgaacgttttctgctttcagaaaattctagtgtaccatgtacagcttagatatttctttttcagttaaaaaaaatagtgcaaaaacatatctgatagtcaaggtgatagttcaagtgagttcttgtgccaaggaacacagacaagcttctcctctagctgatctgtagaaactgtatgtagtttttgggaaatattccagattttcccataagttctccactcatccagtcatcatctacagattccagctctgttattatatctccagcctgtaagacaaaaggagttagaattactggtttctgttgagaataagcatggtaaatagtggcctacctagggcagcatgaataatcttctctgtataactcatttatcttgattgttgagaattaaatgacaacaatgatctatacctaatgatgccatttgcttgtaagcctctatcccttaaatctcattcctttgccactgccacccttgctgcactttgattttccctcttatactttgtgcctctcaaattcaccactcctaatctaaaatccctcttgaacaaataataccagttatcacacacacacacacacacacacacacgattatttattgagtacccactatgtgtcagacactgttctgagcacaattaatattccctcattctacaac

SEQ ID NO: 113459 - DNA, 1026 bp, Homo sapiens
cagattttagcagagcagagtaaattaataacatctgattgcatgtttccttttcattttccataaagaaaagccttaaatcaagccatttttttttccagagggtaatgtactagggctacaaataaattcatttagcccaataaaggtagtcttaacagtagccagagtcatctgggaccattgtagcatcttaaacacagattctaagaaatgtttagaaactataaagaacaaaatagttatgtcttcatctgctgaaggaattctaatttgcacatgaataagacacacagcccctttgactaacctgatgaagataaaacagtgtcctgagtcaaggtgaagctctttaagatgggaaaaaaatgcaaatttgatattgaggccatggcaggagaatcacttgaacctgggaggcagaggttgcagtgagccgagatcgtgccactgcactccagcctgggccacagagcgagactttgtctcaaaaacaaaagatactggggccataggaggaatgtgataaaccagatggtagaggagaaatgccattatgtgcaagaataaatgtagagtgcaaaatgctctgggtgttgataaaaggcaattacagtaaaagcctttctaagtaaaaaggtccattgtaaaatctggcggccacatagcctagtggttaggaatataagcccaggaattgcactagatttgaatcctggttctaccactaactagacatgcgacactggcaagttatgtagtctatctgagttttggtttctttttcactaaaataaggaaatctataaaaatatatctcagccaggggcagtggctcacgcctgtaaccccaacactttgtgaggccaaggtgggcggatcacaaggtcaggagtttgagaccagcctggccaacatggtgaaaccctgtctctactaaaaatacaaaaaatagctggacgtggtggcaggcacctgtaaccccagctgctcgggaggctaaggcaggagaattgtttgaacccg

SEQ ID NO: 113460 - DNA, 1060 bp, Homo sapiens
cattatacttaagctgtataataatccatattgccatatttttacggtagaaggaaaactgattttaaaatgggaatttgtgtgggatagacattatttgtgggcatctctcaaagagctggttttggtattttaggtaattagcaatagcttcatataagaaatggcaaagaggctgggtatgatggctcagacctgtaattccaacactttgagaggccacggtgggcggattgcctgagaccaggagttcaaggctgcagtgagctatgattgtaccactgcactccagcctgggcaacagagccagactctgtatctaataaataaatagcaaagacttttaaacagaaatgaactatagactgttactaatgtatatagactataaatagttgtgtttacaattaactaaacaagctcagtgaagttagtacaggttaacgcaacatagacaatacatgaagagaccggagtggaatcccagagtcttcactcccacctcccacctcaaccatttgtttttaatactatgtggccttcacatctaatgttctgacttcttgtgtttgtttgtttttttaatgtaggcacaaaggtaccactgaaaaccaaaaaagaagattctggctcaaactctcaggtaggctgcttgaacagatgactatagtgacagccaggttcagactctgggaggaatattaaaatcataattttcaagagaatatagtatgaattaatttttcaattcatacaacaaatgtttgtaataaattcttagatggttaatatattttatatagagagctcatacaaaaacatgtaaaccctgatagaaaatgaaaacagagactgggcagagtggctcatgcctgtaatcccaacactttgggaagccaaggcaggtggattacctgaggttaggagttcgagaccagcctggccaacatggtgaaaccctgtctctactaaaaatacaaaaattaaccaggcatggtggcgtgcacctgtagtcccagctacttggaaggctgaagcaggaaaatagcttgaacctggc

SEQ ID NO: 113461 - DNA, 1040 bp, Homo sapiens
tgacaatgggttaaaattctgatgaaaatacatcatgaacctgctgatagaagcttacctaagcaactctccaacatcagtgcaggacataaagaaagcagcaaagacagtctatgccagtgcttcctgcagcctggtctcagcatgagcagagatagtttcatcatttactgcattttattttggccatctggtgttcacccagtttttagaaggttcaagtatttttgtcatgagaaataattaaatcctatagaaatatgaatcctacaataactgctagacattttgtatgtttttgtttttaagaggaactagaagaaagtgaaggaagagttaagttgaaggggttttcctttatctctgaggacgtttccctgaatttatatacccttttatgtgtcattgtaactcctttgtgatttaaagcactgccacaatgcaactttatattctagttaaatgagcaaattaatagaattcattacctgctgaagactgtaaacctgtctatgaataggtcagacataagcagatgctcccagaggactttagaaaacaaatgcaaaggttatcacaaataagaaaacttctgatccacaatagttgaattctatttcagattcagtttttctctatttttaagcagcatatactgtgtctcagcaggttgaattcgaagtgggcttttacagtcattgacccattgatctgacttaaatcagaattctattaaagctagaatcaaccttttctttttaggcaattgcttctccttagcctgttgctattgaaacttcctttctaaaccctcaaatctagggattagtattaaagcacaccttctagagacacaattttatctctgcttttatcttattttcagtcaaaattgcagatcatgtaaggattgttccaaatgtcagaaatgaagcccttttaaaggagattaaaaaaatcatttttaaaggcaacagggttagttccaagactgtgtgttatgatatgccaagtttctgttttctttaaacctcctagtt

SEQ ID NO: 113462 - DNA, 1625 bp, Homo sapiens
aataaactcctgatttacttacaatctctttttatccacttgataggctgatttttgttttggtatgggtaaacttatttgctaaagagttgtagtactcccttagttaatatttgaaattaaaatgatttttaagcataattgagaataataatattataccatgtctataaacttttttcattgttcagtgtgtattcagcacggctttatattggcacagtaggaaacatttgctaacacaatagtgtttttttcaaccatttcccatcaatcaaagcatggtaaatgtgtctaatttggtctttaaaaagggagctcataacaatgtccaaaaaaagaatagcattttttaagtcaatttgattagtataatctgttctcagaatcagtggaacataactgcctcagtggacacaactaaatgctactttgtgcttttatcaaatctgcaaccaggatgattcatcatacataactataattttatattacagagcaagttgatgatttgaacctcacttctggagaaattgtttatcttctggagaagatagatacagattggtacagagggaactgtagaaaccagattggcatatttcctgccaactatgtcaaagtgattgtaagtgggttgtgtttgttttaatttggtcatatactcagtgggttctatgtgacttgtaggttggaaaaaataactagaaacccagattctagttctctttcattgattcatttggcatttggaaaattcaaaaataaagatttggtcaactaggtgatggttaattattatattatggagtgttagaacttaatgcctaaatgctgtctgaaatcctaaagtgaaagaccaccacaggtcaactggtgaatcagctgttcttggagagttgttaagcacttaaggatatatggtaattctttgagacatttagtgaacatgaattcagtgatactagcttatcctgtagagatgttctctgaggttatggtaccacttcttttctttggagtacattttggtttgagtttctttcatcttttccattcttatttatctccatctttaaaaaaaaatttatttgggaatacagaagtatttatattggagatagtggttcattaatggttgtacccacaaaataatttctaatctgattaggaaaattatattaaagcaccagaatttttataccctcacggcctaacttgtgaaagcattcctatgtgtgagagctgtgtgtaagcccagatggctgtgtgaaacatggggataaaatcagactgccctcacacatttgtatcaattggaataggatgactcggtccctgatataacttactgatactgtgaaatatcaataaatttagcttaacagcattaacagcttatttggaaggaaaaagtaaataaattccattacatcagaatattagaaaacaagactaacagaaaatctgaattcttcaaatagaaatgaatttgagtctcttggattatgaagggtaggcattaaacattgtccagtgtatctatgccttgattctttggagaaattcaaccacattctgtaaattaatattaagaataatgtttgttttagcactcttcctca

SEQ ID NO: 113463 - DNA, 1039 bp, Homo sapiens
tctttggggagtgataaaagtgttctgcacttgggttatggtgatggttggataattctatgaatatgctacagccatgttcactttcagtaggtaaattttattgtatgtgggttatatctcaaagatgtttaacaaattcattgagctaatgcatataaggtatttaacacagtgactagcacatggtgaatgagcagtaaatattagctattcttaatattacaaaaccatttgcattagcagttatagtcatattagaaagacctttgcattatgttatatttacctaccagatacctaccccagtggtatggtctgaattgtatggaccacttgttggcaaccctgtctagcctgttcctcttgcccttcacctgctaggctgggttgatgagcagcattgccagtgatatccatacactgaaggcagagaagggaaaatgtgtgactgggaggcacaaattatcccctccctccaaggactggtttatgtttaggcctctggtccatttggagatttcatgtttgtgtttggtgtgtggtaggtctctgacatcattttttccaaatggataggcatctagcctaataacacttattgaatagtaattcctttttctccacagatgtaaatcagaaaaaaatgaaaatcacacatgcacatgtataacacattatataaataataattaatttgtttaactttttttggagagagtcactcagtcatccaagtcagagtatagtggcacaatcatagctcactgcagcctcgagttcctgggctcaagagatcctcacacctctgcatccctaatagctgggaccacaggggtgtatcaccatgccaggctaattttttatttttttgtagatatggcatttcttatgttgtccatgctgaataattatgaaaagccactccaggctgggcacggtggctcactcctgtaatcccagcactttgggaggccaagatgggtggatcacctgagcccaggaatttgagaccagcctgggcaacgtggcgagaccc

SEQ ID NO: 113464 - DNA, 1085 bp, Homo sapiens
gcagaccaaacgtaaggaattaatattgttacagccctcatatcacacatagcagcacatttcatggaactattaattatatctcatcttcaggtttttattagcacatttattttaaccagagtaaaaattacagtagcatttattctacttttagaataaattactactaagagacttgccactgccatactaatcacttcgatacagagtgactaccctgtgttttgttttcttcactgcactccagcctgggccatagagcgagattatgtcttggaaaaaaaaaacaaataaaaaaataaagtaaatatgaaaaataatagtgatcaagtaaaatacttggtttgccgtttatcctagttttcataatcttttcccattttttcttcttagaaggcagtttatcttttgaagtttgctaagaaactaaaaaattgtatttggagagcagaggagatatgtgttaaggtagcttctgctggcatatgaaaatccttactttagctcccacggggcaagttctccactgactcattttctctgttttggtacggcattatccatctgtcatagctgtccttcctctttcagaacacacttatggcaacagtggaagttatactgccaaaaagctttcctttgtgaaaaatagaagctaaaaaaaattagaatttttttttttttttttgagataaggtctcactctgttgcccaggctgaagtgcagtggtatgatcactacagccttgaccttcccggctcaagcaatcctcccacctcagcctcctgagtagctgggactacaggcgtgcaccaccatgcctggcaatttttaaaattttttgtagagacagggtctcactatgttgccagggctggtctgaaactcctgggctaagccatctgcctgcatgggcctcccaaagtgttcagattacaggtatgggtcaccatgcccagccaaaagttagtcttttataacagtgcaaagttctttccaccttaaataccaccttctcatcttttactatagacttgcagagagttggcctctgatgggcagctattggtgataatgaaat

SEQ ID NO: 113465 - DNA, 1026 bp, Homo sapiens
caggatggtctctatctcctgacctcgtgatccacccgcctcagcctcccaaagtgctgggattacaggcgtgagccaccgtgcccggccaagagcatacatttttaaattctcttcagggcctgcttaaattttccctcaatatctcatgaatccactgagtgcatgaccatgcagtgcagttgctcaggctgtggtccacaacaggagactggtttcttcctgtcagtgttttcacttgttattaggacatgaataatttaggcagaaataggttaatattgtttaaggctgaaaactcttttaagctactttctataattcaactgcatttctacttgtagatccagccaaaaggttgcctagaatttctcttgacaagttcttgtttcagattaaccttaactaaaaagcattctctgctacttgcaggaatccaaccacccaggtcaaacaggaggttttgtgcgagtacccccaaggttgccaccgaggtaagtaaatgtgggaaaagttagagaaaaattaatgactcagagacccaactcttttttatcaccaagattgagtgttgttggccttgaatctttttttagagataaaataatctcaccgatttcacgcaggcccctaatccactgtctgctcctaatggtaggttgtgggaatctctgctccctttttaacacagttcaactcatagagcatttatttcctcaaataaatgaacaagactcatttctgaacttaaaacagctccacttctagaatatacgtatacatgcacacaaacaccctcctggttaagaaactggtttttggcatttccgaaggagactggctttgtgagctcagaggtgactgccttctgagttccggagctattcaaataaagggctgtaatgctatcagaagacattattactatgttgaaatttatttatttattttttttttgagatggagtctccctctgtcaccaggctggagtacagtggcgcgatctcagctcactgcaacctccgc

SEQ ID NO: 113466 - DNA, 1811 bp, Homo sapiens
tgcaaatgtccttgatcttatttgaacctgtcagctcctttccccggggcctgtttcttctgaccaggttgtccttttcccagatgtctgcaaggctccctccctcaccaatccttcaggtctttgctcattgccactttttctcagagaccttccctgactacattatttaaaattggaaatctcctacctccacatcccacacatactcacaccagatactccctgtgtttctccttccagtaagctatctcctttctactttcatattactggcttatactcttaaatatttgtcacgacagtattatactctatatgattaactatttccttgtaagaataaggaaaccacagcacagaaaatatcttcaagatggtgactgagttggatgtttttattatatatgtcttaattcccagagccactgcacgcctctcactaagaatgtttgcctcgctctaaatcattgttttcctagttgctggcctgggtattttcctccctttgagaatgttgtcctgtctgcggataaaacaggaacctgacaaatcatcttcttgttataggtttttcacttgaaatggaagaagagagtgtacatttgaaaaaaaaaaaaagagagagaaagagacagagtgctcatctgctcatctccttttaatgtctaaaccaaacagtgtaaaaggtggctttagcgtccttcagtatgttacagtcattcactctcccaattgtttttgcacactcattttaattagctgtcactaatttggtcatcttggttttcttctttttaaaataagttggggctacattatcactgatgtgggtgtggtttggatgtaaaggtattgtttgtttaattgagggcaattatgttcattattcagaagctactgaattagaaaacacattgggcggatgcagtggcttacgcctgtaatcccagcactttgggaggctgaggcgggcggatcacgaggtcaggagatcgagaccatcctggctaacacggtgaaaccccgtctctactaaaaatacaaaaaaattaggcaggcgtggtggcgggtgcctgtagtcccagctactccggaagctgaggcaggagaatggcgtgaactcaggaggcggagcttacagtgagccgagattgcaccactgcactgcagcctgggtgacagagcgagactccatctcaaaaaaaaaaaaaaaaagaaataaaacacattgaattatttttggatgagggagtgttggatacaccacctattaagaagcagcatgccttatcaaaatgaacatggacttttaggttcaaaacaatggatctgacaattactagcaataagaccttgggtagtgcatttattttcttcttagcttcagtttcttcatctgtaaaacaggtaggatattatctagtgtagcactgtgcgatagaactttctacaaagatagaaatgttctttaactgtgctggtagccactagtcacagtggctagtaatttgaaatgtggctagtgcaactgaggaactgaaattttaatttaatttaattttaattaattaagatttaagactaaatcatcagatgtagctactagctagtggactggacaaatctagcacatagatcttggttggagaaatgtatgtaaatatagagcctaacttaattcctggcacataaaaggttctcaacaatgctggctgctgttgaattgtttagtattattttcactctctataaaaacatatagtaaaattaactgatgttgactaacacatcaattttctgaagtttgc

SEQ ID NO: 113467 - DNA, 1036 bp, Homo sapiens
gagtgggactctgggactgagaacagactcaaggtgacctccaaggaaggactcaccccataccctcccctgcaagaagcgggaagcatcccagtaaccaaacctgaattgccaaagaaaccaaaccctggccttatacgaagtgttaatcctgagattccgggaagagggcccctggctgagagctctgatagtgggaagaaagtgccaactcctgccccgcggcctttgctgctgaagaaatctgtttcctcagaaaaccccacctacccttcagctccactgaaacctgtcactgttcctccccgactcgcaggggcatcacaagccaaagcatacaagtcactgggagaagggcccccagccaaccccccagttccagttctgcagagcaagcccttggtggacatcgatctcatcagctttgatgatgatgttttgcccaccccatcggggaacctggctgaagaatctgttggttcagagatggttctaggtgagtgaaaaatcagcagtggaggggaatctaaactcatgatagggtattttaaatggcacttgctgttttagtttctggtacataagttattgaggtgtgtgtatacaagtatgtgcacatgcatgtgtgtgtatagaaacagaggaatgaacagacagatcaagaaacatgggagctatgtggggaatggagacagggagggaagggaaaatatgggatgggggtaatggagtcagaaatggggagacacatgcatcgattactattatatgagccagaagtaagcagactggggctaggagctaaactataataggttgtggggctggctccccttactcttggcagatagaagttcagacttcacattgaaaggatccagggaggttatggaacatgtagaaggatgcagaggaagcttctcttagatgggaagtcatgcagtggccccagaggggctcctcagatgaaatgggcctcagctgggagtgctgggagaggggccagctccaggggaggactcgaaaatgtacggaa

SEQ ID NO: 113468 - DNA, 1026 bp, Homo sapiens
catgaatctttgaacatttatagatagacaatagcttgttaccattctgcaaaacctcactgaggcttctgtccactaggcgcccagagatcaccattgtggcagctgagccactgaggccagcctcgtggtttccaggaaccccacccccaggactgggatttcctacatcatctgcagcaggctcttggaggcctaatgagctggttcctgctgaggtgaataaacattacattatctctttgcattttattttttaaatgaaattggaagataagaacagtgagactgtcaacaccttagctattgcccttagatgtctaaaatcttcattctttacttttcagctcccaccatcttatgaacaagttataaaagaaatcaaccaagttcaagttaatactacaaataataataatgctgctgctactccaaggcacactattacttctgcaactcagactgacttttcagaagaaatagacaacgatctgcctcaaagtaatgcaagtaatttgtcttccctaattctgacctagttctagggaagtaatccgtaggcttccagcctttaaaataatttgcaatttgtgcataattcattgagctctgctgcccagtcagtgtgatcactgtgtgcttgctttatttgggtgtgcagtgatgattataatagatcattcttacaaactgcagccccaatctcttgagcttaccctagtttatatcacaaaaacattatccgtataattcatggtgggtattaccattgattccctttattccctctgagaaggatcttatatttagcaacttatacttgataggatgctaagggtggttgtcctgttaggcttttttaaagtgttgcactgtggcttatgcctttaatcccaacgctttaggagactaaggcgggtggattgcttgagcacaggagtttgagaccagcctgggcaacatggtgaaatcccatctctgcaaaaaaatggaaaaattcgctgagtgtggtggtatgtgtctgta

SEQ ID NO: 113469 - DNA, 2018 bp, Homo sapiens
ttgagaccagcaacatggcgaaacctcatctctgcgaaacatacaaaaaattaccaaggcatggtgtcatgtgcctgtagtcccagctacttgggaggctgaggcaggaggatcacttgagcctgggaacttgaggctgcattgagccctgaacatcatgtcactgctctccagcctgagcaacagggtgagaccctgtctcaaaataaataataaaacaacttaaaggttataaaatgtcagataagttagacaaaagatgaaaatttgaccagtttcattctacaatagatttataaacaaacatcacaaaagcatagtcatatagattggaatcgatatttaaaattttttctgcccattgttacttcatgtcatcatcttaatactccagccatgcaatttatatttaatagctgtcttcttttctctgttcattcttcaaactattttcacaactacagaatgttctttggggagtttttgaaatctatgtattatgcaatctctaatatataaccataattaactttatgctaataaaatgattgttttgatttacttttttttaaggatattaaaattcatacattctatatgatgtcaagtataagctttttccaattgtgtactttgtaaaaatttaaacccttaccaaacatactaattttgtactataccagtttattccttcttcaacagcttctcggacttctattcagagtgaacttcatcgagatagaaggtatggttatatttataatggaggacatatattagactaataattgagtaaaagtgtgttatcaggtagcaaattaaatgtttcactttcataagcaatgtattcttgtattctgcttcatcaatatatctcctgaattaacttataagtttgaaagatgattttgcttgagagaaggagtgatacaggcttgaaaatgttcttttgagtatagttatttattgaagttgattttttaaatgtttattaaacagctgttacatgtaaagcattgtaactgcttcagagaaatgctttgtacctcatgctacttagtacatgttgcctaaccaaatggatggatgacaggatagaaaattgaatggaaggataaagaaaggaaaagaggaggtaggcacaatgaataaagcctggatggctttttggaaaaaggaagggaaaagagaagggaggaaagataatatttgggtagatagaaggaaggaccagtggacagatggacaatagaatggacagaaggatggatggacaaatggctaaatggatggatagattttttttttacattacatcatgacattcaatcagatagagaggttttcataagtcatggtccctgctgtcaaattgcttacagtatagtatagaataatgaaggacttcagagtcagaaccaaattcaaatcctgaccgccactttcctaccatgtgaccttggatgacaagctgcttaatctctctagcttctttatcccagctttaaaatggtgctaatcatacctacatcacaaggttgtcataagaattaatatacatatgatgcttaacgtttattaactaataactcttactatttagttagacaaaagctataagcaaaggttcttaggaagtacagttcaaattttatcaatgatcaggttctactgtttcacaatgtagcatgagtatgtgtgtaatgcataattttgagaatgacagtgcttttttgtttttattttccatagagtgctagagaaaggcagagcaggtattatcatccatgtatgttccatgagaaaactgagttttccaatcaaaacttgattgatttgttcagggtcacacagttgctgtttgttaggaaatcaggtttaagagaaaatttaaacatgctccaggcacagtgccttacacctttaatcccaacactttggaaggattgcttgaggctgggagttcgaaacctgcctgagcaagatagtgagcccttgtctctacaaaaaattttaaa

SEQ ID NO: 113470 - DNA, 1006 bp, Homo sapiens
catttatttgtatatactccctgacatgttatattttgtgaataaatcccaggagtgataaaagtcttaaatcattttctgatactatttaagattctgccccctttcctccaccgttgcttctgatttaactcttccagccatgggatgttcagtgaaagaagacagttcttaaggttctttggtaattaaatcacaattctcacctaatgtgttttgtgtgtgtgtgtgtgtgttttcctctcaacagtcaactgtatgtgaactttttgtgagatagtgaagcacagtagcaaagaactctggccctgcctagagtcagactgtccaagttccagtcctgacttcaccatttaccagctatgagtcctttgacatttaaattatgtaaactcttttttcatctctaaaactgggatgataacagtaccttcttgtacgggtggatgtgtggattaagtgagttaaaagatgtaaaaccattagtgtaggtcaattagattagctatttctttattattattggaatggattaaatatcaagtccagctcccttactgcagttggattaagtaattgattcttattaaatgaatttaaattggaatcttggagtgttttaagtttcatattttaaaaattttagacctagtgggtagaatagagatcatccaatccaataatgtcatgttacagataaggaaactgacatgtgattatactcatggagtgagtaaaggcagagctgaaattgggcttgtcagacccccagactcctcacacagttcacgctctgtctgacaaccatcagggggatggtcctacattctctgtgtctccaagaattcactgatagcctaaaacaaacagatgctttatgtacaaagacaggaatgccagcaaacaatcttcaagtgtagcagaagatgtgaagattgaagcagagatgatgtggtttcagagagaaaggaagaatgagagcttgcacaaaaagccgccgtgtttc

SEQ ID NO: 113471 - DNA, 1019 bp, Homo sapiens
tacaaaaaactagccaggtttcgtgccgcatgcctgtaatcccagctacctaggaggctgaggcaggagaatctcttgaactcaggaggcagaggttgcagtgagccaagattgcacctttgcactccaacctgggcaacaagagtgaaactccatctttaaaaaaaagagagagataaagatttattgcagggaaatatttatgtgattgttggagctgatttaggcaagtcagaatttcgtaaggcaggccatcaggaagggcaggctggaactctcacccatggagtgaagctgccatccacaagtggaatttcttttcattatggaagcctcagctctgctcttaaggctttttaactgattaaatcaggcccacacagatttcatagaataatctcccatactataccctgataaagtcccatcaactggtggactttaatcacactgacataatgcctttatagtgacgtgtaaattaatgtttgattaaataactggagactgtagcttagccaagttgacacatcaaattgattatcacagttgctttggacctcagttaagcaggctaaacccacttggaaatgattttcagtgttatctctgcttttcaaggtcagggctcttcaagtctctgtaacccagaagttctttctgacatatcagtttgatgtttgttagttttgtcataagaaactacaattgcattattattgtcctaaagaattctctcaactcaagccagggtgtgtggtcatggtgggattctgtgaaggagcataagccagcatctgcataaacaccttgatccaggcggtatttgctcttatacatttgtgctatcccttcgtgcttggagaagcacactattgttacatatgcctgctttgtatgaactggtaaagtctggagttgataggaactgttgagtagtcccacaggcctctgtcatagtggcaaaatattacctttggctacctgaagaaaagatacagatttggtcctctcttttc

SEQ ID NO: 113472 - DNA, 1070 bp, Homo sapiens
tgattaaacacttcagattttacctgtacttatagacctgctcccatgtctccttttactagaagcatcttgtatttctctgcaaatttttctcttttttggcacttaagagttctacaactaacacgtgaaaacatgttttaatagtacagaaacatgtggtatctgcctttatcccataggtgacttaagagtggtggttcagtgtctatcctagtctgctttctatgcatatatatagcatatatttaaataatatttagaacaaatggggatatatatatgtgtgtgtatgtgtagtatgtgtgcttatatgtatgtttgtatatctgtatacatatatatgtgtttctgtcaatttgacttttttaacttatttagaaagtattaccatgtcagtttccacttcattatttttttaactactgcataaaattttccagtgtaaccttattataatttatttaaccagtcctttaggttgtttccaattcattgcagttagaaatgatgttgcaataagcatctttatgttcatatctttgtgtatagatgtgtaggaaaacctttattgttcttccaagatagattttttttttgttttcattcacaattacttttaagtttttaaattttatgtgccgtacatgtctgtttgcttcccaaatctcagatagcttcctggtgtttggtactgttccaagttctctagagcccattacaacttccctccccataatgtggcctgaaatgtcacccagcacagggagagactgaaactcaacatgcagaatatttgtagcacatagtttagtactctcagagttaatagttggtgatgttaaaactcatagcaatcactatatcattacgaatttaaaagggtcttggttctctgcattggtatccttttgttgattttatgaagatgttgaagattttattttgacactttaccatcatcacattgtggtttaaatagattagctaaaagcaaaagatttaacttgttttagctgttctcttttctaagtatgtctatcaaaataccatgctctgctggggttagt

SEQ ID NO: 113473 - DNA, 1034 bp, Homo sapiens
aaattggaaccagaaatgtgctaacactatgtgtttggaaatcattatatctaagcaggcatgctttattgtgaatctttttacttattagtctttcagagaacagtgttttcatgagtactaactctttggctttgaaaaacatttcttttttattatgaactcattcagaaagaattgttacatacgtttaactgtgtaaatcctattccttttcttccatatttctttctagaagttttagagtatgtttcataatcctcttattctgttctaacagcaataaaattaaggaaaaactaaaagcattcctgtcttaatctttacgttgccattaaattctatcttgttagcattaattcagaagatactatagaaaactgtattttgataatattccataggattttttcttaacgtcattgcttaggatatattgtggtttgtatattgcttcatattgtttatttttgcataacactgcggccttttacttcatttatttttaattcttaagcatatagtggaggaaaaattgttactcaggttcaaaaaagacaacctgtgggttttatggttctcttgtatatgatagtctcaaggttgattaatagcatgttacagcagtctagagagtcacttttgaaaagttcaagcatctgtgctcttatttcttaccctatagcagggtttctcgacctctgcactgctgacattttggatgagataattcttttggtgaaagggaccgctctatgcattgtaggatctttagcaacattcctgctttctacccatgagagttcccttcttcccagttgtgacgatcaaaaattttatatagagagcacattatatctaattactggagaaacattgaaatccaacttctgaaatgttctgggtggtagatagttaagggtgaagctgtattggtcttagtatttgcagatgttgtagctgactgctcatttttccccctccccattctgttagaagcttctgccaaccatgattcatggaatgattttttt

SEQ ID NO: 113474 - DNA, 1594 bp, Homo sapiens
ctcccccaattaatttgaaaattagaaactaaaaaattggaaggctgagcacagtggctcatgcctgcaatcccaacactttgggaggccaaggcaggaggatcgcttgagtcccgaagtttgagaccagcctggacaaaatagggagaccctgtctctacaaaaaaaaaaaaaaaaatttaattagctaggcgtggtggcatgtgcctgtaatcctaactacttcaactacttgggaggctgagatgggaggatcacttgagctcaggagctcaaggctgcagtgagctgtgattgcaccactgcactccagcctggagtacagagcgaaaccttgtctcaaaagaaaaaaaaaaagaaaagaaaaaattcagagaatgtgctgaagagtatttgatttaaaataaaatccatacacttaaagcactatatatagccaagattaaatttccatgtttgctatagatctgttctcattcttgggctttcatccaaatgttttgttattgttggcaagaaagcagattctgaatccaccctcagtgatttgttttgttcagtcttggcttttggaacaaaataataaccacttattattttgccaaaaaatttatttctactaatatatttcttgacaattgcacaataatcttgactatcatgaaaattactttaaaatgtaagtatatgaaaaagtataagtatataagacacacagatacgcaacacacaccccattatttatatgtatttaagctaaaagatggctttatggcaaaatgtgaaatccaaatatttgtatactttgagggaaaagatcaagccaagaacatgtgtttcaatttgtttttcatggtcaagaggtgagggatgggaaatattgtgagtaatggataatttacccttaccctcaaattatcaactatgtgaattcttaggagtaacattttataagtactgcgtatctatatttacacaggaatgtaacacagataacactaatagtgaatttggggggaaaattttaaaatttcccccagcagataatcaagtcttttgttgaattttaattactggttcaatagaaaagtgctatgagaagacatttgtattttcttagagcagaaagtataaaaatgactgtagaatttcctgttttaaccaagaacgaaggagagctgtgagccatttgcttcctgagtggccacattccagctgtgcagactggtcatagcacatctgccaatcagaacaggccctggagggaagcccttggatactgagtcttgtttacatgcatcgtgactctgtttctcccttcctcttgtgtgttgtaccactaggaagattagtggggaaatttgctattacatgcctaagtaaactatgtaactaggatcacagccacaggaaatgatgttctggacagagttttagctcggctttagccacaggtaagagttgttgctttgttatatgaggatagctaatctgtattcagtttctggctttactttgagacattatacttcatttttgtagcgaagctagcaggctaaaaactggagaatgattgagagaaatgatttaaatg

SEQ ID NO: 113475 - DNA, 1594 bp, Homo sapiens
atgctgaattagcatttcaggagaagtataaaagaatgaatgatatggacctcttgaatctgtttttcttggctcttaatttttatgtcttctatctctgtgtttttgacttgtgttctttaaaattctgtcaacatattttttagattacatttatctatgtctgttccacagaagggaatcctttgtgtagcttcctatgcttcgtcgtcgtaattgcattgcttcccacccctcccaaaacagtacatttttcattacatgaatattatgtttttagtaattctgcaattctgaagtagcacttcaaaatgcattctttccaaataaaaaatttttgaagccttgtggtaagcacaatacttcttctctatgaattaatagcatccacccctaaaaaaaaacaaaaacaacacagaggctttttagctcagctgatctccagcttgcagaggtgtggagaggactcataccagtatattcgacaacagacacttatgttgtacctattttgtgtaaggtgctctgccaggcatttcaagggatataaaggctctgtcttaaagaaccttatcgtagtggaagcaataagacataaagaggattataatgtgagtcaaaatgtggtaagtgcccataggtgctaagcactgaatatatagatgtcgaggtggagggcattatttctgcctgtggaagatcaaataaggcttcaaagtaaaggtgacagatgtctccaggtgtctcttctcactcaagaattctgtgaatctttagaactgtgaaaaatcagaattgggcacttactttagaagcattctacacagtgagtaatagaatgaaacaattgaacattctctttgtttgtatttctgtatcattttgaaagtgttgtctggatggaagttaatgaagtggagaggaaggacaggggtgggcttgaatttgcaacagacgttgtgttgtacagagaatacattccctatcctcaggtagtttgtcaaggcctggctgtggctttacctcttcttgattggaagaaaaagatttttttttcactctaatgtagagtgataattctacattagagaccaagactgccccactgtggataaaaatctcagttagaagtcacagatcggaagaatcctcatccaagcagaaaatgttgccagagctgagtgttcttataccagagggaggtgcctggtctttggagcccgtgaaggagtcttttggttacagcagtttctgatatttgttcattttgcagggtcagctacacaaaggtataactttatgagttctgtggcacaaacaaaactaatggaagagaagacaataaaaagtgggccttttgccctttaaagaaaataaaatctttatttttacccttaacagctgaaaaccaatgtgtagagatgttatccgtcctttggcacctgaaatcataattttaatttttgttttctgtattcttgtctaagaattccatactatcctgaaatatgggagattccagtaatttcataaatagataaaaaaatttacatttaatctatctagttcctttctttatgccactctttcatcc

SEQ ID NO: 113476 - DNA, 1058 bp, Homo sapiens
ataaaaattagctaggcatggtggcgcgtgcctgtaatcccagctactcaggaggctggggcaggagaatcacttgaacctgggaggcggaggttgcagtgagccaggactgcgccactgcacacccgcctggtgacagagtgagactccatctcaaacaaacaaacaaaagactcagaagaccacactggaccaatgcaaagccatccaataaatttgaatttagatgacttttcagctacagtaaaccaggaatgtttatggtcttttacagggaacaggtatgaggaatatctagaaactctgggcacagttgccattaaagtctggaaagtagaaagaacccatctctatccaggcttcacgctgctaagggaggagtcccttttccttaatcaagcattgatgtgtaaatcttgccagacagtgtctcctcactttttcccctaaaaaaaaaattaacaaggaactgaatcagggaactcagtagttagttacactacttaattaagacttgaacaaattaatatattagtgatttttaaaggctttaactcagaaaggtcagtagtgataaagctcctaagcaacttaattattattattattattttattttattttatttttttgagatggagttttgctctgttgcccaggctggagtgtagtggcgtgatctcggctcactgcaaccttcgcttcctgggttcaaatgattttcctgcttcagcctcccgaatagctgggactacaggtgtgtgccaccacacccggctaattttttgtatttttagtagatacgagatttcaccgtgttagccaggatggtctcttatctcctgacctcgtgatctgcccgcctcggcctcccaaagtgctgggattacaggcgtgagccactgcacccaattatttttatgtatatttgaattctctacaacagagaaatctgtttacctgtcatttttgctatggctatgttttagagatagctacacccagtgacacttggttaacatttcaattcaatattggaaacatgttttatgtacaga

SEQ ID NO: 113477 - DNA, 2644 bp, Homo sapiens
agttggaaagaagttttatgtcaatattcaggtttttgggatctttaaactttgacctattttggaaagagggacctgtaatagtatatgtttaatacataatagtacagatttagagttaatagcatttttcatttgctcgtgctaattctatacagaatattttatttatgatctccatccaattaaaagtcacatttcttactgatcacttgataactttctaatacttctttcacagaaacatttgaaaacaagtcttaagtatgaaactagaagagccaattataaatcttttattgaactaagaaaatatttttaaatattgtgacttttacagatacaatcaatatatacctaacatgaagtgtatggacagactctgaatacgtgtatgagtatatgtgtgttttgaatacctttattgtgaatttatacttgtcagcacaataattacatacccttgagtgttttatagttgggcattcatgtaagtacacatctgtttaaatctcaaaacaatcttgcaatatgcacttaaatgtttttgaggctcactttatgtctttgagtagaagaagaaaagtaacagatggccaacaaggatattgagttgacaagagaaaaacttaacttagttactttagttcctgaatttaaaaaaaaattaatcagtataaattcactctaaggaaatcttgggagtatgtttccattgaagtgcgttgtttgcattttgttttgttttgttttgtttacaagggggtgccaggcagggaggagggaaagaaagaggtaagaggaagaatatattggacacctatctagtggttgttggacctgaaatttgaacccatgtgtatggcttcaaagtccatgcgccttccacttctccaagagtttgctttctgttgacctttatcagtggaagaatttctcaatgctgagagcaatttttccaatactcttagatctaaaaatgctactgactggattattcatgtttgaacatgtaaaaatattttcttgttaaattaagtttaatcttatacttaaagttcgctgtgttatggagagaactttgaagcaagaatcagaaatcaaataacactaatgcttcctaattagagaaatctctattcaatgcaaactaaaaatatattggctggtgttctaatcagctgtgcttaattctaagcactaaattctgaacactgtgggtaaaacactttgttcatttcagaaatagctagacttttcctaaactctcattaggaaaaatagaagaaattaagaaaataaagctgggcacggtgacttacacctgtaatcccagcttctcaggaggttgaggcaggagggttgcttaaggccaggaattcaagactagtctgggcaacatagcaagatcccatctctaaaaacaaaaacaaacaaacaaaaaaaaaaaagtaaaacattaaaaaataccttacagtttgaaaatctggtcaacatgaagtaaagaataacagcaatgtcatctgtaggcagggtggttattgtgatcatattttgatattagcttcctattgcttgctgccaatggggctgtaaggaatatgtgtttatggaagtctcagcgctgatcataggaagatgaaaacagtcatactgtttgttttttccataagtaccaggtagctttaatgagctataagaaaattatactatttgtgcagagtaccacattcaattcttaaagttaaatattttttatatagtatagtcacattatatacaatacatccaagatttatctccgctatcttatttaatccacataaaataaacatgtctgtttatatacattaaagttatagagctgaactattaaaatggaggagctggtgatggcagcagggattgactgcaagtgggcacaagcgatctttctagagtgatgggaatgttctaaaatgatctcattgtgatgattgcacaactctgtaaatttactaaaaattatccaattgtacatttcaagcaggtaaattttatggaatataaattatatgtaagaatctgtttaattttttaaaagaaatagaaaatatatgactgtatctgactccagaactcttagaaaatctgaaagaacagttattattgatgaaacaaagaagttgtcatagagctaccctcctttccctctccttcagagtttgcaaagaaattctaccaaacttttaagaaacagattattctaatgctattttaactgttctagaacatagaaaatgaaggaaggcttccagttcgttcctttttatgaaggtgaaataacattgatattgaaacacagaaaatatatttctcctaaaagaagaccagggaccaattttgcatgtgaatattgaaacaaaaatctgagagaaaaattataaaaattttatcattttatagaattcaggatcacatttgaaaaataatacacaaaagaaaaataagaaaagtaatacacaaaacagcaatatggtgtaatgctaaagagtttcagctctggagctggactgctggtttggaaccccagcaccgtcacttcctagctccatgaccttgggcaagtttaaacatggatcaatcctatgtaaatcttgtgcca

SEQ ID NO: 113478 - DNA, 1026 bp, Homo sapiens
aaacaacaaaacaaaagtgtaccatacaccttatatcatcagataataagaacaatactctttagtcaggagaaaatttttccccattgtaaaaagcacattggttaacataatatgcagttctataggggactgagaaacattcctcattttttatattgtctctcaatgaatgcgaacaccatcattttgaatcatgattaaggcatttctgtgaagagtgaaactaatttaattgaagtatttatatttattgttatgtaacttgaaacaaaagtggaacctaatagaagatgtctctttcctctttcaaatacttctgcttccagctgtgctttggcaaggcccatgttctctcaatggcctttggactttctcgacattttacataaacaggaatctgacttgtatttctgcacctgtgggaaggatagttccagagccaaaagtatcaaagatctcaagatgacaagtctcatatccccctatttagaagagaatggataaggcctcaggacagaaaacaaaaataatattggccataatgcccagaagttgatatgatattaaagtatacaatttatatatagacaattacaaactctagagggagaaagacagtttaaaatctttattataattcaaggctctccctctccctctccctctccctctccctctccccctctctttccacggtctccctctcatgctgagccaaagctggactgtactgctgccatctcagctcactgcaacctccctgcctgattctcctgacagcctgccgaatgcctgcgattgcaggctcgcaccgccacgcctgactggttttggtggagacggtgtttcgctgtgttggccaggccggtctccagcccctaaccgcaagtgatccgccagcctcggcctcccgaggtgcctggattgcagacggagtctcgttcactcagtgctcaatggtgcccaggctggagtgcagtggcgtgatctcggctggctacaacctccacctcccagccgcct

SEQ ID NO: 113479 - DNA, 1044 bp, Homo sapiens
catgctgcctctgcctgaagtgtcttacttgacttcaagagattctctggttcatcctcatttgtcagttttggaagtaaaactgacaagaatggtatgtgcattggatgtggaaggtgaggggaagtgaggtacaatatttgtcttgagtaactggttatattgttgaatgaaatggggaagacagagtgagacaaggtctcactctgttacctgggctagaagtacagtgggatgattatagcatactgcagcctagacctcctagtgggagaatggggaatatgggaggcactcttgatggattcttgctgctacagagggtcctcacccatgccctgtgcagcctttcctagtctgaagcccctgtccctacctagggcttaccccattctgggggctcacccgaaatccccagcagaaggagcagcgtgaatgcatagccagcagtgcccgtgtctctgtcctgagggccagcactccctgcccctggactcaggatcccagggagaggccagtggggaacacccagagaagggggagcagaaccatctcctcctagatggactcctctgcttcaccccctcctctcctttggtcttcaccccctgccagatcctgaagggaccagacttcagaagtgcagctccaggacccaagggaggaattggggggtctgcggcgtcccctgctgtcctgggagagcagggtgtctgggattcagcctgagggtgggtgatgggaggtaagaaaaagggaaggttggaggtgggcattggaaggagcagggctcgctcagtgcttagtgaccctggtgttgaacaagtctaagttcacacacttccctctgcctaaactgccacatctcagggacctgccctggtgtgcccatttaattctcccctgaccaaaggtgaaccaatggagggcagatccctgatttgggatctcaaatggctgtgcagactggccaccctaggtccttggcctctagaatggttctgacaggactgacaggagaaaataaaggggaaataaaccagt

SEQ ID NO: 113480 - DNA, 1035 bp, Homo sapiens
gtccaaaacaacaacaacaacaacaacaacaacaacaaaaactgtagcttccattttgggtgttctctattgctctgtcttggatcattcactctgggagaagccagctgccaaaggcattccttcagcgaggcccacatgaatggtaacaggcacatgagtgagcttggaagctgatcctttcctagttgagccttgatgactgcagctgtggctgacacagcagtagctttttgaaagatcctaaaccataactaaccagctaagtcttccagataactgtcctgcagaaactatgagataataaatgttcattgttttagctactgagtgttggggttatttgttgtactgcaatagataactaatatactgccggggctcctcctccggcctggcccgttttatctgaaatcttctaatcttccaagtccctactttttcctcagaatccagtctaatcccagggttggatggttttcatcttggattaagtaagtggcaaactaacctctggaccccagcatcttcacctatagaatgtgttgggctaagtgatgtccagattcctttaaccctcaagttctctgcttctgcacttccccaggctctgtcttcaatttcatcaaaagaatgaatataagaactaatttgttagaatcaaccaaattttattcactctggggatcttgtttactaggctgacttgtgcgggggaaaggcaacaagcaaattaggcttatgggacagcagaactgcgtctgtcttgctgactcttcaaaatctgtcttcagaatcctcaactctggaatttcctttttctctcattctcaactgtcactttacccagggcatactgacctcagccagttaaggtggcctcaggaaaatcagaggcagaagcataataggcaggagcccagagaggcccagactgagggtagcagaaaactcagcaagcgagatgggagacttctcaatccaagacttgtagaaatggatgtttgtgtatattccaggcccactggtttggat

SEQ ID NO: 113481 - DNA, 1906 bp, Homo sapiens
ataagtataagggggccaggcgctgtggctcacacctgtaatcccagtactttggaaggctgaggcgggtggatcgcttgaggtcaggagttcattaccaacctgggcaagggcaacatggagaaaccccatgtctctacaaaaaatataaaaattagctgggtgtggtggtgcacacttgtaatcctagctactccggaggctgaggcatgagaattgcttgaacctgggaggtggaggttgcagtgagctgagattgtgccactatactccagcctgggtgacacagcaagactctgtctttaaaaaaaaaaaaaaaaaaaaaaaagaaaagaaataaaataaatataaggattaattgatcattctattaaaaagcaaacttatgccttgagcttggagtagtatcggataatttgtaaagtgccttccaactgttatattttgtgattttataacctccttttatctccttctattttttggctccactatctagatccatcatcttctctcacattctatcctctttttttttttttcaactgatttagcatcccacatgtgtagtgagtttaccttttcttttgctgaagcattttccacagtgtcaagtatgccttgtttgaaattctgtggtgttgtcatctgcaaaaattctaacaagatgttactgacataaacagtatgcctttgagaataaattgtaatcattctttatcctgcttataatttgataatttttgcatttgggaatttgtttttttctgaattctttttttatatgtatggaaagctttttaatggcccacatttaattaatttattattatgtaattaccttttgtgattatttatgaaaattatcatttttaaacaatgattttattagcattcaattagaatgaggaatattcactttgcagttgttcattccactgtcttgccaaaactccttccttattttttattctttattcatcaagtaatgtagagcattgtgtctattattgtattttaatccgcatcctatgaaatccaactcagctctggtcagcatcagatcccatgtttttaaccattctttgtatatcagaaaaaaaggaaaaaaagaaaataaggcagcatatttttcatatgaaacatgttcttagactactctgattgtctacaggatgttacattttggaaatatctctagtaaacaccttcattaacaccaacacacctgagaacacaactataaaatttaatccatgactactaaacacagtcagccttagcttctcaggctctcattccagactcttcctgtactctctgtttgtgaagacagccttcaagatggcctccaatgatcttcagctcctgatattcacaccttgttgacttactactaaagaatagaatactataagaaataatgagatgttagggttttttttttgtttggtttttttttttttttttgagacagagtctcactctgttgcccaggctggagagcagtgacgggatgttggctcacccccagctcccaggttcaagcgattctccccctacctcagcctcccgggtggctgggattacaggcgcccaccaccatgcccggctaatttttgtatttttaatagagacaacgtttcaccatgttggccaggctggtcttgaactcctgacctcaggtgatctgcccacctcagcctcccaaagctgggattacagacgtgagtgagccactacacccagctgagttgtcagttttgagattaggttataaaaagactgtggctggccaggcatggttgcccatgcctgtaatctcagtactttgggagacgaaggcaggaggatcacttgagctcaggagttcaagaccaccctgggcaacatgacaagactttgt

SEQ ID NO: 113482 - DNA, 1046 bp, Homo sapiens
aagtctacagtagtgtactatcatgtcctaggcgttcacattcactcactgctcactcactgactcatccagagcaacttctattcccgcaagctccattcacagtaagtgccctatataggtgtaccagtttttatcttttataatatatttttactgtaccttttctatgtttagatacataaatacgtcccattgtgttatagttgcctacagtgttcagtacagtaacttgctgcacaggtttgtagcctatgagcaatagactatagcatgtaacctaggtgtgtagttggctgtatcactgagttttgtgtcatttcactctacgatgttcacacaatgacgaaatcacctaatgacacatttctcaggacggatctccatcattaagcaacatgtcatgtacttagcatctgttatgtcagggccaagccttggacaacctttcacagacaatcttctttctcttcctggctgtttgctttattgaccagtctacaggtttccctggactgcactcatctcctccacagggactaatctttctctgagcaccatcctacttgcttgaaacactaatgccctttaaaaccagtccccctttacaggggggactggttattttgatcaccaactaatgcacctgttcttttggtcactaacaaaatacatttccctttttatgtttattcacttctcatactaaaggaattcttccctatttttttgacagctggctttctatagtctatagttctcattttgttaattgaaaaaaacaagatttgatactttgtttgcaggatactacgtgttgttagaaggtcaaaaagatgaataggacattagttaattttctcaagtctgtttttatctattcagaaggaaaaataaaagctatgttcactcaaggaactacaaatagagataagaagtacaagaggtacaaataactagggccaaagggcaagtgttattttggtgtaatgtaaggaaaaaccttatagctttccaacaatgaacggaggtaatttggtatagtg

SEQ ID NO: 113483 - DNA, 1043 bp, Homo sapiens
acgttatctttaaatacctctgccatacacaataaatataataataattgctgcaaaataggaataataatatcccacaagattttcataagaaatgagatattatagagttaatacttagcttgggtttggcctatttagcatgtgataattaatggcagctgttatttttattattgttgttattgaactcatttctcagctttaagtatttaattctacccaaacagtttatcttggtgatggcttggattgatgttgatggtacctattgaccagggcttctcaaccttggcactattgacattttgggccagatgattctttgttgtggggtagctagcctgttcattgcaggatattaagcagcatccctaatctctacctattaaatgccagtaatacctactacacctagttgtgacaaccaaaaatatccccagacattgccaaatgtcccctgggagaaccactgctgtaaagcaaagatgctacttcaagaattcagtcttcttttgagcaccctgaggataaaacagggaaaacaatagatttgcaagttttgtagctttttatctgtattaacagaaagggcaaatggacaccattgtctgttttctaattcaacccatcaatcagtctactatattggaaaatgaatagctctccttataaaacagtctcctaaagaatatctgaggccacgcatagtggctcatgcctataatcctaggcctttggggggtcaaagtgaaaggattgcttgagcttaggaattcaagaccagcctggacaacataatgagacccccatctctacagaaaaattaaaaaattagccaggcggggtgttgcatgtttgtagtcccagttactcaggaggctgaggtgggaggattgcttgaacttgagaggttgagactgcagtgggctatgattgggacactacactccagcctgggtgacagagttgagaccctgtctcaaaaaaaagaataattgacttctctagtacgtgtatatcaggccttggcttttgccttt

SEQ ID NO: 113484 - DNA, 1022 bp, Homo sapiens
gaaccctggaggcagagcttgcagtgagccgagatcgcgccactgcactccagcctgggcgacagagcaagattccgtctcaaaaaaaaaaaaacgtatcttgaagtcctaaccgcacttccatacttcagagtatgacaatatttggagataaggtctttaaagaggtaattatattaaaaagaggtcattaggttgggttctaatctcatatgagtgatgtccttagaagaggaaatgtcatgtacgtgacatctatagagggagaagacagctatttacaagcctagggtgcctgaaacaaatccttccctcatggccctcagaaagaaccagccatgctgataccttgatcttggacttccagcctccagaactgtgaggaaataaatttctgttggttaagttcgtctagtctgtggtactttgttacagcagccctagcaaacttatgtagatgtctatggaataataagaacaggataacagggacacctggagctgccataggacaaccctgaagaccagagctggaaaggagctctggattcatgacagcttaagagctcatagcaggatcttctctctggttctctgctattaatatggctcaaccgaattccatgtcatttctttctgtcctactataaactgctcaagttgttccctattttcagttcagactcccaagacgtcttatttggcacagattatcttttctaaccaggatataggttcatggccatggattaactgtccttggggtaagtaccctcatatgggaaggtgagaagatggggatgcagaaatatggccagctcagttgcaggggctattgtggcagggcagatgccaggtttgctatatctcagtaaagtagcataaagatgtttacctctttaaatacattttaaaagattttagaagtgaacacgtgaaaaaaatctctccatttgcttttttaagcaaacactgcaacaccatgaatttttaccaaatttatgtttttaaaattcatttgt

SEQ ID NO: 113485 - DNA, 3177 bp, Homo sapiens
gaatccaaaagcagcttacaatgcctttccaatcatatttgcttatgggtggatcttttggtacacttaaatctaaaactcagtaattctaaattatttctgcttctttgaggtttttttttaattgagccattgttctaaataatgagtacttccgataaattctgattgagtaaaggtatgactattctaaaggattctaaaacttcttcctttcccatgttttttgcttctagatcagttcttgtcttgtgtctactccaacctgggaaagagttgacgtaaaacttgaaaaacagttaaaaaacactagacgctctccaaactttaaatcagtcttattaacctctgtttgagagaggtagttatgtgtttaaattgttagtatctgctcttccagctatagctagactctgcaagatgcaagagtaaataacataaaaatataaatgtcaaaaaagatattttatttaaaaacttatagataatatcattagattgatctggttttgttgaaaaatattttccatggtaaggatatgcctagaatatgaatgttctggagtacaagaggatgacatatgaaacaacccttctctctgcccattctcacctgaactttccttaacttttccccatccggtcacccaacaaaagggtggaattgccaactgctttgtgacactgggcaagcaaataggcaggatggcagaagtgaaggtgacttgagaggacagtttcaacaaggcgacgtctgccgttgtatcttggtacttgggatggatgacgattttggacacgtagtacttcacacgtttccttgagtcacctactgtaatcgatcctagccacacagtatatgaaaaagtagtccaggtcctatggggaaaagaaaggaggcctgcttatggcctgcagctgggtcagaacaggctgcctatatgtagcactaagtctctactcaagaaaggagggtagccaactgggaattaaccatggtgcttccaacttcaactagggttgatttgtctccttctttcctctctttctccccgtccttccctgaccactctttctgtggtctcttcctagaggcttgtggcttgagttttgccctgtgttttctctccggttctctcatttacctctcccattctccatggtttcagccatcacctgtatgcttaatagacattgctgtttattgtccatactaatttctgttctgagcactagaccttcatttctgaataaaattttaaagcaaaatataaccacagttacacatatacacagttaaaatgccaggtaatttgataagatgtacaaaataaataaataaataaataaataaataacaagttctctgccccaccaccctcagttcaaactatttagaggcaatgactttcaactcttttagctcttagtaattttcaagtgttttcaagaaatcctatatatagctgtttcttgatttttctttttcagttttagaatcctgagttcctagtgtggaaggtgaggattgagctttcttacacatcgctgtctaccccccacctcccacttccattccacccatcctcctagccagtgttatcataacttttcgttagatcagtatttaatgcgtttgttcttgtgactatgtaaacattgttcactactgggtcctattgggtgattacatttcttataaaacgttttgcttctcctggagttgataagtgggctcactttggttttttgtttttatctttatacccatcaccagtctcattccccaggctctccaccagaagtgtaaatctcctctcattttgttcaaacttgtcaggcattctatcaatactatcttttttttggagccctctgctctcttgttctaatctgggctgctgcacagccatcatcttggcactttctttatcctttatgactttcttagggattctcttctgtgttttattccccttttgtctggatcctgtgttttcctgtttttccccctttattttggtggagcagattctcctatggcttcttgagaaaatgtgcatgagaggtaacatttttgctgctttgtgtatgtgaaaatgttttacttctatcccacatttgattgatagtttgcatatgggtagaattctaagttggaaataaattttttttagcattttgaagttattactctattttctttgagtttttttttaaacttaattttttttttagagacagggtctcactctgtcgcccaggctggaatgtgtggtacaatcataggtcactgcagccttgaactcctaggctcaagtgatccttctacctcagcctcatgagtagctgggattacaggtgcaagctgccacacctggcttattttcattgaactttcagtgttgttattgaagagtcctggaattttaatttctgttgtgtattagttatcaattgttgcataataagttataaagcttagtggcttaaaacaacaaatatttatctcatagtttttatgggtcaggaatcaggtgtgacttagttgagtaccattgactcaaggtttctcatgtggctgcaatcaaggtgagctgcagctgcaatcaaggtgagctgcagtcatcttactggggaggatctgtgtccaaactcacgttggtaggctttgggtcttctcgctgttgactagagatgcgggttccacatgggcctctccatagggacactcaccacatgacaagttgcttctctcacagcagtggctcttagagctcagattgtgtttatgacccaaaaacacgacaaaaatctcctgactggtatttagaaggtgatttggcaaaaaataagaaaagtctttaatatagtgcctgtctccaactttcctttttctacttctatgccctgtctctagttgtttcgggtttgatagtctgacatgacctgggtttccttccgccctgcctattttaccactttcatttgtcttttggttcattcatgaagtgatgcaaatattcactgagaacctgtctgtgtgttagctgccagctagaactcacggttgtatgcagtgtgctgctgtcagtatcaacctctcactgacgagggaacctccacagataaagttgtggtcaaagtgtaggctgacctgccaaggccagcgccctg

SEQ ID NO: 113486 - DNA, 1053 bp, Homo sapiens
gtgattcccctgcctcagcctcctgagtagctgggactacaggctcatgccatcatgcctggctaaattcttgtgttttagtagagacagggtttcaccatgttggccaggatggtcttgatctcctgacctcgtgatccgcccgcctcagcctcccaaagtgctgggattataggcgtaagccactgcacccggcctaaaaaccgttttctagggttcttttaatgtgttttttagatattcactgcctccttttctaatcagtgggcagaaataagtgggttgaggtatcaaaagaaaggtattccaggtgtagaggacagaggaaataaagccttgaggtggaaatggaatgaagaaatcagaacacttgtctgaataagaagaaaacaaacaggaagtgagttagctgttttggtgatgaattccgaagtcaaaggtaagaaacttgggctgtacctttctcaagtcacttggtaaatagggccttactctaaggacagtgcagataaagaataggggacggtaagacagcacatagcctcatgtggaaactcactgatattcaggatacagcagtccttgtttcactcagctctacttcagtgccttggtgtctgattctttctctctgctttttgttctgactctgctaccatctgactgccctctttgccatcctggccccctcctggcctctgcatattcccatgagcagtggtgtgggattctctactcttctgttctttcatcattcccttgctctcacttcaccagtggcttctcatgtcactgagaatgaaattcagagtccttactgaggcctagtagcttctgcaggacctggcccctgctccctttctttctggtctcagttcatacacctttccacctttgctcacagtgtcccagccacattgaccggcctgttcttcctcacacccacctaaactcagaacctttgtactcgctgtttactcgaccgcaccttctctccttttttagtccttgcttccctcctctgtttaggcctctatcaaatgtcacctcctc

SEQ ID NO: 113487 - DNA, 1044 bp, Homo sapiens
ggttacagtgctgggctcaaacccctcattcagaccttgaatgggcagcttacttttctcatttctaggccatataccaccccaaacccctttgttacttttcaaaacatgatatccaagggatatctggccaggggaactctatattcctctttgttgttaaagtagctcagaggaagtagctttactgcaccgttctgaacaaatcagtcatgttaaaacataatgtatggctaatactctggggagtggaatcgaggagggcctggagtgtgtcactttatacttctgtattgtttcagttacttacaatgaatgtttattactttcaaaattaaagaaaaataaatttaaaatactgtgagaaataattggctgctggtccagtatatttcttgctcatattatggtatttttaaaaacctatttttccctaaaatgaattactgtaataatcatagcaaatgccatcctgttaataaaagaaatgattgataatctattcaagaaaatggtggttggaaggagtgtataattgtgtttcctctgaagatcatttttcaaaacactggctaatttatcatttgtttacctgtttggtctcatgacatttacttcttttcgtgaaagctataatcactcgaaaagcaaatcctcatttataaccaaactgttgaaagctgtttaacataatcaaaacctatctttagcattccctgctttatttattgtgtgtatttcatctccatcttgtgacccaacagaacctgttctagaggactagattcagaagacatgcattctttttttcttttttcttcttatactttaagttctggggtacatgtgcacaacatgcaggtttgttatatatgtatacatgtgccatgttggtggctgcacccattaactcgtcatttacattaggtatatctcctaatgctatccctccccccttcccccaccccacgacaggccccggtgtgtgatgttccccaccctgtgtccaagtgttctcattgttcagttcccacctatgaacat

SEQ ID NO: 113488 - DNA, 1070 bp, Homo sapiens
gttgaatggggttgccaggaaagttctttaaagggggttcactcaactgcacagaatacccttttccccttaccatcttcctcccacctcctgccaggaacaaggctgtgtagctcacagtagccaccctgggccatgaggttactttgaggttggaaccgaagcactgagaatagtggagcagaaaaatagatggccctgcagtccctgctgattagatagagtcaccacatgggttttgattgcctgcctcctcctttacttagaaggaaggaataagaaactctaccttgtttaagccactgttatcataggcctcagctggcagctgaaggcagttcctaactgatagattctaacttgatcttattgtttccttcctcttaccaccaagctgtaatacattttgttataagatacctagattcttgttgctattttgtactttactgtagtgtgaccttggacatgttagttaggttttatgaggcccccactccaccgtttttttacatctttggaataggaattattcatgccctaactactctgcaggctcattatggggaacatgcttgtaaacttcaagtgttcatgtgtgatgtgtagtttttgaagtggttgtggccatccttgggcaagtggaagggtaccaaaatggaagcctttagaatctgaatatagttttctggttttgttattttgcctagtgccaacttcattcagaataaataaatagaagctgtgaagggaggtgatgttgtccctgctctgatgcatttgagtagattaacaattgcattgctgatgagccctagaatgcatgccagggctgctgcatgggactgagagttcatttgttttcaatatggctgccttcattatactggagctttgtttccagaagatacgttaatcaaggaatcattatactggatgatagttaactgctttttctctgagagctggccaagaacaaagggctcagaagaaaatgtttgtacaagatgtggagaattagtttttctggcaataaatgtcactatttccaaatagtcctttgaaactag

SEQ ID NO: 113489 - DNA, 1053 bp, Homo sapiens
tgttgcccaggctggagtgctgtggtgtaatctcagcacactgcaacctctgcctcccagattcaagtgatttctcctgcctcagcctcccaagtagatgggactacaggtgcatgccaccatgcccagctaatttttgtatttttagtagaggcggggttttgccatgttgcccaggctggtcttgaactcctgacctcaggtgacccgcctgccttggcctcccaaagtgctggaattacaggcgtgagccactgtgcccggttctgttttttttgtttgtttgttttcattgtataaatatataccacagcattttgcctattattttttattgatttattggagttctttgtttacccaggaatctcaacttttgttggttatgtgtgttacaaatatcttcttccacctccactctggcttactttttcattttctctatggtttctttcgatgtggaaattcttcatttcagtatagatgaatttatgaatcttttcctttataatttgtgtctcttcccccctcaccccctttaagaacatgatttctatccaaggtcatgaaaatattctcctatatttcctttattgtcccctaaaagctttgtagctttccttggggagaaatgccatagctttcatcagattctcaaacagatttgagaatctctgcctgacatacaacattttaatattatttctccaaagggaggatatacaagattctggatcctcctcccaacatctggaagagtagtaggcacataatagggcttactaaatgctaactaaatttactctttctatattttgatgtgtttatggtaaaccctggaaggactgatataactgttgtctgttgtgctttgagtaaaataactttaatatcatcagtatgagggcacagaagaacattcactgtgttcacggtgtaccaggtgcttctttatgttatcacctgtgaggtaggtattattttcttcattttatcattgaaaagactgaggctcacaaacatttaagcaacttatccacagtccctcagcta

SEQ ID NO: 113490 - DNA, 1260 bp, Homo sapiens
atggagggtagaaagtaggatgaaaggaaaacttgagaagaacatcttgaagaaatagtcaatttaatgcctttggtagaatcttggaacataaaaataattctccatgctcattattacaacttttcatcaaaataaggcatttggctgtctatatgaacaccagttttgaacataattggtaattttgttcagtgtaaacccaaaccttgtgaaataatgaatagttgctggatataagtgaatatttcttgcaagagtacaatgaaaaaactttacaaagatataccgccatgcctgacctatggatttaaacagggtaggccaccttagattcctgttaccttcagcagaaagcttcattctcacaagagactgtacagtgaagacctgttttggagttcagactagatgtgatccagatgtgtgtttatcatttagttgcaatatgtgtatttattccaaagctggtggaaatgacattttgtaattagttttcaccagttccctaatttctcaaggttgacaaaggcttttctaggttctttgataatattttgctgagacatgacattgtgtactttttgcattcagtaattggtgtttgtagttttctaaccatttatatgccctttttccattaaagggtgtgaggacgatgtaatggaatgagtaagagggttaaacttgcgatttttggatttatttcttttagaagaaattatttaatagtttacatttctttacaagctgagctccactttccccttattagttaacatgtttttcagacactaacacattccttaccaagcttgggcatttgttagttatgtctgtgctagatgttgctctcctccaagtgagagggtatgaactgacgcagaagcttcatgttttttctgcatcaccttttcagtttttcacttttcctgttctcagtgctccctccttcccttatcattttacaatctaaagagtttccttttctctgatttcacctagcttgataaccataaacctggggtttatggacttaaggtagtctgtgaactcttccttctctccctgataaattttggagtggttgtgtaagtgcatttatttatttttgtaacttacatacagaagaacatatgaaatttgtaaattataaagtaaaaactcttgtaactcatgctcaagtcaagaaataggatatagtcagttccttagaaatggattcccatccctcctagacttagcctcctctctccccta

SEQ ID NO: 113491 - DNA, 1048 bp, Homo sapiens
acttggtggccagcgccgcgcccggggccgtgcgctctcgggccactcggccgcaggtgagaggcgcgggggacggggcggcggggacccagagctgcgcgctctggggccgctcgggtcctgccccacacagcggcagctccttcacgcgccgggatgggaccggcttctttaactctcagaggccagactcggggagggtggcatttccatcgccatcctcactttccggccgagcccgaggaaattcagacccgtctttaactgctagtggtcgtacagctgaaactcaaattttccgtgcacactaaatccaggagctgctggcttgggacttgtggcctggttgatgacttatctctggatgagtcagaggtcaatggccgtctcggtggacaacgacaccttccgaggggtttgcctgcgccgccgcagccaggtcagagcacgtgctcataactgaggcaagtcctgtttcggcgtcccttgcacttcggacctgtgacccccctccctccctcccccagccgccgagctcaccagttttctgtaggacttgttttcgttagttgtgagaccctcccccacgcaaagagaagtccagaatatagcattccaaaaggccattcatttgggctgagaatcattttcgggcctgtaattacttttatgatactgtgttttgggtacacaaaagcggcacggatcaaatagtttggcacattagtgaaagagtgaataagtgtagatccacaccccttccctcttccgggcggcttttcaatcaaacataatagagaggacattctttggcctttggttccaactgggtaatccgagttatctgaaaacaagagggaagaacaaacctagggggactggcaacaaaagggagatagggaagtgagagagtcggaggagaacgattcactgagagcctcattataaagtggaatatagcgaatattccatgaagtggagaagcttttctgtgtgactcccttaaccactaagagaaagttggaaaaatagagaagatattgtatct

SEQ ID NO: 113492 - DNA, 1051 bp, Homo sapiens
gtggtggttcacacctgtaatcccagcactttgggaggctgaggcggctggatcacctgaggtcaggagttcaggaccagcctggccaacatggggaaaccccatctctactaaaaatacaaaaattagccaggtgtggtggcacatgcctataatcccagctactcgggaggctgaagcaggagaatcgcttgaacccaggaggctgaggttacagtgagccgagattgtgccattgcactccagcctgggtgacagagtgaaactctgtgtcaaaaaaaaaaaaaaaaaaaattctaaatggtataaaaaatctttgtagaatcatatgaatatcaagtaagattttttggaattttgttttaaaaatagtaattcctagctgtaaatcacttttgtttgtttcagactgatgacctattttccatttttatggaatatcaaaatgatgacatcacaatgcttttgtgatttaatttgtataagaaaaaagttatttagttcagttaaatgacacattgatgtttacttatttagatcctatctgtattttattccccaaaaagaaatgcagctatcttaaatatggcagcgacgcttcagtatcttctctggaagctgcaggtatggacctgactaacatggctgagccaatccctgctcttctgcctggtgttcatgttacatttcttggttttcattagagtttctcagccccactcaaccttagcactgttcattgtaaaacaaacaaaaacgtaggggtttttattacattaaatagaatcttttatcaggaaccacaggataaatttcattctgactcagtaccaaaatagttctttctttgagcaactggtttatttttaccctgtggacactgaatcttaaaacagatcgtgtttctgtctgcatgttggctgcagcaaagcttagagtccctctaagctgaacatctacaacacttctcttctggctctcattctaccttgtggctacagttactggtacgcatatcttatcctactcgtttaaaagttgcttgaagacc

SEQ ID NO: 113493 - DNA, 1045 bp, Homo sapiens
gcccaggctggacttgaactcccactcctgggctccagcagtcctcctgcctcacctttccaagtagctggggctataagtacacaccaccatgcccagcaatatttttatttctgtaatgtgtcatttagccagtgattgttgtattataatagaatcacagaaatggagggactcctagaggtaatcaaatctggtggtttttaagccttttattccctctaaagggatagtaaaaccattaaaaatataatttatcccaatatgtaagtcagagaaagctgaacttctggtttagagaggaacacagatgaaaggccaaatgcctccatcatttctccactctccacccaacccaaccttcaaggtatctgggggctctgtggacctcactttgaagaccatagttctggagtaatgaaggactactatattaagtaaatccttctagcaccgtttagcaccagtttgcttgtatattgcttcctgagggtaaaattttaaaacaaaactgctccaagttcttcctctgcatttgtctgtagtgtgtattacctacagacactcaccagtcatcaggaagcttattgtgtatcttgaatgttcagcccaaccagcatacactgtaggtaccacaggtgagaggctgacctgagtgacagagtggtactcacttttttatttgatgatgagtatggcatctggatagcacttaagagattggagtgtactagatgagataggctctaattgtgtagatcagtgattgtcaaagtgtggtcccctgactagcagcataggcatcttccaaaacttgttagaatacaaattcttgggggttgggtgccatggctcatggctgtaatcccagcacttcgggaggctgaggtgaggatcatttgaggccaggaatttgagaccactctgggcaacatagtgagactctgcctctacaaaatgttttaaaaattagccaggcatggtggtgcacacctgtagtctcagctactagagaggatcccttgagcccagaagtccgtggctg

SEQ ID NO: 113494 - DNA, 1125 bp, Homo sapiens
taataacttaaaacagctcttttcctgtcagctggcttttaacgtgtattcagaccatgattttttttttgtactttaaaaaatttgagataaaattcacataatacaaacactatgagtatttctggtcaagagaatttaagaaaagttaattgactcaacacttggtccatttttttgactgatggctgataggctgggtgctataaagccaagtctttgccttcaagatcacagccacctgtggggataaaaacatgtaaacaaatattaatagaaacacgttacaaggtgccctgtgattgccaaggatgtttattacactttcctctttgagcctgcctctgaaaatagtggaattttttcctcttgccttgctgtttttttttttttttttgtagcaactacttcattgtcttaatgtttactctgtcagggatttcatatgaaagttagaattttgtcagccactctgttcttctgaacatctcttccttccaacattcaaaaggcagaaatataagtggtgacacctgaagttagtgtatttgttgggattataaaacatgcagcacatttaggacttggtataaaaaagctatttttgaatgctgaaatgtagactgggtttataccaagcttatttttcctgcaagtctgtggcaagaccattgcacaataaactccaaatctgcttgcttacttaagccagtcttaatattcacatatttgtttttattgtacatttcacctttctcccttccaaaaaacccaagccaggaaagggtctccttactgtcttctgtgctttgaagtttcctgaaattttatgtctctgttttttgtcgttgttgttgctattatctcttggatgtttgtaaatgtaatagcagtcagtgccttttccttttatactggtaaatgaaggcttagctggataatgttcataaagatctctagaatccttagagaaaggactaaataaaatgaaatagtattatgcaagatgaataaactactttcctgtattaagccgagttttattaaggtgaattttttctcaatgcttatcttttttttaaaatttattttaagactctagctttattaatagttaatgctcct

SEQ ID NO: 113495 - DNA, 1051 bp, Homo sapiens
ccactggtgctagatcgttattgttaaagcaagaaactgggcagacgcaagtgactgcaaggtcagccaaaggcattgtcaagacagggaagatcggagcatttgtgaagctgtgagattcaagccacaggacacgggaaaccagcatctttggttcggaggagtggaaagagtggggttctgagcaggggtggaggggttgtttgatggaagaggaggaggagagtgccctagaaagttctcaaccgtggctcagctgatgtccttgtgaaatgggaggtgagggcatgtgcagaggaggggagcagaagggggctgcctggaacaggcgcttggtgggacgccagctaggggcactgcgaaatccgtgagatgaacacagaatcctgtgcgcagcaggtaccacctggaggcccaagtcccaatgtcttccttcttcttgcatcctgttttaacagaagcagagaaggtggactttgggcctgagataagctgggggattgggacagacagcatggttcacggggggtcgggggtggttgtagaagcatcagcgttgtctgctctcatccaagcaggagatggagctgtgatcctgaatgagctctgagggactggacaaattttggagctttgaaagagcccctttcccctcctctgtcgaaccgcggcctcagagaatgggagggaagagagcagcacacagagctgaaggccgcggtgtcagtttcttcttcagcggagacgcattcactatccagaaaccagtattacctgacaacagcaaattagtagcctgtgctgctgctgccattgcgtgtcgagtctgagggtttatttatttaggcgatgagtggggtctttcggggtctgtgtgacaggtactgatctttgtcatcgtctgactcaagtttagccctggcatatgtggaattaacatgtgcagtctgccagacatccctatgggtgtgaggaagcctgtgacacaaatatgatgacctactgtgtgacaggcatcgtagggacagaaaagtgatggagaaatcccaag

SEQ ID NO: 113496 - DNA, 1385 bp, Homo sapiens
atataggaatttggggtgggacacaaatattcagcgtctgagagcagactagaagcaggaattccatttgggaacctctttcaggaatgcggatgagaaatgccccaggcctgagccaaggtggcagtggctgggttgaagtgagctaggccaagttgagagcaattatctcaattggcagaacttccagatttcttgcttgggcagaggtgaaacagagggcagactttttcaatgtaggaggagctaaaggaaaaggaataaactttataggccgggggtgagggaagatgccgtattccatttcagacgtgctgacttcgagctgcctgcaggacagacatcacccccacggggctaaccagtaggcaagatctatgagtctgcagctgataagatcttggggaggtttgcagttgagagttatctcgttggttcattattcagctcatgttcacttagcctctgctgtgtgctaaggtctgtgcccagcatgagaagcgcagttcctgggacagacaccagccctgaatcaaagcacaggcagccttgaagctggtggctacagtcagtgacaggggtgctctgagaggggaagaaggtagcagctaagctaagacctgaggagaggatgagcagggacaggccaaggctgacagggaaaagtgttccaggcatggggaaaagcacgtggagaaatctgaggtgagtctgggcatgagagtttggggaatccagggacacagcacaacgtaagtggaacatggactcagcagcatctgtacttgaagctgttggacagatgagaactttcagggagggtgcagcgtgccagggtggctggggaacgaacctgaagctctttagcctttaactgggaagcgtgcacagagaaggaaatgcaggcgcgatggcacagaagtagaaggaaaaccaggaaactggggggtggggggggggcggggcggggactggtgacacagaagccaagggagaggcaagtttcaagaaggaaagaatgggcagtaggtgtcactttggggcatcagaaagagagttctctgggggcacataggcaggtggcagggcccttgcaaggtcccggggcagggggagcccaggctgggtgggtgtgtcattgtctcagcagcatcccggggagtgaagacagacagatattgacaaataactcccaacagttgtttgcccaaataagttaactctagatggtgtcaactccatgttcagccactggatatggatgcacacatccatgtgttagtgtggcccgggtgttagttcccttcccgactcggctgctcagcttgaatgagttccccctctgaccctcagtttcctcactgtaaaatgaaaatggcaggacg

SEQ ID NO: 113497 - DNA, 1012 bp, Homo sapiens
agcagacacggagaaagcaagtgggtttgggggatgtggaatttcaccatccctctggtctgcaaagtcagggctctctaaaatgtgtttatccttttgagaaaatgctatgtaaatgcacagtgacagtagtagaatagttgtcattagctgaaagtgatcagaatgttctggtgacatctcagggtttagcaaagaaaaagtggctgtctcagaggaggcagaggggacagtttcagatttgccttcagaatgctgatctttcatttttggggaggctttatgtaattttctttttttttttttaacagaacgaagtcggcctactggagttcttccaaaatgtgataaaagaaactagggcagagccaaaaaaggtgactagttgggtcctcaacacttttctgggctatttaaagcaacagaacctcgctgtcagtgagaggtgagtgaggtctgggatttctttcttcctttgtgatgagctctgtccagaagtgctggaaatagggcaggtccatttttttgctcctgctgttctccctcaggatatcctgacatgacacaaacatcccctgtggactccacattctaaatatgttctctagcccgtgtaaaaatgtatttattccttcaaatctgtgactgtgcactgtgtcctctgcactgtgtcagaggctgggggcacaaagatgaatgagacagacatttacaaacttgtggaggatacagatctgtaaggaaacagccaccccagggtgatcctgtcatgccagaagcatgcacggggtgctgggaatgcacaaaaaggggagttgaacagaggctggggaaccaaccagggctcccctcgggaggggacgtttgagccatgccctgaagcattaggggagagtcgctctgcagtgggagggacagatcacgcagacaaagcagagtgcgaagctcagagagcagcagcacagcaggctcaggaacgccagaagctgcaggggccggaggcaggcaggtg

SEQ ID NO: 113498 - DNA, 1041 bp, Homo sapiens
aactggatttttgctttttggatggccagtcataactacattgggatgctggagtatatatatttatatgtctatttatacacttccaataacaacatcctagcatttacagtacaacgtaggcagtcagatgcatgttgaatgagtgattctctcttcatcatccataaatcagctacttggagaagcagagttggtcactgcctcctgtgggctgctgtttgatcttcttcttacctctctggcaattatatcactgtcttttaagtacttattagtgtatgttgttcagcatcttgaaggcaaggactgcttcatcctctgtgctactcagcacagatgagcacaacatcagcagtgcttaatgccacactttgactatgactgagtcagtcagcattccgtacagagcacctcttaacccaaagcctcttacaattcatgtatttttcctaggttgacgtaacaaaactacgttttagtcttatacatcttccccaccatcttgaccacttgagtttccaacctacttgaaataaacactgaattctagccctaccttttattactatttgtgaaattacataggagatgggaggaagggaccaaggctactcagcctcgaagatttaagttacctccctccactcagcaggagcccaagccaaccctttgaggtagtgtatgatgaaccaagaaatggccaaggtttccttgctcaaaatgtgatttcatagagaaattgactatatataacattaatttgtgtgtgtgtgtgtgtgtattagctgtctccataagagagtgaaagaaactttcagaatctcaagaatacagctgtttctgttcaaggcactgtatgagaatctgtgcccccttcagagggcatttccataggattgtcactctcggccgttcatgagcggtgatggggacagtgcctgccttacctcactgagcataagctccatgagggcagggacatttttgtatttgtgtttgtgtccttgtctttattcatgggtcctgcatggtgcccaa

SEQ ID NO: 113499 - DNA, 1146 bp, Homo sapiens
cctgaggtgagaaagagctaggaatgggccacgaggtaagcgaggtagcacaaggccactgtgccagaagcagaaggagcagtggcatcaggtgacactgtaaaggcaggcaaggggtagatcagagagaatggcaagaagtttagctctcaacccaggtgcagtggtaatcactgaaaggcttttaagcaagggaaagacatagtctgatgaatgttttagaaaaccgctctggctgctctgtgggaagtggatttccgatgggtaagagtagaagccaggagaccagttaagaagcttttgcaatagttcagatggaagatgatgctgttttggacagcactggtggcagtgaagatgaaggagagacaagagagacatacaagatggtttttagaaataggctggtgtggaaggtaagagacagggaggaagcacaaatgcctttagggaagttggaggagctagatggtggtgctgtttaccgaaattggaagatgagatcgagaatgtctttgtgcaggggcaaatcaggatttccttttggaaattgagatgcctgtgaaacctccaagtggaggtgtcaaatagataccagagctgtaagtgtggagctcagagaggtctgggctggagagagaaatgtaggcatcctcagcatgaggtggtatttaaaactgtatccgtccacccagagagtctagataaggaaggggatcctgggtttggatgggaaggaagccatcagcaaatgaaatggaaacaaagcatccagaggacgaaaactgggagcaaaaggcagcagaagctgagctaggaagataattcacgaaggaaggattggttggcttgtcaaatgttgctgaggcgtccagtaggtgaagacaagcgtgtcctgtgtccgctggatatggcagccaggagactgttggtgactctgacaagggcatttttagagagatggggagagaagctaggctgacgtgggttaaggaataaatgggaagtgaaacagcggagacagtgtatgcaacaaacaaacaaaacttgtttaagaggctttgctgaaaaggaaaccagagaaacgatagatgagtgactgatagagtgagaactgggttcaagggaataggttttggggttctt

SEQ ID NO: 113500 - DNA, 1022 bp, Homo sapiens
tttgtttggtctgattcagaaaaacaacagtgatgatgttgcttcacctctttctccttgaactgaagattggggcgagctgttttttagtgggtgagggcacgagtagaattaaataaaaaatacaagtaagacctgcgttctccagtggctgctgcttttcccctctggcctccagcctctcagcaagtctactgtttggtagggcggaaagaattaaaccgcctttctttatcttttaagagtgacagacagtttggttgaggtgggagatttagtaataatatgactaaaatgagatgttttggtcatctgtggctttctggtctttctggcccagatagttcaaataatccagagtttcatgggacatactcatataataaagcatttgttgttttttctgaaattcagatttaactgggtgtcctatattttatccaacaaccctacccagagcttagttttacaaattgagacttcccgtctcagcatagaaaacgggttagccttttgcaggattctcaaagtgtggtccccagggcactgacatcatcatctcctgggaactggtaagaaatataaatcttcaggccccaccctcgacctactgaatcggaaacctttgaggtcgggccaagcagtctgtcttttgacaagcacagtagtatttctgatgcagttaaagttcttaaactgggggcctgccaagtggtgaaagacacggattttggagcctgaccatctgaattcagacattgacattgatgctcactagctctgtatgtggctgtgggcaaggtcttaatccctccacgccttgttcctccttcctagggttgttgtggaattaactgagggaacacagtgagagcagcacctgggacctaggaagtgccacagatgcctttgcttttattctctgttcttctccaattctcctcattgacctgctgtctctttagtgcgtattggtgcctctgtgcgtttgcaagtaattcttcctttccacttagaagcag

SEQ ID NO: 113501 - DNA, 1043 bp, Homo sapiens
gcccttgagaaaatggctacggccctgtcgttttcagaagttcattctttttctgtcaaagtgaagccacccttcctcaggactcctctcagcaatcagtgcctcttgtgtattctgaccggccccttattctgtttgtagagggagtgagattagatttattctatgtagtaaccactccgctaagcttttctgcgactcttcctgttagctttgatgccgggcactgggggaaagggttcccgatgtggcagttccttaagtgcccggtgggacccactgctgcatacattttcttctttatatccttccctgattcccaggcaaacagactcggcttgtgaactggagctgcccacccagagaaccagagataatgcctgttgaagggccaagttgcatattcagcgaggatgtcagtgtgtgggagaagcatttgttcagcctgcggttctgagaggaactgtgtgttgtgttcccataggttctcaacaggaggtgtgtagaagcggcggtgatgacaggcctggctctgaactgccacataaacaagaagtccttgtttgacaggaagcactacttctatgcagacctccctgtaagtacactttgtgatccaccccactgcaagttctcagagctgggccagccctgctgtggggggtcggagcaagggaaaggggctgtgcctctcatgttttcagccagcactgtgtccatcccagcaggaagttcggcccagccctgatgcaggcaggtgcccctgatggttactagatcggatgcagttgtcctgattgctgacttcttgcttacctcatgcttctggtggctcgctcataattgcacagggagtagaagccagtgtttgcaggctcagcctggccgtggtatttggtgctaattgcctgttagtacaaaagctaaggctctggctgatgcaacagtaaatgcatactgtagttctgtcagcagagcgagagcgaatcgcttttaagttgaagttcccaataatagggctgtctcctttggagacatttctg

SEQ ID NO: 113502 - DNA, 1019 bp, Homo sapiens
actacagcagaggtgttgtggggggacatggtggtagatgaaattgaagatgtaggcaggagtttgatcatgtaagagcttggcctttgtcgtgggaacatcaggggccattgagggacttcaggtaacagaatgccacagatccacaattttagcaggatcaccctagtatgaaagacaaacttgaaaagggtttgcagatgctggcaggttcatgtcaccactgcggattcattgagggcagagacagagtcctatttatctatgtacccctaaagtttagtgctttatagacatttaagaattttttttttcagagtgaagacagcccaagttgaattttcccattctgtatcctatcctcagaacatgctgacctggacttccatctgtcacaagcagcttgactaagatcctaggaaattcctttttttcttggcattcttctaactgacactctctgtttactgggccctctgtgcatctgtaacgtgtgatgactgatgcttataattctgaccttgaagtacttcatggcttctaaatcatcaaaaaaagattaaagcatattctcagtatcactgtaatgtttgtgtgttttactgccttcttctctggaaagtggtggtttatgaagtgcccgtgcgcttgtgtgcacacggacacagtgagagtctgtgatggtcctcaactcttctcccacagggaggctatggtgcgtgcttgaaaataaacaaacaaaataacctgggttctcttcatgcctagcaggaggaagcagcttggtcccaggggcaaagaagcttgaaatgagagcgaaagcagtggttaggaaagcagagggaatgatgaggcagaactggtgcagaccaggagtcaggcagtttacgagccagccctggctgactgcattctgaccccaggaagagcaaagcccagggtcgggactgcagcttcatgttctgtgtgcctggacccgaatcatcaggcttggatttggcgggattctccaccagcta

SEQ ID NO: 113503 - DNA, 1027 bp, Homo sapiens
gaacaatttgcttttatgtcacagcttatagtcttttgaatgttgataaaggaaatgttaaattattcattatctcatttaatcagcttggtattatatttaggtgatggggcaaagaagaataagacaaaatgacctgattgccctcagggaactcagtctgtttggggaaacagtgtgttccccaagtgccaggggagctaaatggaagaaagacctagactgtagtagtggtgggaaagatgtcacaaaacaggtgacatccgaaagtcttgccagatactaagatcttgctcaagcagatgaggaagaagggcattcccagcagaagcagcagtttgtatgaaagcatgtgtcacgtttggctgcaggagcatggtggtcagggggactggaggaagaggaagctagagaggtggtcggggtagaccacaaagagcattgaagcctctgccaggcaattggactttatcctgttaggactgggaagcagtgaaaaggattttaagcagaggaattacatgaacagatttatccttcaaaaaggtcaccttaggagaggtgtggaagagagactagagggctgaaaatggaggcagagaaacctcctggccaggtggtgagtggcagaagtcctggtgggagtgggtggtgtttaaacaaagacctgaattaaaactgaaggcaagaggaggaggggaaaaatcaagaaatgttaagaaagtagaatgtgtagaacttggtgatttgtttgaaagtgttgggagttgttgttaaatgatggtctcagagatcatggaatatttgtctggtttagctaaataaatgttaaaactagaagcctgtttctcaaattggggtcgctgtgtccccttagaggtctcatgcaaactctgagttgtttatgctgccttatgagctagatgtatcttaggtttcaaacaattatgattgcagcactactcaggtcttacaataagccagacaagcaattctttattaaaaatcatttgctactcccaccacc

SEQ ID NO: 113504 - DNA, 1278 bp, Homo sapiens
ggaaatgaacataccagctttattacagataatagcttgattgaaaaatgcaacgtgatgtttagccatatgctttttagtacttgctgcctctgttgaactcagctttccaaaactgcaggcttttcacttgtagaggacgaacttgcttctgcagaaagcttatcatgtcgccagagtagagctgactgtcccatcattgtgggcatgttgattaggaagaactcatgcaggctttctcctgataatttatactataagcttctataggaatgctcagccatggggccaacccactcatgtggttccatttcccaaagtcacttgtcacaaaagtcactcttttggggacaagagaatacagagtagaaagcaaagtcctgtcacatggaaacctaggggcaggggaatgaccgttgcccaaattgtgccctcaaaagcatgaagccagtgtcacatcatgtctgggcatagatgtgagaagctgtttttgggtgagtcttgcggaattctttgtttatactgcaagtagatgcacttgtcatctgaggccattggcttggcctctcttggccatttttatgtgtgtttgcggcttcacatgtaacattgtggggagagttggctattttctacgctgcggcatcttggggagtttttttcctcagctcttttaaaaatcttggcaaagttaggaggtcattttgccattggcataccagagatgacaaacgtaggcttggtgattctggcatgggtaggtagtcaggctgggctcctctgaagagcattctgttcctcatggcagaggattcttgctagtgagcctttgtgttccccagcctttcaccactgggtacatcattataataaggactggagctgaggcagggagaataactgggaatcaaaaggcattagtgcttctgggagccttaaaatattctattctaaatttttatgcacgtatctccttttacaattatagaagcaagaagcgtaatcaatcaagggtctttgtcatgctttgcagctttcttaggaaatgcagacaggcaataatatgtgattgtcaatagcattttgaattttcagtgatatttgccaactcataggccatcccaatgagcaaggtcaggggctccaaccccagttgataggagaggaaactgatggtcttactgacttatccaaggacacaaagaggtcatgaacccagctaaaaatagaagtgagaattgcctggtccctattcttagtataagcaccagattacac

SEQ ID NO: 113505 - DNA, 1018 bp, Homo sapiens
ctgcggccccaggggattttcttgcttgctttgagcttggctctgggcatgtacacatctgtgtatttgtaaatttatatgtatatataaatgtatgtgtgtataaatagaatacttcatttctgcctcctgcctccatctccctgttccccagcatgtctggagcacacctgctgtcttgaccaaccccctccccgttctgattagtaacccttattctgaatgttttttaggatctttttattttcttattttccctcagttttaggattttatggaagcccatcataaatcttgaggatgaaaaggtcagccagcccatttcactgcttataggcaggattacagctacactaaggacagcattctttgtttttattagtagggattcagcttcactcattatttggacctagtaaaatctctttactgtggtgccaagtcttccttaatttattaagtaattattcacctatagatctatagacaggatcttaggttgtttgcttaaagttagttatttcctatttaacaataccattccaatttttctacttgtaatactttgtatatggttgtgaaatgggaagaaaaataagaaagaaaatatatttgtttggtaaaatgtcatgggctttacaagtctgtttcataattggccaagtaatatttccagtaatggtgagatttcagcaaagaatcaagtttgtttgaaatttatgcatgtgcaaacccatgtttacacatacacacacactcactttttgtcatcggaaatgcttgccctctcctggtgtcagttcccacgcaggggaaaggggagaggacaccgttgcctctgccgtagctggctggtaggaatgctcagtgtggcacagtagataactcctgataatcaggctgcactacaattcatttaataagaaatgagaagctctgctcttgttttgcttgtctgaaagctcttatctgtatgtaacatagaactccctagcaactgtgaatgcctcttgtctcc

SEQ ID NO: 113506 - DNA, 1041 bp, Homo sapiens
tggttactgtagccttgtagtatagtttgaagtcaggtagtgtgatgcctctagctttgttcttttggcttaggattgacttggcaatgcgggctcttttttggttccatatgaactttaaagtagttttttccagttctatgaagaaagtcattagtagcttgatggggatggcattgaatctataaattaccttgggcagtatggccattttcacaatattgattcttcctatccatgagcatggaatgttcttccatttgtttatgtcctcttttatttcattgagcagtgatttgtagttctccttgaagaggtccttcacatcccttgatttttttcattttgtagcagatattgcttcttacatctcactctgcttttgggcaccgttttcttcctgtgttggtggctcttgctttccaggtctgtgggtgatgaactctcttagtctgtatgtgcctccagctgtttctgtttccccctcactctggaatagtagtatagaattccaacttgacatttatttcccgttggcacttgaagacatttttccattgtccttaggcatctgtaattgctgatgagaagtctgcatcccttgtcagtaatctgttgtgtcactctgatagctttagccaggatgtgtccatatgtgaatttgtttttatttattctgctcagtgtgatttttaacttaagtactgtaccctggactatggaggtatctctatggaatgaattcctggtggcctctgccagggcccattgggttttattgaatgaaccggtttgtatgttaatttcttggccccctaactgccacacagcttagatagtgccagcgtcaagctgcacacatccaagccaggcacagggtcaagggctcagatttctcaagactctttttcacctatggcctgaagtagctggcctcctccacagcaacccctccagttggtggcaaaaggttttctaactggactagaattttttggctcacagctttatgcaggaagccatcccagctccctatcacat

SEQ ID NO: 113507 - DNA, 1090 bp, Homo sapiens
aatcaggtccacatacaaaggattgggagtcagacatcagacttttcaacagcagcacttatacctgtaagagaatggaaccatgccttaaacattcttaggggaaaaaaaattataattctaacctagaattcggtacccaacagtgtcaatcagatgtgacagtagaagaatggtattttcagacagactctcaaaaagtttgcctttcattaccccaggaacctgctggaataatagagaagtttcaggttgccagctctaccatgagaccgttggaagaggaggaaggtggctccagaataaagaattctaggaaaaaatgagagtagggaattaacaggtatctgatttgtgtggaaaaaagatttccatataatctagcctttagaggaatgagcaataggtacataaaaaatgaagcacatgaaaacaatgaagggcttagcaagtctaggaaaaacaaaatgttcaagaaaggaaatgtaatcatagtgttttattagcttaggagagaaacatgtaaataataatagaagcaccagctactgatttaataaaaactgtgatataacttggatattgggaaaagaactaaattcttacctaccataattggaagtcatgttctaaattggtaaagcaagaaaaaagtaacctaagtataggctgtaggaacatttttggccactgattggaggcctctttctccttttcaggccttaagccagtagatgggttttattttgttgtgtttttctttggcggtgaggtgggatgtgggattgtatttgtgttttgttttgttttttaattaggtgatgggtaaatgatttggagctcccaagaaacagactagtagtcaaaagcatttttaaaaacaagatttatttttattttatatacaagataacgttaggtaataatcaaacattacctgtactggtttctcagccttctgctggtgaagtgcttttcattttgttttgttttttgttctcaaagtccaaataatgagtcccctaccacacccctgttctcacaactcttacccttaccctgattttaggagaaatagactcatccacat

SEQ ID NO: 113508 - DNA, 1031 bp, Homo sapiens
tgaataaaaccacattgatttctgaacacagattactttttctctcaaatctaagttgtgcttaattgtaatcattccctttcactagttcacgatgggggaaataacatgaatacccaatgtcctaggatagatagcttcttcagcaatgtgggtgcaatgtgagggggtaatacaggtggttctaagtttccactttttaaatgaaataaataatttcaatagaaacattaaaattgcaagtaaagtgaaaaagagacagtttccactatcctggcaatgtatgtcgaaatctatttgtatacatctttccagttaaaattgcattaactaatgtagtctttgattaactacttttgtcctgtggaaacaaagtcaatgctttaaaagcatttagcaggctaatcaacaaaatgccccttgtagtctaacagagctggaagcagatggttatcttagtatttcttagcacagttgtgagcttgatccctgtctttcttggctgtgagtttctatgtgttctatggctatggaactcagcctgctgtcttgaaactttatgccacatggtagagacggaagatggctaggtcagtagatattctcttaaaaaaagagaaagaaaccacagcagtaacaacaaaacccacataagataatgtacatataacagaaattaatagcatcatttatgttgtaactagaagagctcctgtttttgagaaagcattctgaaaacatgaagttccttcttagaaaaactacattttaaaatccagttaggtgtcattaggggaaaaaagaaagactgggaatacatgcatgctgagcaattgggaaaacaggattcatttccttttattttaccattaaagtcttgattctgataaaatactgatgcagagggaataattgctttctctagaagattgctttgcagcaaagaaatctatgactcctttttcctttccagtgcaaggaaatagaacaccctgttcaatgtccttgagagatgaagggccatatgggga

SEQ ID NO: 113509 - DNA, 1126 bp, Homo sapiens
ttcacttagatttatattcataatgttatcagaacacattaatccaagcaagacactgcccaagaacttcagttattatttccttatgtatgtacacatgcatttatgaagctgaaggaagcgcacgcatgcaaatagatagacaaacagacacacaaacacatgatgctccatctcatacagtacaatcatttgtgacatgctaatttctagtaggtgccccgtcaattggtttcacagcttagctattcatcgtcagacagagtgtctgtgtttcccccatgcacttccagttcacggaatagtgccagactggcatcttgtcttgtgacttgataacagattccattaatagtgtatccactgggactaacatccagtccctctcagctgggagaaatctggcaattagtgccagcccgaaggactgcaagggctgggagcctcgcatgccaggtcatgcataagaggctgactgtgaattcacaccatatatatgcacaaggaattacaaaatgggagctttgaaaaacaaaaaacaaaaaacaaaaaaaaatgagggagtatactgggtaagaactttcctgatatctgccatccccactttgtgaaattggggatgagacaaaatcgtcattgtttcattagattgggaccatgcctagctctgagctccatttatttctcagcacattgctagttctcaatgattatcattatcattattaatgatggtaataattgacaacatgataaacaacttgaaaagagctagtttcctgaaggaaaaaaaataagtcactgtaataatggctcttttacacaggaacaaatagaacatttgtgtcttggtattttaaattatgtctttgtttgctgaggctggagggcacagggtgcaattttaaactccaataaatgaacagatgaattagcattaggaaaaagggtacatgttagtcaaaaccagccatttggacttggggtccttaatgatatgtagattttctgtcttgcttctttcattctaatatcacttattcctggatttgcagaactggctttacccataacaggaggaaaatgttgcttactgggtgctgaggttttaggccatggcacataa

SEQ ID NO: 113510 - DNA, 1014 bp, Homo sapiens
aattcacccctatgagagaaatccactcttagcttgctgacaaagtcaattgcctcaattacaaaaaaaaaaaaaaaaaaaagattcccgaacttgccccatagaagcaagacagccaagcttagaagcagccagcccagccctttttcaaacttagaatcagtgatccaagggtcctttcagtatttttccacaggatctctggctgaatttccacagcatgtgaaaattcaactatacacaagacagcatgatgcagcgattttctttttttcttctctctctctctcttttttttttttttgcacattttattttagtagcacaactcttattttcaaatgatcttacgaaggacctcaagctgcagatattcatgtcttcacatcaggcgtctctacttgggtgtctgacaggcacttaaaatataagatgtccaaagagcattctggatgccctgcccccgctgcacatgctcctccctaatgtgccctcatctctcaggcctaacacctaaaatcattctattctcaggtcatctcttagcctcaaactcctgcttccagctacaaaacatatgtagaatcccatcccttccaagctagggcccacatagctgaaaccttgttttcagccagtatcccctcttacctggatgactgcaacgaacttataataggtcttcccacttttattactgcttcctatacttccctggatcggaatgcagtttcccatatgcttctacctacagggaaagaacaggtatggctggcttacataattgtcagatggagcaacatttgcttcacttaaaattgtttttagaagtctagactttagaatctctacttgttaatgacaatataacaatgaccaattactaccattttaaacgtattatttctctatttagtgaaataatacgtttaaaatgtagatcagatggtgactttcaccctgttcaaagtgctccaacatctcccatcactcttaaactgcaaactccttacc

SEQ ID NO: 113511 - DNA, 1070 bp, Homo sapiens
aacatatatagtatcttccctccagttgtgtccacctcgaagaaaaaaaaattacagaatattctcaatctgttaaaaatatcttacttcactcttttcccttgcttaccctggagaaatccaaattagaaaacttcctatttaagataatcaacagaggagaacaacagatcaacttgggctaatatcagtagcagggaagaccaattaacaaattcatgaattgtgctgtttacacttctattcctaaggttaattatgcgatcaagtaatagcttttgccttgattagagggcccttaggaaataaaagtgtgtttcctctttacaagtatgtttgcatttcagtcctgcaatgatagcacaggaactgggctcagcaaacatcgcctgtgcacacagctgtagtcaaagcagaaggtcttaatttaaatagcctcaagactcaacgtgtaaacagaagcatcatccataaaagtgctaacagtcacgtatacatttttctctctctctgctttggactacttatagtgtcaattctttgcagaagtttattttcccattattccctattgtaaagaatcagtaaaattagctcctggggctataggtatagaagaaagaaacatcgcccacatttcagggagcactctccgcaaggctgttccagcttcctgttaataatggcagctcacgtttttgaggtgctatcccatggcaagggacctcacatgtataaattctgtaatcctcacagtaagcctatgaggggaatattgttatcatcctctccttttcaggcgagaaaacagaggcacagaaaggttatgtaaatcacccaagtccatagcagctagctaagccagggtttgaacccagacattctggctccagtgtggacacatttaaccaccatgtgctgttgctcctctctttagggccctgacttaaatgtgcagtgttagaaaaaagtgaattatttcacccaaatgaagaagcaacacattgtgccatttgaaattctcaagtgaagtgcaaaagtttccttgtccgtttacaatccacttctga

SEQ ID NO: 113512 - DNA, 1050 bp, Homo sapiens
cctacagactaagaaggaaaagaagaagagatgacaaaccataactgacaagagaggcgtctgctgtctcatcacataaaaggcttcacttttgactgagggcagctttgcaaaatgagactttctaaatcaaaccaggtgcaattatttctttattttcttctccagtggtcattgggcagtgttaatgctgaaacatcattacagattctgctagcctgttcttttaccactgacagctagacacctagaaaggaactgcaataatatcaaaacaagtactggttgactttctaattagagagcatctgcaacaaaaagtcatttttctggagtggaaaagcttaaaaaaattactgtgaattgtttttgtacagttatcatgaaaagcttttttttttttttttttgccaaccattgccaatgtcaatcaatcacagtattagcctctgttaatctatttactgttgcttccatatacattcttcaatgcatatgttgctcaaaggtggcaagttgtcctgggttctgtgagtcctgagatggatttaattcttgatgctggtgctagaagtaggtcttcaaatatgggattgttgtcccaaccctgtactgtactcccagtggccaaacttatttatgctgctaaatgaaagaaagaaaaaagcaaattatttttttttattttttttctgctgtgacgttttagtcccagactgaattccaaatttgctctagtttggttatggaaaaaagactttttgccactgaaacttgagccatctgtgcctctaagaggctgagaatggaagagtttcagataataaagagtgaagtttgcctgcaagtaaagaattgagagtgtgtgcaaagcttattttcttttatctgggcaaaaattaaaacacattccttggaacagagctattacttgcctgttctgtggagaaacttttctttttgagggctgtggtgaatggatgaacgtacatcgtaaaactgacaaaatattttaaaaatatataaaacacaaaattaaaataaagttgc

SEQ ID NO: 113513 - DNA, 1108 bp, Homo sapiens
tgttgactaacgaattaaggaagaaatcctcgatccagttttcaaaatggtttctgccaaactggactttttgactttctcttctcagtgcctttgctgttgcttttatctcctcctgtaaagccctcctattaaaatcctatctttctattatcgtcatcatacccctgttaaacaagtgtgatttctacctcatttgtcaaaaaaggtctctctgaaaggtccttacagtgaatccatggcagtctttacctttaattctgtctatcgcatcttctttattaagaacaattacattaagcagatttcacaccagatttgtaatatgtgaaaaggagtaccttttcaattgtcatttacctctactttgaacagtgtgctatactgttaaaatttgggggatgagtatcaagagaccttgtattccagtttccattatgttctctcaacattaggttctcaattaaagggttctctcaaccctttaattatctacttttttaaaatatggaaactgtggtatttctttatctcttcagaatgacataaggatacctgagttttcagctttgttttgtaatccaaaagtgattacagtatttgtatattgctctggttttcagaagagtatagcgctgatgttgaaccaaatgtttaagggatagccattgtttttaaagatgtacatatcttttaaaatctttatctcttaatatttttatagcctattgcatatttataaatctaatcattaaaagcataagcagcctgtgtttgaggacatgtctaaaactggttaatttttactggaatgtatagtgtaaacacaaatctgcagctgtttaaattccaaattctgacttgttttgttgtataaactttattgaattttttacctaatcacaagggaatatatgcattcataattgaaattttggaaaatggcaaagaacataaagaaaatttaaattctttaaaccactaccacctagagttctcccattaacattttatacatatgcccacattaacattttatttctaaaatcaaaatcttattgtatatatttagaggcagcttctgctgctttttaaaaaatacagtaca

SEQ ID NO: 113514 - DNA, 1618 bp, Homo sapiens
tttttcttggctcaatttttccccacttttatttactatctaagttatacctcattactttgtaatgtttttcaaaagtatggttgagggatatttatttttccttataaactgctttgttgataacctacctgtagtttagaacttaataaatcatgttaatttatacttatctcaaacccttgtgagatgagagtggacaaggcatttaaatgttaagtttgaagaaaaagcccaagcaatcagcttgactgtgtaccatatcataccttaatgattctctagtgaatatttatttttatctgtccagtagagaatattttcatgaattaagtaattgccacctaaaaaataacagaagagagtatgaaaacaaaaaaaaatccatgtcttttaaaatgtcttttaccatgttgcttcttggcaagtatcttataaatattccaagtcagatgttaaaattttttaaagcagctttatatttccatagtgtaatattagtttgggatttattacagggctttaatgtctgtctttacttgtctagaagtagcttcactggctcctaactactgccctggggcagattcagatgaaatgtggtatgtagccacacccaatactgttggcatactttcattgaatctattcccatggaagaaacccagttgcaatttcagtattatttcatcaaagaggccaggccagagctatcataactgctttcatgtcgtgtttcctttttattatatcatgttttatatcatatgtttgctttctacatactacatacacaattgcttgtgcttatataaatttataatgcttttgaataaacaaaacaataaatagtgatgggatcattttatacggatgtaatattttctgaagagccaaacaaattaaataagtaactttactccaaattttaatgagctattaaattttatttaaatcacttttcctttctacccaaaagtaatcatcttaagtgtttttccagtgtctgagaacattagtgggacatacaggtggagtatggtcatcacaaatgagagacaacatcatcattagtggatctacagatcggacactcaaagtgtggaatgcagagactggagaatgtatacacaccttatatgggcatacttccactgtgcgttgtatgcatcttcatgaaaaaaggtaagggaaaatcttgtcatggttgggacttcttcctctattattggtgaatttgggccctttctgtgtagagttactgaaatagtgacagtgtgctcttaaattagatttaattattacacttcagatgtttctattctaggaaagccatagcgttttgtcttaaaattggtgattgtctgtaaatttcctttctcatttgctagtgttgtcagcttcctgtttgaaactctctactctctaatctctaatcctttttgttgttctgtatctttgatgactcatcatattcaagcagaaatcatgttttctctctctttttttgatattcttatttccgcaagtgggacaaattcaggcttcaagcgtctgagcctttttaaattacctacccaccttacacccaccctatctctaagtctaggcaaaagct

SEQ ID NO: 113515 - DNA, 1005 bp, Homo sapiens
ataagtaatatgtatatgcccctagttatatgtcagctaagaagacaatataaaatactaacataccatttcaaatgatcctgaaacttcaaatttgaacagaaaaaagtcatttttttaagattatcattctaaatatcctaatggtgttaaagatagtcccaattagaattgcacgttggatacgaataaaatagttgtatcatatttaatgcatggaactaagcataactccagagaaaagcaaagtggagaaaatcttttcttcctaaaatgtgttttctactgagtgctttttaaaaatgactttggcccagaagaaaatttttatttttgctggctcattctaaaactgaatcctttgaatagatttggcttatgaaagtgacgtcagctctctttgcttccagaagggcattaataatgggaaacacttacataagtatttgactgaaagtgattttattcacctttgatatattctctgtagtttacttagtgatatcctccgtattttagaggttatcatttttgttaaaatgcaggctttctcatagtctcattttttctcttatttctaataatggtgaggtttttggtttgttttgctttatttgaatttccataacttcttaacagacaaaatgttgtgtaagatcagaatatgaaagtattttgaaaaatctaagaattaaaaacaaataatcaataaccagggtaaatccagtaaagattctctcagtttaagtgttcttttaaagactgcctggggaaaaataagtgaaattagttatataggagactaagggagagccttggtttagcatatcatctgtgtttccctcttgttttcaactaccagaaaaaaaaattcctattttgaaaaatgctttattgtctaagtggataaataatgatatagaaaacattatcttctcagaaacaaagtattattatttaaaacattattaccttcttgtcaggaaatggacttatttttcttat

SEQ ID NO: 113516 - DNA, 1138 bp, Homo sapiens
aagaattgatgaagtgtatggcaatttccctgaaaattactatgttttaaaggattgaaatggaaaagcataggcaatgtttttattaaatcaataccaaaatacgcagtttgaaatataacttagattacataatttctgcaaatgctgtcggctccaaaccagtttactttattgtcagtcaaccccagagtatattaatttctcttttcgggattgcctgttttgtaccatccaagctacttgaaaaatctgattagtctgtgccaggactacggtaggatgacagtgaaaatagcatgctttgcctcagttcagggggaccgtatgaaaatatatcctattttcaaaatgtttctgaaaagacttatttgtggaaatgttccttgctatttaaaactcttcaaaaatgcaggttttacaaaatacaaaaataacctcttgaaagtttgaaaggggagagggggctgtcgtgtgggggcggtctctgctgcccacatcctccctctgttcagtgcgttgtgttcttacgggttccctggagcggatcaccatataattgatgtgcagtctgcattgctgaatcctggactgcaccattctgtgttcaagggaagatgtaatctgatccctctgctgctgagggaggaatctgttcagtcaaggctttgacagggcatagtctcctccaataatcttctccgttctctctcattattccctcgagttcttctcagtcaagctgcatgtatgtatgtgtgtcccgagaagcggtttgatactgagctgcatttgcctttactgtggagttttgttgccggttctgctccctaatcttccttttctgacgtgcctgagcatgtccacattagaatctgtgacatacctacctgaaaaaggtttatattgtcagagactgccaagcagccggacacacgggggcacagaatcactgaaggggaaaaatacagaaaatatgggtttctacggcacattaaaaatgattttttacaaagtaagtaagctgttttcttcctatgctatgtgattgtgtgtgtatgcctgcctgagaaggaaaatctgtatcatcagagatggctgcagtatcctctaattttggtgggtggctggatgtctg

SEQ ID NO: 113517 - DNA, 1017 bp, Homo sapiens
taatatagtgaaatagtaattctaaaaatatagatgacaaacattttcttagctgtttggttgactaacttagctatttggtttcttagctatttggttgaccttctttcctgtgaacttactacttaatattttagtgtaaggcataaaatactttaaaaaaacttatttaacatagataatagactgatctaaagtttaaaatgtttcttgtcacagagataagatagataaatacagacacaaacccataaaaatttttaaatattatattaccaaaaacttaaatctgaataaagtttcaaactatattttagccgagtggtataaatagaaatgcaagtgattttatttgctttgttcatattaagattatgatgacagtaatataatagatcacagttttcattgatagtacgtcagagaatgttgaaaatcatttttattctgttaatttgaaattcagttagaagcttagttgactagttttgcttgacagattcttcacagttcaaattaacatcataagatattagggagaattgtttaaatacttgggaagacaaggtcttcattagtacttataaacattcgcatttctcacttaaaggataaacaataaaaatcattcccaaatgggaaccatggtagatggaggatatgtggtagtagaaagacttctcagtgtagaattttttgtatatcattttgatgtttgaagcatacaaacctggtaataaaacatggatctacaggacagtacccacatacaaacaatatttgtagggaacaggttttcctgtaactcacagccctaagtaggagccatataaccatgggagcagtcctttgaatatacaaagttaagagatattttctttaggttttgagacagtatcccctacttcattaaagttggtctcttcttaactgagtagatttaatttgaaaaggttagttcaactagaaataggacatgatttcagttgaagccaaagtatatactattatagcact

SEQ ID NO: 113518 - DNA, 1054 bp, Homo sapiens
tgagtctgggggccagacagtagaggtgtggggagaaagggctggggtagaacaagatgaaaattttcttagtgagctatacctttttgaataggacaggttctttcagtcacatgttggcaagaatcggtgaattgtgtactcacctgttgccccgagtaacttttcggattgttttttcattaactttttctgggaatatacaatttcaatgaatgttttatacaccatttccctgcgctgtgtattcaggagtacaacttgcttgtatgtatgatttctagtgtgaatgcctgttcaaacagaaagtccccttgtttgtcagtgtttgtaactaaaataaaaagtcaacagtcttcacacccacacagtaaagttctcctagtacagaaagacacataatgccctaagatggaatgatgagtcatgacaggaggtattttgaagaaatttaacaatatgttaaataacattttaactctagtattaaatgtttcagttaggagaaataattgttatcacatgggttatcccctaatgaaccttgtaagaccagtgattagaagtctaatagatgctgttaatcctgcaagttaataatagtcgtatttccatttacatctcaggtccacaggtggtaatttccttcttccctctcaacacttatcaaacttctgttttttaaacacagaagcaagaccatgtcatttatgaactcccagactattaaaataacttctccattttctgactcactccacccaatttggcaattgatatatagtccagtattgctttctatttgtttcttgtctttgtgggttttttttgttttttgagactgagttttgctctttttgcccaggctggagtgcaacggcacgatctcagctcactgcaacctctgccttccgggttcaagtgattctcttgcctcacctgtcttcgtggtttttgttgttgttttgttttgttttgttttgtttttggtagtttttgtttgtttgtttttgagacagagtcttgccttatcacccaggctggagtagagtgc

SEQ ID NO: 113519 - DNA, 1042 bp, Homo sapiens
agaaaatttatggtaatgttgaatgggattttcttaaatttcttctcctttgctagtcttgaacatgaaaattgaaacttatgagctatttaattacatttttatgtgtgggtgatttcatatagttcacttgggaacaatttcagcttaaacagcttttcaataatccatagaaatctctgcgttatcactttagattttaaaatgtcactgttgctactaatatgaacatgtaggggcagtatagtactgtttttgtaaatcttgtctgaatttgtgagttttaaaaatctgtgttactgttagaagtttgttcttctctaagataacataactatatcttgcttttttaaaggatggttggtactgcttcattaagttggaactattctttcagttcatgttcttacatgtgttatacaaaatctcttatattatgaaagctcttggccctgatttatatttgaagtcaaggaatatgtttagttaaaaggaaaaatgcatttttattgtctgacaataaaaatgagaataaatggattcataaaaaccggaaaataccaagatcagtgcagttttgcccttactctgtgtcatcctttcaaaatgaatgtttatgataatttttacagtcttaatttttcaatatgacaagtgaacaaaactgagattaccgaacagtcttatttttaagattctttaattggtacatctttttttcgtgtcaaaatggttaaggttattacaaactttattacaaaatatagtaacttttcccccgacttaatatttaaaagaagacaactgagcagttatctcttccatctatgtattcactttattcaacacctcctatgagccacggactgctttaggcatttagagtacaacagtgaacaaaacatcccagccatcaccctcgtggagttcatatcagaaaagcagagtgcctaagagcgcggattatagggtcagttggacctgggtttaagttctttgctgtaccacttactaagccttatctgtgaagagctaatagtag

SEQ ID NO: 113520 - DNA, 1064 bp, Homo sapiens
ggtgtataattttaatctattatactcctgtagtagactgttgggtttgttagaacttttcagcaaggtctgctaggcttattaaacagtcgtattgcttttgtttcagaaaataacatctctaattatttattctacaataaaattttcattaatatgaagattttatacatacccaaaacaccgaccatcataagctctgttggtaaagcaaatttgggaattattaccctcccaaatttagtaatttaatatcctccaaagtctgagttcaatggctatataatgaatttttatttccctccaatatttaatatcttttacttctctttataaaactattagacatgttaaatatgtaatgtagaaaaggcacttgtctttacagtgtcctaaattattagtaatctcacgggtcagaaataaccacaataaggattttaagcatataattttttaaacaaaactgccactttaattcatttttaatatactgctagtattttcccatggctgtaggtattcaaaagtatataatctgccatataaatatatcgtaatttctcactattgttgatttagattgtgacctgctttgaacatcgttatgcataaatttaaccacatcactgtacacagatttctacaagtagttttattgggtcaaggagtgtgaacttctttagattcttgataaatattattaaattttttcagaaaaaattgtatcagttcaaaaacagcatggggtttctaatgttacaagacattatattttaaagcacatttattcttatggcaaagctttgtggactttacttagctgatactgtatcattgtacttccatgtttattattctaggttttctgtgaactgaattttcattttgagaaaataacgatatatgtttttacttaaggcctcataaggaaaatatatcaattgattaaaaaattatttgtcgctcatagtgattttattttttattcttataggagataatatttgccatagacttgtcacctatattattttcaactgtaattttcttctattcttttc

SEQ ID NO: 113521 - DNA, 1065 bp, Homo sapiens
gcttacctagcaacatttttttctttctagtaataagagaaattatattaagatgcagcttacaactaataattgcatggttttttgttttgctttttttgggacagtgtctcactctgtctcccaggctggagtgtagtggcgccatcttggcttactgcagccttcatctcctgggtgcaagagatcctcccacctcagcctcccaagtagctgggactacaggtgcatgccaccgcatctggctaatttttgtatttttgtagagatggggtttcaccatgttgcccaggctggtcttgaactcctggactcaaatgttttatctgctcgcctcagcctccaaaagtgctgggactacaggcatgaaccaccatgcccggcataataagtgtatgttgaaagaaaatggacttttaatgcataaatttcatctcttgactcattttgtttttgtttggagcacttttaagcatttagaatattctcttaaaattattcttcagtgttactattttagtagaaatttccaaatgacatgcaattgttggtttatttgggacttaaatatatctggtttgactgctggtttatagacaaatattgtatttagagtgcctcctatattcttgagtttgtgtagcataggcatcagcaacacaggagagaatggagtagagctttggtggaaaggatggagcacagataagggacaaggatttatgcatctgagacccaggaactcaggaaatagtgaaatatacaactgacgtttccagtagttgaaaataatttcatagtgattatattctatatcaaattctattccaaatactgtacttaaaattatttttctttaaaataaaaatagaaataaaagtagaatatttgtgtgtcatttgaaaaggtgttactgtcacatcttatgtatcgtcatcttaaatcaggagtccacatgctttttctgcaaagggccagtaaatattttaggctttgtggaccgtgtagttggcctctgttgcactcagctctctctgcctttctatcatgaaagcagccacagac

SEQ ID NO: 113522 - DNA, 2752 bp, Homo sapiens
ctccataaaagcttggaagttaaaagttggaaggagagataagtggagctgactggctgttggaagaagaaaatagaatggaaagagagaatagttgattgagcactgtgaatggatagttcacaatcattatctactatctgttaggaatatggattatagtataaagattaattaacacttgcacaaatggttaatttagggaaatatttgagataatgctggaaagtttagtttggggccactttgaagagagtcttcatctccagactttatcttaggccgtggagaaccattgaaggttcttgaggagtaaacggcacactgcattccctctctgtgttttaggaagatttatctgaccatactgtgaaggagaaattaggcactagggatttgcaatggactggctagttactctcccattttactataattacttcccatcatagattactttataaataaatacactttttacatgtctttaatcagttgggtgactgttatgctttcaagtataatcaataagtttttcagaattaaagattgacaattgaaaactctggtacaaagattaatctgaagtgtgtattaatagctattagagaaccagagtatacagtatttaatgtctagtgagtatgagataaagaatggtgtgtatggaaaagggaaagagagcacacacttgaaaatagtgctcattataatatatctaaggtagaacaaacatacatatgtgtgtgtgttttttttaaaccatacgtaaacacagttcaaaaaattcaaaacaaaatttgtaacagaattcaaaacattcctaaaatattaatgctgacatttggataaggaagacttaatagatactcaagatacaatgtttgttttttttattttatttttgtaagtaaaaatttactttcactttctaggaaacactcttagattagttagttggagaaatattaaaagggaccttacagcacagccctgctttggttgtgttcacattactgactttgtatgagaggttcaccagctgtttgactggcaggagcaggagctttcacttcagtagtttataattcctggctattctaggatagtttgcacttcaccaagcctcagacaggtcaggacatttggtaggggaaggttgaaagacaaaagcagcaggccttgggttctcagccttttaaaaactattattaaatatatatttttaaaatttagtggttagagcttttagtaatgtgcctgtattacatgtagagagtattcgtcaaccaagaggagttttaaaatgtcaaaaccgggaaaacctactctaaaccatggcttggttcctgttgatcttaaaagtgcaaaagagcctctaccacatcaaactgtgatgaagatatttagcattagcatcattgcccaaggcctccctttttgtcgaagacgggtaagtctcacacatttgaaaaatatgaatgtttatttaagtgaagtaccttggcctcttttagtgaaaagatgcctcaaatttcagtttttatttaaaattaaaactatcaatgcattgtgtagccagtaaacacttatataagtgatagttttataatatgatatagagcctagaagatagggttacccagttcacctttttctctcatttatttttcatgaaattagaatcctgcagatttatctaaaattagtaaatgtaaaaaggtatgttttgaaatacgttgacaaatattagcactgtaaatttgtagtttttgcatgaaaggcaaaaagttgatggtattctccttatacatgggaaatacagcatttcattcgttaaaaagtgttccaaatccttaggcttctttggcctcttaagctgtattatttttttaaattgctattccttacattcaaacttaataggaacactactttttgctgttatataaaataaaaatagcatgctattgtgtggcagttacgatatggtttatatatagacaatcctgaactaacaaacattttgtagaacttgtatgatctattggatgtttctcaggattacgtactcctctccctggtcaacaagttttaaccctgttaacatgagcaattttttgtatttcctgagttaatttaaattgccagtttcaaattatttattagagtgatatatttttagatctaacataggtttatgagcctgaaacaaacaaacaaaccactgcttgggattaaatgagtgtatttgtgtatatcaacactgttagggttctatctttttgtgcgtttcttaaagttttattttgtttttaattgacacataattgtattgtactttttcttttagctaaaggggaaatattctattaaatagaataatccataacactggaagaatatttttcctccttaataaagagaatcttctatttgctggaacttaaccttcataaaaacatattttctagttagcttagttctttttgagtagtttccacttctacgccaaacaagtggcagccatgttggaaaacttttacatgaggttaaaatgtaatacagtttaaacatcgaaaacagaatacaaatatccccagcaccctcttgttacttttgtactttactgttttaagaaagtgtttgttttattttgtctgctttcaccttgtcattttagtagcttcttctgaatgaggtcactgctctgatttgagtattttatagaggcctctaatagctttaaagt

SEQ ID NO: 113523 - DNA, 1051 bp, Homo sapiens
tctttgagggcttttaaatgtaaaagtgaaaatttataatattgaatacattatctttattaaccagtggaataaccactgatggctaactaggtctttgattcatttttctaaatgccaaatgaacatgttaaactcgtagaatatattaccctcttctaatttttctgcattggagtatcacattgttaaaattgtatcttctatgtagttcaggaaaagaaattcaggggggttaattatccaattgatttcaaaggtatcactgagacagaatttttttgaaaataatctcagactgcagaaaactgttgtaatattaacaggtagtgttagtaactgagataaggatattccatgggacctactttagcaaaagggattgtctaatgagagaaggacaaaatatgacatatgtttcacaaacaaaacaattagtcttatgttggaaaataaagtgaacatctgaggagatgctaagactagcatgaacctagtattcattctgcaggatagtaagttgtctcatagggctgtagacatggtatcttggatatcattctcactttttttctactaccagtttataggtttccaacactctcatattatctcttctctctcctaaccttagatctctcgaggtttttttggtgatgattattccattttcaatcatttacttttttgtttaaaaacatttaaaatttatggttaaatatccataacatgaaatttaatattttaaccatgtttaagtatacaattcagtggcactaaatatatttacattgttatacaaccattaccactatccatcttcagaatattttcattttctcctactgaaactctgtgccaactaaacactaactctcatttccccctctccctgtctcagacaaccatgattctgttttctatctatgcaaatttaagtattccaagtaccttatataagtggatcatacactatccttttttgactgacttattttacttagtatagtatcttcaaggttcatgcatgttgtagcatatgtcagaattt

SEQ ID NO: 113524 - DNA, 2090 bp, Homo sapiens
atttaggaagtaacacaactaagttaggatgtaacattctgtggaattggatagatgttctgttacaaagcacaggtttaggaattagacataccagggttaaaatctcaactctactacctggcagctgtgttaccttgggcaaatttgtaagcctttctgagccttagttttgtctgtaacaagtagacaaggataatgatacctcagggtttcggcgtggtgattaagtgatacaaagcatgatctagtagaaactcttgtcagtgtttaatctcttccccttatcattgttccagtctgaaacaatgcgtacgtattttctaagccctatagctgcagacttcctttatatctcttactgatctctgatagtctccttagacttatttatctttctatcccaagatctttgtattacaggcatactaaagaatagtaggaattgaattttatttctttgtttctaatttttcttgatagccagttagtgttttacttactgtaaagaatgaaaacttaggctctcagcttaatttaaacctcagctacaaaaaataacattgatatttttcagaaaaattatttttttgagtatgtaatattgacagcgtaaaaggccagtggtatcaactgtcagcccgtccaagaattaagttctaaatatgtattttctattgcttaatcttatacttgttttctgtactttaattctatacttaaattctgtgctgaagtactttcagttaatattaataaatctcacatacttgcatagcacattactgaaaattatataaatgaagtatggtactatgtttatctttctcaaaatatattgatttttatttataattgcatcagaaactcaacagtataggaaataatgtccccctcctattttacctatttaaagcaccagcactccttcagattttttatgtttccataagtgtagctttttatttttcataagataaatttttataatttgtcaaactgtcaatttggttgagccttctgcattatagcttaattttttaaagctgtgtagcaaaaaaacacacaattacttactgtattttaaaagaatattagtattatttccttagtcctaattattagtataattagtattatgactccctggcctgcaatactcttaagaatttttataagagaaagatattattggtaagtaatgtttaatttattttaactgaaagtttaaactgttatgtttaaactgtttatggacttaagtactgacattaaagaagttattgtctttcttagacttaaattttattttgagaattatggaaaattaggttactttaaatcacttactctgtcattacatgaggctttttgcatgactgaaatacctgtaattactgtgtcatttttgtcatagttgacttaaaggtgtaactataataatcacgaactaaattcttggtgagcagctgtgtaaggccattttaacagctggggtaacccagctcagcctgtaagagttaagcttaatcatgagacaggttatgttaagtcattgaagacttcatactgggcatttctgaaatacttagaaaattcagtgggatagttggatttttgttttatcttaagtactttttaaaatgcttaatgaaaggatgaggaaaagtattttaacaactaaagttcttaggcacaaataatagaaataaaatccaaagtttactcattaaaaaaaaaaagtcaaatatactctatatgctagtgtttagaccactacagtaggtaggagaggaaaaaaatatataaacacacacacatattattatagtataatatggaatcagaaaaatcctgaggttatttttcttgaatttcatcttttaaaaatttttttaaaaatcattatgcctgtagcttctttccaataaaaatgttttcttattactatacaaaaacatttagagcacaggcatacatgccttttgtaaaagaaggcagacacaaaagaattgaaacaatgcattttatttggatatattttataaactagctatattgttcactaaactataataaaggaaagctca

SEQ ID NO: 113525 - DNA, 1060 bp, Homo sapiens
acagagctagcatttgaaaatccccccgtagtttgaccttagagatcacactgtaccactattcatgagaattaatgcatttgttatagctatactgttgaggacatgatctactgagtcactcaggaagtcctatgtgggaaattccttttatgtaatattaggaaagatgcatgggtgtgcataagtgtgtgtgtgtgacatattttctcttcccctgaggactcagtacatcgtcaattttatcacagggcagcagagacaacaaactacacaccagtgttttgcaaacttcagtttacatgaaaatcagttgagaacttattaaaaatgcacatcccgaccctggagtttagttaagtagctcttgagagtaacccagaaatctgttatttttaaaaagcactccagatgcttctgatgcagctggtccaaggtaacactttgaaaaatactggtgcagacacttaagagtggacaacctatatcctattactagctttctccaactcatcataactcaatccttacctcttctcatgaccttgccctcatattctactccagtattgtccctggttctgattttcatgtacactttgtcactttattatatgtatttttcctacatatagaccacttcaaatctcaaattccttgtggaagttggatactcatttctttaaaatgaggtcaattcatttggcagtttaataactaaaatcagtacaccaaactcataaggaaaagtccgtaggtcactggctaaagcacttaaagtgctatgcatatgccgcacttccactccaaacaacccaattcccattaatggatcagcactggaggcaaactatcgtaattttgcaatgggtgataaacatttctacagaagtgccaaagaacatcttcccttgcatttatttcagtttcagttattcagttcaagaataatagtccattcttcttccctacatgatgtctagtgaaaaataggtggtctatgggtcaaaccaacccacggaagtgcttttgcaaaatctggacaccaatatattttaaa

SEQ ID NO: 113526 - DNA, 1617 bp, Homo sapiens
gagtttagaggcgtaagaccctttcttgtctataaattctgaacaatagaggaatcaggtaataggatcattaaccaatcagggtatctggtccgccattctccaaccacctcctaggaccagagctgctgagcagctttgtaggataatgtggctaacattggaaatataacagggctctaagttacactctgttgtagagttctagagaatgatagcttcttcagaaagtccctggcctagtctacctgcaagacaagcaacttaagttcaaagtctgtttggtatatacatgtccagagagcaaaaaatgctatttaaggcagtcatcttgaataacatccactagtaaacatggcccaatgaatagccatgtcccctacctttgtgaaggaggaaaaatgaaacattgactcagcctaatttagcccaattttaaacatgtggggaggataatggaaatgggagaaatggggacaatgggtgagatgggttttcccctaacatattagagtgataagaacttttcacatctgagtttgaattctgattataccacttactgtataaccatgagtatataatctcagtgaacctattactttatctgtaaaataaagactcatgcctacctctcaaggtttttgtaaggattaagtgaaataatttatgtaaaacaagtagcatagtgcctgggacactcagatattttgcagatatcggccttgtgacctcattttttccgtctcctgtgccttaccccaaatcccacaaaataaacttcattccccgcagcggttgtcaatctctatatatatgttttacaaccttcagcattcagtcatcatatcaccctctagtgtaaaaagtagagaaataaattcttttaaaaaggtacataggaggattagaagagtactgtaataagctaggcccatcttcaataaaaatagacataaattttgaagtcgatgctacccacagatctccctagttgataaaatatgtaccctttcctttcattagaatttaagtcaatttctctagactttcttctaatctttaactaaagcttctgtatatttaaatgctttaatgaatcttccatatggatgccaaaatgaattttagctcatggttaatttctaattaatgcctgttaatatagttttaaatgtatttgttaatattattttaaacaataatagctctaaatgttggtgataaactgtatctcattcactgcaggtaatgacagttactattattaattatttaagagacggggccttgctgtgtttcccaggctgtccttgaacccctgggcataagagatcctcctgtgtagctgggactacaggcgtggaccaccgtgcccagctcaaaaagtattttaattatgaggtttcattgtagactaaagaataatcttcacaccaaatggaccattttaaaattgttttatagcattccattgattagttctttatacagatgataaacttcactgaagtatacacaaatatcacaaatagttatcttcaaaatgcttccaaagaaaattgtttcatatgtgtattataatgatctgatccatttttaatgttgtttttgttg

SEQ ID NO: 113527 - DNA, 1805 bp, Homo sapiens
aaattttttttgatacacttcttaaaattttgtggaagttttatataggatatagtctatgaactactgatgtaaaattaaaattgttttatttgcttgaaatattatgttttattggtcaaaggaattaaactataaatcttcatgctaaaaattattaaaagggattagtgttgtttactatggtttttgtgcatgtctttataaagtcttataacttttaaaattgaaatgttctatattgtttactaaagaacattttaatgccttggtggcatcaatacttttttgcaatcattaatgatatttagaaagtagacatataacatgaaagtagaacataatatagattgtacaaatcttgttttttaccctattttcccctgcagaatgtgaaaacctttgcatcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtggtagaggaggaacagcaacagcaactcagacaacaagaggaggagcacactgcaaggaatggtgaagttgttggagtagaacctagacctggaggccaaaatgattcccagcaaggacagttggaagaaaacaataatagatttatttcggtagatgaggactcctcaggaaaccaagaagaacaagaggaagatgaagaacatgctggtgaacaagatgaggaggatgaggaggaggaggagatggaccaggagagtgacgattttgatcagtctgatgatagtagcagagaagatgaacatacacatactaacagtgtcacgaactccagtagtattgtggacctgcccgttcaccaactctcctccccattctatacaaaaacaacaaaagtgagtatattcaatatattgttaacctgagaaactttacatatctattttaattgtaatgaaactttcctcacagtctttgtattactaaaaattaatcttaagatgtgtaataataaaatgaactagttttttgtcttacagaaggtaatggaaagtattacaagtagaaatactgataatgggacaatctgagtacaaatggagggaaagtaattgagcctattactatgaaaaattattaacatcaaattttcgtctaaaccttgcgtcccgggcagggattagtagcttgtgtggggtgtagaggtttcgggtgaaacatgatttgtgtaaatcaagtaatgaagaaactttttatttacaaaatgcagctgctagagtgggctattcacaagtgtcactctaaggcataaattactcagaagttgcctcaaattagttctagttatttatcatttgagaattagaaataatgaatattcatgtagagtagacttacaagttaaactatgttttggaaaggaacattttaacttgaatatacttgttttatagacattaacataatgtctgtggtagttcatcctcttactcctacttgcttatttcttacattttacagtgattttaggccataaacaatatacaaactgatttaacatcgtatcgtttaacctaacttgacttggaatgaagtatcttacacacttggattaataataattgaaatgctaaatcatgttttacatctgcttgtaaaaccttactttctaaaatgtgtttggccctaatttacctagcctatctgcaagtcagattttatttagctggcatgatctaaga

SEQ ID NO: 113528 - DNA, 1050 bp, Homo sapiens
ttagttataatgctgttgaccatgagttcgatgctaatgaatcaatgtatattaaagatatatttaggcagaaacacgcataaaaaaggttatgcattgatcagttggcaacagtgttgtgaccagaggcttgtgagaactgtatttcccctaggagcaatggctcagtatttgttaattcagtggttgcagcaattttatagaacacaattactgtgaatgggaatcaactgtatttgattaacggtggtgatttatagggactttagataccagaaatgtttcataattccctttctctgaaatcactgttttaatatgtttaaatgcatgcatgcagagttgtgatgttaaacataattttactgtgggttctggtcaaaaaagatgaaatgtcattggttaacttgaaagagacattattctaaacattatcctccagaaaattgacatgtacaggaagcatattgaatgctcagcaaataatttgttttagagtaataatctttgagtattgtagtgattcgagttttggaaaagaaggcagtatcagtgttagagaataatattctttcaggattttatgtagttactttaaggtgcatgaaaggagactcagttgggtgttaaattcttgtccctgctttacttgaaactagtaatcttgagaaatttactaaatcattttgagccttgattaccttgcctgcaaagtgaggaacattttcaatttaaaattctatttcttttattagtattcttcctgaccttgaatcatttctattcccatcatgtccagttgccaagaaaaccatgcaacttaatgttgtttgttagccatcagattttattttactgaactcaagttcagtcacatcagttaccgataaaataataagttctatattaatatttgatatatcttgacattttgtattatggtaggaagaaataaaagaccttcctcaaattttaggatatgggcttctgtttgttgatgtttgtgttttatgatacactgttgtaaatcatactaaaggttttctctga

SEQ ID NO: 113529 - DNA, 1061 bp, Homo sapiens
actgtcacctgtaccttgttttctcttgatacagcaagatactaagtatgctggaagccatgctggaagacagcttggcttagtggaaggagcagaaattttggctcagacatatctgagtttcaaacttggtagtgaatcttactaactataaatctttgggcaagcaaccttaatccaagcctgtttcctattttgtaaaccaggaataatgatttcagagttcgggattaaatgaatatgcagtcactaatatattgttggtatgtagtaggcattctgtaaatgtttgctgattaaatgaatgcagtggaatcatctttactaatgtgaatacataactggcttcatacctacaagattttctgctaatattttagttctgtatcttgagtagctaaattggtgttgtagaaaaaagaaggcatattttatggctttgttgttgttgttgttgttgttattgaatgagtactctaattttgcctgtgcaagaggaataacttcagaatgacaaggaaatccagaaaaccagaatgaaggaaaccttttcagaaacttgaagatctaagaaatatcccttcaacaaatctgaaatcagtgcttttgaagaacagtgaccatggttactatcttcctagttctctgaacggctgagtttagtggtaaaatcctgaagcagtcctcattgtaataagaaattcaagttgtggccaaccaacaatgctttctcttagttttaggttaaatgtacaacacagcattatttgtattgaaagtgagggtgttttgaagtttgagaatgtcagctactgccttgttaggtgtgtccagaaatactgttctataacctgaaaaactttttaaatttcttgtgtgaaaaattacagattacataagatattgtttactgatttatccactatgatagtatagctttatttgtacatacagaaggtctttataagaaaatcatgatatttcttaccattaaaaaaaaaaaagttctgtctgtactaaaaaaagaaagaaaaaagaacagttttaagtgggttataatg

SEQ ID NO: 113530 - DNA, 1914 bp, Homo sapiens
ttttattattcaacaggtaaaaagtttatagactctcttgacttccaagaaaaaaacccttctgtgaacactgatgaacataagcatgttaatatcatttaggattcggtcaaggatgtgtctgaatttcatatatattgaaaatgtttaatgatgggccaccagcaaattaatcatggatatgttttactggagtgccgtctatgacagcttcttttcatgatgggttcagcaaataggaaacgaggaagtaaacaccagagtgttgactactttttataaaagttagaaagataactatgattggtctgtgattagacagtattttatgtaaaataaatgggcagcgtgaagttctagcctcagtggagctgccttttctaaagagccctggatcgagcattaaaagagttggatttaatttggctctgccattaatctatttgataaccttgatcaaattatgtatgaacattttaaagtcccttaaacatgctcttaaaatgtccattaaaaagatttcaatttacccttaccagtgggaagtattagaatacttgaccttgaagctatagaagttagagttaggaagaaggatgaagtttcttaaagaatcaagttgtaggtgatgttaaaacctctcctttcactttttatgtctttttttgggggggtgggtgggtaacatgtttttgctaagaatactgttttatctctttgatatccaatatttcctaagtaggatagtaattctggaaattatcctagtggttaatagaatagacctgggattaaaatctggtgctgccaattttttctagactttctaacaaagataatgtcattagggagtttattcagtacctaggatattttttagtaaacacgttttaagaaggttggccattatgttattggtgctttcttcctgtatggcctattagataagcgctgtgcagtcatctttgttgcctaggcaaaatggtttgtaggttcattgattgaactcttactttggaccaagtgctgtactaagcactttggttttttttttttttttttttttttttttttttaaagacagagtcttgctgtgtcacccaggttggagtacagtggcgcgatcttggctcactgcaacctctgcctcctaggttcaagtgattatcctgcctcagcctcccaagtagctgggattacaggcacctgccaccacacccagctaatttttttgtatgtttaatagagatggggttctgccatgttgcccaggctgatctctaactcctggcctcaagtgatctgccccgcttggcctcccaaggtgttgggattacaggtgtgagccactgtgcctggcctgtactaagcacttctatgttaattatgtcatttatgagaaagactctaatgattatttttaaagatgagagaactgaagctcagagaggttctacaactcctaaaaatcacacaactgggaaatagcagaaccaatgtcaaaactttaggcatcagcctgctgctcaaaggaagtgctcattgaagcgcttcggattttgaaatttctgataagtataatgcaaatattttttaaaaatcccaaatctgaaacatttctggttccaagcatttcagataagagatactcagtttgtatttgtactttcaattaagctgtgagtgtagagatgaagccaaatttcatctgaagatgtaatataaatgattacctaatttttttagtcttgaataagaaatgatttgttcacctcttactcagcaataattcgtaggaaaaattattcatataaagcatatttgtactatttggagtaatgttttccaaagtgtggttcagggctgggcacggtggctcacattggtaatcctagcgctttgggaggtagaggc

SEQ ID NO: 113531 - DNA, 1305 bp, Homo sapiens
catagatttatttcaaataaaaatatgcaatgaaaatggatgcattatgactaagaccaaatgattaaaaataaaagaccaattaaagatgttcttagcagttttcttgaccttgcagtagatatccaatatcattttgtcatcatcagattgtgtagcaatggaaatgcactgcagtaattgattttgtaataggatcaggtgatttactagctgcactgacaaccacttgcttgcttgctctgagctgtggagcactctaatggatgttgtgatttcagcctggagtttatgtgagactgccggccacttaaagcagcagcacttattttaaagattagattagtttttctttcttgttttcttcgtttcaagttttgtgagtagcctcagtaactttatggttaagttgtatgccttcatgaaattttagagattatatattatttcattcatcaattcatagtctttctgctccatattcctagctaaatatcaacatattctggtattgaccatgagagcatatctctaaaatatgagagttattggtaactatgctgtgttatctaaatgaagtggaatattcctcacattcgtagatttcattagcttcagactctagctgtaattagaatgatggtaaggttcttgatctcttgagttgtactgcagttgttttgcatccttttttggtcttttactttcttagtggtttcatgggtaaggcaccatttaggaaatatgagttgtattacttctaagggatactgatgaggatatataaagctattttaaagtagtgtttaaggatatagcaaattaaaaatctaatatcaagtattataaatttcaaagtgattattttaaaataatttttgttttccttttctatgccttttaaacaaataattggttcaaatatagaagtgtaggaatattgctaactgtaaaatagaactactgtcatagaaactcagatgctgtcaaagactttgattacttaaaagttttgctgatggtgttagattagaaaagaaactctcttccactcccttcctcaccaatacctctacctcatgtaaagtgttttatacagactccaccacataaaaatactgaattctttatcattccctgtttctgttcttgccatgatagagacaccatttctctcaaccacatctaaaaacatttacaaaaattaaataagattaacaatttactgtagtagaaacggggcataaaattgtcatcacatgtggtattcaaatcaccatgttaagagaactttcctttttgatg

SEQ ID NO: 113532 - DNA, 1083 bp, Homo sapiens
cttgtttgttaccatagcctttatctaccaaaggatttttaaaaaattgaatgtgaagtgcatgcctgtttttagatattctggaaattgatttaagtataacatgaatatcaaaagggcagtgcaaggtgaaggcagaggcagtgctggatctttttagctttaaaccagggaagaaattgagcatgttacatacacaaagaagaaacctttcagtgtcacagacaatgggaagttttaaaatacgtattttaattcaaggtgtttattatttagttttagactatcttccccaaaaagggtgctcttacattagcaatcattggtctatgaatgttcatttaagttacagtaatttgaagtatgattatttgtgaagactataaagtatttgtattaatgcgaccctcccttgtcctggaaattgtaatgtggattaattacattgtataaacaaatacctttgtgcattattggcaaaggtagaatgcttaagtataaaaggtatagtatagctagcatacttaatattgttgcttatgttttcagggtggtttgtggtttttaaaataatcttttaaataaaatgcagacaagtaagtgggagaaaattcagtatcaaaacaatgaggtttttgatggctttttacttgtggtcagtacctacctatatagccatatgtccttttttctcattaaaactcttctaacatttatgatagcaggagcctccttggattatccagcttgtttattacatcattatctgcaccagtatttttgctatagatttttattgttcattacttctcaagtctacataaagtatccagagggaatttttgcttgtatattttattcagttaccctcctaccctcttccatcagtcctcaaagatttgtattagctactgtctacattttgtttatttaaaaaatacttaggcctatatttttgtattgtagattgaataataagattgaaaacaattctgtaaattaatctatagtatagaagtaaaatttgttgattattcttactgtgagtatttggcaggcttcttgaattgtagagtcataaaa

SEQ ID NO: 113533 - DNA, 1043 bp, Homo sapiens
tctcaggaactcccagggttcatattttgaaaattgctggagtcatctctcagaggctatgtgtgacaaatggtgtttttaaatgaaacaataatttttaaaatatagtgtcaattggctaagtttttatttgatactttttttttcttttttttttttgagacagggtcttgctctgtcgtccaagctggagtgcggtcacagctcactgcagcctccacctcctgggctcaagtgatcttcccactttagcttcccaagtaggaagtaggtgggactacaggcaagtgccaccatgcctcagtaatttttgtatgttttgtggagacagggtttaccatgttgcccaggctgctctcatactcctgggctcaagcagtctacttgcacccaactcagcatcccagagttctgggagccggattcttatttgatacatttttacctttaggggaactataaaaattagcttatgcttatttatgcaaataaatttgagcattgaggaaggatgtctcttgttcagggttgtgtttgtagatttcacatcttttagactaccatttaagagaagtgatcaccttgtatcttaaggaaatgaaaatcatttgatagaaatggattgttaaatatttttaaaacaagttttgacagttacttgcaattaaaggggaaagcaactttaaaatgcattagttaattgaagaaatactcaagatccttaattgttgttagtgagcaagtattaatgttctttcctctttgaaaacgtatctgtacctagacaaagttaattataaactttttcataaacaatattatgcttctttttcttctaatttttaaaccttatctttgttggtttgccttccagctccatctatctgcaacctaagaatcaacaatactatacatcaaattagctgatgtggaaggaaaatgataaataatgaaaatacgtcatattgcttatactctaagttataattaatataagatccaagggatattggtgtgggggacgaggaggaaggaacattgca

SEQ ID NO: 113534 - DNA, 1180 bp, Homo sapiens
gctgttgccaagttgaaagtcagtgtttagttttttttaaaaagggctatttagtgtggaattcctaaatattatagttccctcttctgtcctttcagagctattgcaccctgttaaattttttttgcattcagttcaaccagtgtttgaaaattaccaatagacttaaagtacttctctgaagttagaagagctcctatgtctgatgctatattgctagtatttctattcaggttggaatttggaatagtcattatcaaaagttatttgtaggcaaaagaaaacaaaaagaaaaaagttatctgtaggaaatattggagactggggtacaaggtaagtgacacagtgaagaagcacagacaatttcagaatatgagacacctaacatggtttctgcaaggtattggcgtggaaaaaaaaaaaaaagggggggggggcttagagagttactctccagtaaaagagatataagaagcagtactatagttatatacaaagggtagttctttggattctgtttagatcaaattaactagaaaatacatttttaaaataagatggggaatttgaatattgactggtattacttaatatcgtggaaatatacttattttgaatgtgtatagtgactttgtgagtatgaaaggcagtggccaaattatttagtgatacataatgatgtatatggatgagggaagtaatgacgtgatgtctggaatttactttaaaataccttggaaaaaatgaataaaagatagataaagcaatattgctaatatttcagtacctgttaaatataggtgacagtatatatatagaggttcattatactcctttctccacgttttgaaaaatttcatttaaaaattcaaaaaaattctaaaaaatattttttcttttagaaactaacacatgctgaaaaaattcaaattttgttcactgaccacgtttttgctgccaccactctttcaacatttaaaaaatgttcttaaatctttaaaaattcgatttacattttcattaagaaaatgaggcatttgctggccatttcatccttcctcttgtattttttctccttacctgctgccaccgtttactagaaaaatatttctcttgttttttctgtaccttctccttgaaatataaaagttcagtgaaggcaggagagattttagcccgt

SEQ ID NO: 113535 - DNA, 1147 bp, Homo sapiens
gacttgatgcaaaggatttgtactataagtttattataaaattattaaccgctagcttttgtaaatagtaaaattgatttgcccattatacatttctttttgttatgcataaaatattttaatttttaagtaccaacataggatggatttttaaatgcttcctcatgttaattttttaataaacatagaatgaatactgtgtgaaatattttcccactttattggctctgttttaactcagtagactctatagttagattgtctaggtgccacttaaaagatggtaactagataccagaatgtgttacattatatgttgattgtcaggaagaactgaatgcatgaatgcttccctaagacattgttagcatgccgtggtcttgatctataattttttgtctaagttgtgatagagctcattctttacatggtctagtaaattcagccaatgtctttataattcattagcatctctatatattacctataaaatttaaattataaggctatgaaaaaattgtttcatatgtataatataccaaagttttagcatatggtttggattttaaactgttttactgaaacaaattaccgtcattaaatggaattcttaggtagacattacagagtaggtgtaactctgaagttgaaaatggtttcatcttcttttttaaaaaattttattatatagggaatctcaaccaccagcaggattttaaaaaggctatctaaatatttggtaagtaaatattctccatgttaaatattttgcgtgttacttaagtttacacatatgctacatgaatgacatttacaatagtgagtgtaaattatagttataattaatattttaaattttacttggttactagaatttttgtctccttaaacctattccaatccttttctctcttgttctttatgttgtgtccagagattctttcagtgtacagccttattattaagagttcaaggaaagaaatggttttagtgagcaggaatgctaatactttatgaataaaacaggatttcccctacttgagattttgtagtatttcttttttgtgaaaacactaatacagatttgttctttagccatccattgcttgactcctccttgtatttaggtcctgtttgctgcaacatg

SEQ ID NO: 113536 - DNA, 1054 bp, Homo sapiens
tgaagttattgaaaataagagcttttgggaattcaggtagttcaggagtgacttttctaaaaaacagaactgagcaccatacactacttcttatagccttttaattactgccaattgcctagaataaagttcaaattcgagggcaacacaaacatggccctttgtgaactgacagacatttcctaataattccttacatacatgatacccttgagccttacagaattaagaatttctgaatttaccttggtgtttgatgcatctgtgtttctatacgtgctgtttatttacctaaaatagactattctctatttagcctcaaaagtctcatggaaggttttaaaaaatcctgtctaagctctgttaattatattctttatactattatatttagtagttaatattataaactaccttacagtaatttttacagatacctggcttactccctaaattgagttgcttgagggcaggaattgtgtattaatctttgctgtattttctttgccttgcttactgtagttgattggtgctaattgaataaatgaacatttatgcttttctttttgagaatattatatgggtagttcctttagttgtttaatagaagatagcacagacttctatacagattggtttttatgggaaaacacaagagaataattaattaaaacataatttcatctagaaatttctgcagttggagcgaatattttttaagttattaacttacctagagtggaagattgaatttttgaatgatagtgttttagttattaaagtaaatggcatgtaagagaacttttaagttcatgtggcaaaacagggaaaaattgcaaagttagagtctgtaaggtttctgatgtttcatagactaacaaaaggttgctttattagcagcattaatgaacgaatcgctttattggcctaggcatactggtagcattgtcgttccaaagagctgagagttcttatttcaattcatgattatgttagacaagtgaagtgaaagccgttgaccttctcttaaggagaaaatagaaagtttttacaa

SEQ ID NO: 113537 - DNA, 1024 bp, Homo sapiens
aacattttagcatccttacatagactctccaatatcctggtcttatttccctgatctcctcaaatctactgatttttctcttcctcagacaagtgatttttcacttatttggtaaaatcctaattctggattaactcggttatcagattctttcattcctataccacctgaatgctgcagtaaaaagttacctcaaaggacatttaaaaaaaattataaattcatgattgttgatcacagaccctaatactgcatgggaatccactgcattatccttgtcagctagtttcctcatctttaccatgactgtttcaatcatctgttctcctcagacctccaacatgccctttctctttctacagaaaacttttcctgttactttccagtgaaaaccggagtacttggtgcaacccttagttgcccactatcttttctatattttctttcttcttaatgttaaaatagaggtagtcttgctttctatctaaggctttctccctttctctgcagtaccttatgctgttgatgatttcccttttttttgtatgtttaacttttctttacacttgattcttctcgtcagtatttaaacacgcttaattcctgctattaaaaaaataaaaacaataagcattaatgggtaccacattactgacctttctgttctctttcctagccaaatgctagaaattattgtttccatttctcacctttgactcacctgtttagtttattcattccactgtaatagtatttgcttatgataccaacaacctctctgttagtaaattaagtgaatatttttaaacttggtcttatttgatctctcacttggtgtgctagggcttctataaaataccacagactgggtggcttaaacaacagaaattaattttctcactatgtggaggctggatgtcaaagatcaaggtgttggcaggtttgttttcttctgaggcctctctccttggcttgcagagggtgccttcttgctgtgtcctcacttggtttttcctctgtttgc

SEQ ID NO: 113538 - DNA, 1052 bp, Homo sapiens
tttatgatttttgttaccatcgtgaatggcaaatttttataaaaatactttttgttactggtagctacaaaccaattagtataagagacaaattgctaagaagcaagttgctgtttgtatcttgattttgtatctctcaatcttgctgaattcttagttgtttttgtttgtttgtttgaggtggtgtgtcttactctgacacctaggctggagtgcagtggtgtggtcactgctcaccacagccttgactgcctgggttcaagcaattctcccacctcagcttcccaagtagctgggaccacaggtgcatgtcaccacacccaaccaattttaaaattatttgtagagatgaggtcttgctatgttgcccaggctgctctcgaactcctgggattaagcgatcctcttgccttggcttcccagagtgctgagattacaggcatgagccattgcacctggcctaaactcttacttctaatgatagattctcttggatacctcatgcagataatcatataagtagtgaataaagatggtttttgttgctttctaagcctatgtctttatatttttcttctgttattgacctatgtaggaccactttactaaaattgcagcttttcctgggccttggctttatgtgtgtgttaatgtatggagtagaaaggggtatctcagaactgaagtctcccactaagggccaaaagtctcatttctagtccctacatatgagtcaaaggataaatataggttaagactagcaacccattgtagggaagaaacattgccaacttgtagcctaatatatatatttttaatatgttactgttttttccatgttactggcacacacttaaagatttctgtttcatggtggctaaaggattaatttaaaataattttttttttcctttttgagttgagtttcactctgttgcccaggctgaagtggagtggggtgatctcagctcactgcaacctctgtctcccggtttcaagcgattcttctgcctcagcctcctgagtagttgggactacaggtgtgtgccacc

SEQ ID NO: 113539 - DNA, 1026 bp, Homo sapiens
ttcttttttttttttgcagtggcacgatcatgagtcactgcaagcctcaatctcctgggctcaggtgatcctcctacctcagcctgttaagtagctgggactgcaggtgcacaccaccatgcctggctaatttttcatattgtttgtagaggcgaggtttcatcatgttgtccaggctagtctcgaactcctggactcaagccatcctgtgttggcctcccaaggtgttgggattacaagcgtgagccactgcctggccccagactttaacttttattgatgattttgtcatggtgattttctgtttccatcatttcttctgtatttacattagtggtttttggtaaggaagaactttcccttgttatgtatttatttaatgttttatgtatatcagaatggactcgcggattttttttcccctcttatatcagatggacttacagattcttctatggatttcatctattatcatcattatttattttggtgctctaattatcccaggtttggccccatgaagcctcttcaaggaggttcctggtccttttgacatgtctccatcattttgtgagggcttaactttttttttttctttttgagtcagggtcctgctgtgtcactcaggctggagtgcgcagtggtatgatcatagctcactgcaacctggatttcctgggctcaagtgatccccctgccttagcctccggagtagctaggactacaggccaggtatgtgccaccacacccagctagttttcgccttttttttttttctccaatagagacagagtcttgctgtgttgcccaagctagtcttaaactcctggcctcaagcagtcctcccaccttggtctcccaaagtgctgggattataggcatggaccaccacacctggtcagaaggcttaactttctagtagcgcaaaatgttctagtctcttcttgtgcttttctctgccccagccatgaaatcagccatttcaccaaggaatattgattccttttactggaaatcggaattctt

SEQ ID NO: 113540 - DNA, 1003 bp, Homo sapiens
ccccacccctgagaatctcagaatttcttgttgagaattcatattacagtatgagttgtaggaaacatgaaggaaagatttcccttctagtcagttcttatatttatcacttgtttcatgctccttggtgtgtatagtgttttcaggtgcaggaaatgctctgggaagaatgttgcttcttagaacgtaagagaaagggaaccccaagggaagactcaaatgaagtccttaaaaagcccacttagcttcttctgagacagcattgtccaatggaatgcaagcgagatagttaaatttaaattttctggtagctatgttaataaagcaaaaaaagaaccagccaacattaattttaataatatattttatttaacacaatatatcccaaatgttattttaacatgtaatcaatatgaaaaccatgaagactttgatatttaaaattcttattttaatactaaatctttgaaatcagtgtatattttatacttacaagacatctgaatttggacttagtcacatttcaagtaagtgctcattagttagtgactaccttagtggacagtgtagatgtagattatgaactttttaggaaaagacaatagcatgtggactccacaagaaattgtctttaacaactgtttgactctcataggttagggctttagtgtttcagaatggtttctatggttgagatgtaaagttttttatttttataaaggtaagtacatttttatacattttcattatacaagtaatgtcattgttgaagagttggaaaagtctgggtaaaagacaacaaattgtcctcacttcctcagtccagagataaccaatggtaaactttattgaatttcctctttgggaatgttgctttttaaaatcaaagagaaaatagatttcttttttgtcataattccttcctgttcacattcagacatacattattattgacaattcttttacctctttgtttaaatttatgtattctttttctcgggct

SEQ ID NO: 113541 - DNA, 1060 bp, Homo sapiens
atgcacagttcacaatagtgtttgtgctcctatgagactctaatgccacagctgatctgacaggaggcggagctcaggcgataatactccacctgcagctcacctcctgctgtgcggccgggtttctaacaggccacggaccagtaccagttgtggacccctgctctacagcaaattaacacaaatttagcagcttatcttacagtttctattggtcaggaatttgggtatggtttagctgggtctttcctcaggttctcactaggctgaaattaaggaatcagccggggctcctatctcttctgaggctctgggttctcctccaggctcaccggttgtgggaagagttcaattccttgttcttgtagatctgatgtccctgtttgcttgctggctgtcagccagggaccactttgagctccttagaggcccacccccgccaccatgttcttgccatgtggccaagttattatgttgtgtatgactaaggaagaaaaatgctggattaaaatataagacaaattcttactttatgtatgactaaggaagaaaaaatgttgaattaaaacatgatacaacacattattgcttggacagtgccttgcaaaaaaaaaaaaaaaagagagttgtggttattcttccagccacaatatctgcttcagaaatgtcaaatttattttctactgttgtgtttgtgttcttttttgtaaacaacttttttgtttcaatgctgaatcatagtattttacaggacatttaaaattaagaagtaagcgtgacttcttattgtactactaaatgtacagaatttagtaataattatggtgatataaactgccattacccaatttgcaagtgtacagggaatgacagctatgttgtgactgccatgggcaaatggtgatttgtaaagcattgttgcttttttccccccattttaagttgattttattgagatataatttatatacagtaaactacaagacatttctgtcaccctcaaaagattcctcatgccccttcacagttaaatccttccctgcaccctcgcttcaggcaa

SEQ ID NO: 113542 - DNA, 1051 bp, Homo sapiens
aataaaatagtaggctgggtgcagtggctcatggctgtaatcccagcacattgggagtccaaggcgggtggatcacttgaggccaggagttccagaccagcctggctggcatggtgaaaccctgtctctactaaaaatagaaaaattagctgggtgtggtggtgcgtgcctgtaatcccagctactctggaggctgaggcaggagaattgcttgaacccgggtggtggaggttgcattgagctgagattgcaccattgcactccagcctgggcgacacagcgagactttgtcttgaagaaaaaaagaaaaaaataagtattgagtgctgaatgatgttctataaaagattaaaaatgcctaagtggaactaaattctggtaaatagaatttaggggttggggtagaaagaatcagataagtacttcaagattttcagactttaagtctaaggctcattagtatcctctgacataatctactacaggtttcctttcttagaagtgaatgttaatatggcaccactatacaaataatatcgatatcggtatttgagtgtttattatgtgacaggcactgttctgtgtccttcatgtgtattacctcatccagtcctcacgatagctctatgaggtaagtgttgttaatatccctattttatagctgaaaatttggcatagagaagttaaacatggtcaaggtcccacctttagttaatagtggagctgggattgtttccaggcagtctggctctagagcctgggaccttaatctttattctatactgtctgtgtcatctgtaaatttatttcttatatattatttatagaacagtgcctggcacacaataagagccatagaagtactggctattttcattggcatttaattatatatgaggttggcagagcatgcattattattccatttgtttatttatactattaattagatagtagactttattcagatttctgtgtttcctttttttaaatagtcgagtttaccgaagttcttagaaactggatgattgcctccaataatgtggccatg

SEQ ID NO: 113543 - DNA, 1025 bp, Homo sapiens
ggggtttcaccttgttagccaggatggtctcgatctcctgacctcatgatccacccgcctcggcctcccaaagtgctgggattacaggcgtgagccaccgcgcccggccggtaatgattgattttttacccccagttatttttaaagaattggcaaggaaggagaggggtatgaatctagaagataagaatgtagattttgtaattcatgatcattattattaccatgtattgaatgtttactgtatgtcaggaactgtcctaaggatttttacaaccgttatttaacttagtcctcacagcagttcatatgaaatagctactgatgttttatggcaaaggaaacaaattcagagaaatttccaagaacacatcggaattttgacttgcagaactgggattcaaatctagatctgtcatactccatggtctatgcttttaatcatgcatgctgtctcttaagtttttattgaaaatggaaagttgtactgacataggaggggaaaatgatagaaaatcatcctattggaaggcagattaacagactcgtgaagaagcaattcccagttttatgtcattatacaaaataattgtgaaattgaagtccgtcatttgaattgatttgcattaaccctcattttttagtcttgctcttggaatcatcatcaggacaggtgtcccagatatgttagcagtagaataaatttatctaggcaaaatctgtctaagattatggagaaaactgattttatatgtgaaatgtgttgttgagtgagagttaaatcttttgaaggagattatttcaggatgagcctcaaatacattatttaggatttgaaaacctatggtttagcagaaaatctgagaatcaacatttgttagtctcttgggtataaattgcttaagtcagtgggtatctgattattctttctttctttctttatttatttatttatttatttttgagacagagtctcactctgtagcccaggctggagtgcagtggtgtgatcttggctcactgca

SEQ ID NO: 113544 - DNA, 2003 bp, Homo sapiens
gtcagatgataaatgctgggtcattagtggtagagctcaacagtgattaggagcaggaacttgagccatcattgtttgggttcaagtacaggctaccacacttactggttgtatgacctttggcaagttgtttaacctccctcggtttctttatctgtaaggaggggaaaatgatatctacccacctcatggttacttctttgttagtattaaacgaagtaaatgagaagctcgaaacagtgcttagtatataacaatctataacagggtccccaggggacatttggcactatttggtgatgtttctgatggtcatttgggggagtggggagagggaagggtgctactggtatctcgtgggtagaggttaggtataaacaaggtataggacagcatccacaacaaaaaaattacctggtccagaatgccagccctgccaagcaacattgggaaacccagcttagttcctttgtataaggtactttgccagttagattctgtatacatgctgattattgataaagatgagtcacagacatggataggcttcatttaacattcattttaaaagacagacatgtaagaaggttagtaggtttcatttctttttaaggttacagggaaagtactccaaaattaatctaaaagtccttacacttttttcagaaactgagaaaaggttccagatgaattttactaatttaatttttttatgacgagctattcatgtaaaagtgtattatgaatagagggcttatgagatatgagtgccgtagtgtgtattcataaagtcaaacgtacacttaaaaaacaagtatcaaggtaaatggaatgatctattgggggaaaccttggagctctctctctttccatatgttttattactcaccaagtcaagggctctttaacttaggatcttgtttttctgtgtacacttttcctgtttactgtttaaaattggacccttactaaaaatacagaaaattagctgggcatggtggcgtgcacctgtaatttcagctactggggaggctgaggtagggagaatcgcttgaaccagggagacggaggttgcagtgagctgagatcgcgccattgcactccagcctgggtgacagggcgagactcagtctcaaaaaaaaaaaaaaaaaaaaaaaaaaattggacccttaccattccttgtccatttcaggagcctcttaattgccttgcttctgttctttctctgtattcccacttgaattgactcttctttgctgggatccctttgggatcccttctagtccagatccaatctacccttcagagctccttccaccgtccccttatttctgggagagaattcagccttaataccctaaggatggaatttgaatgtactgacttttctgctatttacagggttgtgtattatctttggaagaattgggaagtcatatcattttctgtatgttgtggttcaggtgacttgtttcacttgtatccaaacactggttgtgtgtccatgtatatacagcatgtatgtactttaatgtctatttgtatgtgtgtgtacatgtatattctttcatgtatatttgtctctacaccttgctgtttcctctgcttggaatattcttttcttttcatctgggaaacatttgtctcttcagaccctacttaaatattgatctcctaggaagtgtgtcctgattaatataactagaattagttatttttttccactggttacccacagtatctctgtggcttttatagcacttaacatccttatttgtatttttcttttctactgatctctcagttctttgagggcaagagtcttgtcttagtcaacacctgctcccccaagtacctaacattcctgccacattgtagacatatagtatgttaacaaatgaatgggagagacaaaaaactggaaagcttttaaataagttctatgggggttggcaggaggggagaccacacattatcttgtcacctttgtttccaagtgctta

SEQ ID NO: 113545 - DNA, 1911 bp, Homo sapiens
ccaaggtgtagggaggggggtcccagccgcagcgacacatgcgggagccgggagcgggggcggcgccgagcggagccggccgggtccctcgccttgccgccgactcggccacccgcccggggccgtagcatcttgccccggagtgtatgaaccggggccccaaccaagctcggcaaccaccccccggccgggggggcggggaccccgatgtgaagcggcggctggggcggcggagagaacaggaccgacgccgccgtcctttcctcaccttccccctcccctcagccccctccgggggtcttctcccttggccagtcgccggccccccggctccttggctggactccgggaggagttcctagagcccccctcccccgccccagtcccgagggcggcggggccgggggggacccggggggccggccgcagcctccacccagaggaaactttacaaaaacaaaatccggagtctcccaaacctgactgtcccgggagaagtggccctggacgggcagaagccgcagcctgaaaagacccaggaagaggaaaagaggaggtaagcggggccgccgcctcccctcccctggcagcgcggaagagacccgggttgccgcctggtttagcgacacgagcaccgcttcttcctcagtaccgcgccggagccttccgcagctgccgcttcagtccgaaggaggaagggaaccaacccactttctcggcgccgcggctcttttctaaaagtgtgagtggccccgggagagggaattgagggggagaaagtgggaggatgccggcgcttcctcctggagttttgctgatgttctccagtagtgttgggagtctatcaatgagggagtctagctttattcacggaggggggaaggtgttagggaggcctgtattttgtaactttttagctctttgtacgagtaatgcaagtatgcaggtttctgtcggaggagtcttttctccaaagtgaatactcgcacctttctggccagcagttggcaaagggaaattgaggaagccagagcatatgtgcgcacagaggccatctgtatctgtaaccttttcctggtactgtgggtgtgtgcggtgtactttttgtttcgggggtactctcatataggttcccgaatgagaactacttaacctgtggacccctgaaagtaaaattccttttttaaaaaacaacaacaaacctgttttgagagaggttcatttcagtacctattggtacaggagttaaccttctcagttactgggtccaatttcatgtgtgtcaggaggacactgtaacagatgtcagttactcaggaacttgagttgttaggaatcacaacttacttggggaagagcatttatcacattaatcattttataaaagttgtgattttttccctttcacccccccctttttttttttagagtaacaaattacagcacttttttatttggtttgaggctttgcttttttgaattatctttatttctgtatcaatttaggatacatctttgatatttaagtcaggaatgattttttccttccattattttaaagctgaagtttataaaacctttgacttgtattttaggtatcttgtcagagtaccaaattaaaggtttatgaaagtaattaatatttcatatacagaccttaagggttaaacatagagcagaattttatgtaagaagacatagacagtagtatactgagaattgtggtccgtctagacaactgtgggctcgttctgtctgaagccactgctgagagatactttgtgggaatgaatgtaagcctggggttatctctcttttcgaagttctccattcaggatcttgattagattaatttaaaactttctcaaacttaacaatgtttggtccttttttttaaagtaatgagttctg

SEQ ID NO: 113546 - DNA, 1026 bp, Homo sapiens
tcgtctcaaaaaaacaaaaacaaaaacaaaaacaaaaattagctgggcatgatggtgcgtgcctgtagtcccagctgctcaggagactgagacaggagaatctcttgaactcgggaagtggaggttgcagtgagccgagatcgtgccactgcactccagcctgggcaacagaacgagactctatctcaaaaaaaaaaaagttaaattaaattaaaattaaaaattaaaaataagtaaataaataaagtaattgtccttggatactaggggagaaatgcttgagggatgttttccctctggtgggaaattgaaaagtgctcctcttccaggactcaaagttggccatcaccccacttgtgttgttatctcatcaggcctttgggggctcagctggcactgttgagggactgctaaaaatgcccgataggtcaaagcaggtcctgcggctggaagactcacactttaaaggagataagacattcattcatagggagcagtcagataatacagaaggcagcctctgatcaagcttccccaatgtgtggttgagagcggggtgctcaggtgctcaggagagagagaggtcagtgcaaacagctcagccccgctaatctcaacatttgcccttcagacctctttctcagggataataaggttttctcttattttcttctcctcctcctctttcttctagaatttatttgccatatgtttcagagaaaaactcagaatattgaggctggataagagcttaaagtgacttttctcgaagtgtggtcgtcagactccctgcttgagaattatctggagtgttcattaaaactgctgattcctgggccaaaccctgggctactgaattagactctggggcagggggtgcactgggactccgcatttttaagaagtttcatagatgctttttatgcacactttagcatgagaactgttgatgtggaagtaatttagcttattttgccaatggggaaactgaggcccagagaaatgaaactgctttcccaaagccac

SEQ ID NO: 113547 - DNA, 1033 bp, Homo sapiens
ttcaactcatggcccacagtgactctcagatatttatgccaaaattgcatacaattgttttctgaatcataacttgtctatttttctgcctatgtgtgctactttcagtttgtttctcatcaacattttgactctcagaagagcctccatttgcccctttctctctttaggtatctaagatctttgaacacctgggcctttacatttgatccaaccctatcaaataatgaacttctcagagaggcatctggggtcctggaacttcatgttgatgaagtcatattatataatatgataaaaatattctcatgcagtattttaaataatttcaaattctagaagaagcaaatttcagcgacatgtcattgagtttttatttggtaaagctataattgtgcagtgtacaaagcactttttaaaaagatagtttattctgtcagggtatatgaagttagtatacagccagaacagccaagcctcaattcttgtaccttgtgtctttttattactgtttaatcaatagatatcatatgtttatgacagtttcaagaattgtttttaaacccaaacttaattttatgtttcagactattgttaaaaaaacaaaacaaaaaccaaaaaaaccctcactaatttgccctaattggatagggcaatcagaacaaaatctgactttcgaatatttaaaagatatgtaagtttgattgcattttcgtacattttaagcaaactaggttaacaacaacatagcctagtcaaacttctcaggaaacttgttttaataaatatgtaaaaatacccattcatgactcttgacccaatggtgtgactcctccctctgggaagggctttgttacccaatgcaagaccacagcctggatccaccttgatgtaggtggctcctggataacccacatcaaacaaatgtgataaagatgagtaaaactggtcttgggaaaataatttcatagtttttttttctcctagttatgctgtataatacaggagaaccaaaagctgtaaaattatttta

SEQ ID NO: 113548 - DNA, 1795 bp, Homo sapiens
aaaaataacgagtggtgtaatagaaaagaactcatgaccataggaagatcagctgttttcccactttacccaattctttcctaccgtgcaatctgatggaaatcattctgcagacacgttggaacctcaggcgaagccatcttattccactgtctatcctgagacatgcagattctagcttttggagcactggggtgctgcagggacagaataaccaagcagtgatgaattgtgtcctttccagtgtcagaggcatgttgaagttttgcatctgtgttattagtgctttttccatttcaagagccttgacatcattaatcttttcatcactatcactccttggtgaggccatttttgtgcaagtaaccacgcagatcagagaactatggtatttaactgtatcaggtttgtggatagaaaatacgatttcagtaactaacaatgagtttgcttttattctgtcctagccgactttgaatgtttacctaccttgaaggaagagaaggaatcaaatcacaacccaaggtacttctcatttctaccacagattacatgtatatggcggggggcggggggattgggaaccagggtggaacactttttgcttacctcctccgtgcctataattcgtatgagatcatttacgcggctggatatgtgcatagtgtggagaagaggaagtgtgttacagaaaatagaaggccacaaagtaaatatcctaggactctttatctttagaaataaatgagtattgacattttcttgcccttctaaagagacactgttgcttcagcttctgttttagtcataaagctttccaattatgacaaactgtaggtttgtttaccttggataaatagatgtttggtaaggaaaacagatggaggcgacagtcttaaagtgggtaactgtaaactagagtgagaaaataaatgggaatttttaaaaaatgttccattttaccactaggtggctctggttgatagaaaaattttagtgctttggggtttgggtgtatagtttagcattccacaatctcattttaaattatattatcttttgtgaggatagaaatgaccacatttggggtgttttgattagagaactgttttgtcaggacatgggaagtgttctaaggaaaaaggttggatggttcagaaggttggggactggctctgcagagctctgctgtgaccttggaggtactgagttgttggcagcaaacactcatggacacccggagagaagaaaacttgagcctatgcctgagatatcacacttctgttggaataaatggaataaaccttcaggcaggataaatcctctccctccatgttcaccagaagtctggtgccagtcagtcacttgtcaccaggcaacccctgaagcctgagcatcgcgagggaatactgattattaggcaatggttgggggcagtcagatgtttatcttcggacccttttcctgcgtctcccccctaaacctcacttaagaattcaccatcccaaatctctcctcacatcacaccaccacagtcttactcagacaaacctcagctctgatgccaaagtctatacctattgtagatttaggtcaatatcaccaccctaggcattttcatgttaagattattgccagttcaggaaggattctatcctatttaaaagagattccaggtcatgcttggtggcgcttgcctgtagtcctagttacttgagaggctgatgtgagaggattgcttgagcccaggatttcaggattgtagtgagctatgattgtaccactgcattccagc

SEQ ID NO: 113549 - DNA, 1034 bp, Homo sapiens
gacataaacttaaaaaaaaaaaaaggaaacgggaaattatccgaagagctaccaaagagctatgtgttagagggtagccctctaacacatcaagtaaggtctttcatctacttttattgcaccttgttacttttacagattttttttttgcattgattgttactaatgaagatttgtttgaaaaagtaatatgattggaaccaatcaaaggtattggaaaaaacaatattgaatctcattattatgggctaaaagcaacaactgatttacacccttgccagttgctacaacaagcacaagcaccttcagctgcctctcttgttgacttgcctttgggcaaatacactggctgcccattgtttctgtcaatgaacaccgactgcttctagtgtagggcagtatttaccaagcaaaaggaaagttctcaagctacagttctttagatagaatgagggacatcagccccaacctaacagatgtgacaacttcctggaggtcagcagccagcacccagccaccccactccatcaatttctcttcccctgggtgttctccatgtggtcccccaggcatctgaggtagaaaacaaagtggaaggcaaatcattccagctgaaaagatgtctggttaaattgagtttagtgttcagagtgggtttggaagttgatgtgttgttttatgcccagtgttttggagctggaagggaacttgaagatgatgcagctcaaaccatattgggcacacaggtgaagaaacagaggtggaagaagggagatgtctgggtcttgctgctagtcagctcttctggcttctactccagagttctttgagctcctccaccccccaccaccactgcccccctccccccaccgccgccccggaaccaatcactgtctctgccaagagctctggaacctttcgtagtaggacatcagggaagaaaagcctagccatcctccttccacctcttctattgcacaacactgccacaggtgcctcaaacactcccttaatactaattcatcttgcctgaa

SEQ ID NO: 113550 - DNA, 1037 bp, Homo sapiens
aacgactcttgctctgtcgcccaggctggactgcaatggtgggatctcggctcactgcaacctccacctctcaggtacaagtgattcttctgcctcagccttccgagtagctgggattacaggtaccccgcatcatgcccggctaatttttgtatttttgtagagatggggttttactatattggccaggctggtcttgaactcctgacctcaggtgatccgcccaccttgtcctcccaaagtgctgggattacaggtatgagccactgcacccggccctgagccttccttttatcgactgtaaagttatctcattccttggcctgcctttgggtctgtgccaaaatgcagcgatggtggctgactctcttgctatggcaagctctgaattaatatccattgcttggtttcatttgcttgtgctcatttagtcttcatttatttccaccatgtgcatgaatgtgtgtgtgagagacagctgtgtgtgtatctgagtgcatgtgcacatctgtgtgtattgggaatggcaggatcggagtgtgaagaggaacgcggagaaggctgtctgcacccactggaagatcctatcatttatctggatttgttcccttggagtccctcttcttttatggcccatggagtggtggtggggagggggcggggggaagggagggaggataggatgagagtcacttctgtagcacagacagttgattgtaaaagtcacactcctttgtgtaaagtaataaagagtccctagacatggttcccagtgtcccttcctgcccttctgaacatgatgaagcaccatacttctttcctgctttcagacagccaatggcaggctccaaagtggcattacccctgcctgtgtgccactcactctgaggttcccctgtgccccacatctgggactgaggccctgacttcctgccaccagtgcatcgggatttaatctgaggctgggtggctatttgcctaaattaatggttgctaaaattaaaacagaggtaaatagccctttacctaccacacag

SEQ ID NO: 113551 - DNA, 1058 bp, Homo sapiens
ttgaaaaatcttctataagagttttttgtctattctcccctttcagtcgtttatttatatcagtctgactcatggatatttattttatacttaagggtaaatccagtagtactttattactttgttgctcaaattgtttcagctgtggccactgggagctcttttagttggttcctgtattcctttgacatactcctgtcattgtgagacttttgttcttgttttgtttgtttgtttgtttttgagcacttttaactttctggtattacaaaatgctctaggctcaccttgtgtattacctaccacaggcctagaatcagccttttctccaaggagcactgattccttctattggagaatagtattagaaaccaatatctgggcactatgtttgctcattgctgttggaatgtcattgcttctaggccctcccagtggacagagtaaggaaatatatgtgtgtacactaactcatgtatatacacatatctataaatatttctatatgtaactatatatatgttaagctatattttcagtttatttcctgtgagcatttttcattaaaaaaattacctgtgaatattgaaggggtttattttacatggttttgggaatttagtaacaaaaagtaactctccaattatccattgctaagggacaaaagcagttcagataataccaaataacaggtaacctgtttgatctttgaatgaaatcaattacaacaacagagatgaccacctctcttggttcttggttggcttcactgctaatgttctggaactgagccatctatgaagaatgaggccacagcatactgaataatttagagttaatttacagctagttttcttttcagagagtaatttagttttgagagtcttatcattttacttctcattggtttctctgtaacacagtctgagtggggaaatttaaaaagacttctgcagacagtcagttttgttacctaagagttggttatggtggtagagataggcatagttgaaaatctgttaggttaacttttaaattgtttcttattatgcatataa

SEQ ID NO: 113552 - DNA, 1097 bp, Homo sapiens
aaagatattttcctcttcagacctcagggctattttgggacctacaaataagtatgaccaccagctgcttcaattcttgctattcaaaaggttaatagtctttaagttaaatataatgtgatattattcaacagaaagaatatgtttttcctttttaacctcgaacaaattctgtatctgatgtttaaaaagtatttttaaaagttgtggtaatataaaaatatgtggaaattgtggctgaagcattaaaaataacttgcaaaataaatatattctaatggtaaagaaaaaactgatcttaccattctgttcctgtttatccatgaatgagaaaagatgggcatattccagtagatttcatcaaaagtgaaagaaatagagccacttaaaaaaatctttagaataataactgatctctggaatatcaagtctaaagaaactaagcaaaatcactttaaaacaagcccaagttttgctactttttgctctcagtgttttctatttacctccttttattgtccttgactcaccagtcagaagttcttgatgctgtatatcattatttatagtacttttcaaacttttttttactaaagtacctttagaaagagtaataaccctttagacatttctttgaagactcatattttatcataaaaattcagtaaatttctttgaagacttatgtgtgttgttttattcaagtgaattttgctttagattctatatttagtgaaaaataatgtaaattcatattccagtatgatgtgccatgtttatcttgtctgctatggttgtatctgccctcctgtgtcttgggcataccacttcagaccacctgttatatgagtacctgaatttgaaaagctcccattatgatttatgttcaacaacactcctgccacagatcctttatcattagacttctgaatctttaaactcagtgttgtcatggagactctgaaggggttttagggatcctggcaaatctaatacctcctgccctctctttcctgggtgctaagaagaccttaaatgcatttaagagtggtagagtataaaactctccctcactaaaatttgggaaatgatcttac

SEQ ID NO: 113553 - DNA, 1024 bp, Homo sapiens
ttagctatacccaaatatgcagcattcatggggaacattcttattaaatttaaaaaaagaacaggtacgtgagtataagctgaatttatcctccaatttaaaagcattatatgagtttacagttaacaaaagtacagtttaggaatattttatgactttaaaattccctactcattagtattctactaatttaaacctgcatgtttaaaacttatgggtcagatttgttaccagaagaacagtagcctaataggcaacattcattgagggcctattaagtgtcaggcgttgtattaggttttacatatatcatctcgtttaatgctacaataaccctgttgatgtttttctcccattttatagattaggcaactaaaacttggaaaggtcaacatagcttttaaggagcagagctatgatttgagcctcaatgaaagaaaagatgagtaaatttaggaaactgtatagaaaaaaactatttaaaagtagaagcaagaaattggggaaacaagcaaattaggtatatttttataacagtgacaacaaaaaaagcaaagaaattgcattagatatttattagtttatcctgagattgtagtcttaattcttctgtctgtccttcaatatagtaacactagaacatatacctatttctaatatttaaggaaaatatacagatatttgcactcttcttttgtgtaactcagacatctaaaaagtgaaacgagtacagatcctgcatccaaggtcgtattgtttaatagaggaaatttaaatgaaataaaatgcagaataataattcctttagcgtggtacaagtcaagcattgtggcagttcagaggagtagcagccaggaatatcagtgaaggtgccatttattctgaagtcttatagcgtgggtacaatttgaactacttgaacaaaagcacagataaagaacattgagaaatacgtatggagaagagtaagtttgatttcatagggtatctgaagaaacatgattggtagaaagaaaacaggtca

SEQ ID NO: 113554 - DNA, 1027 bp, Homo sapiens
ttactggttttctttttgaattggatcatgtaatatgtactctttggttctggtctcatttgctgaacattatgtctgtgaagttttttccatttttttttttaagacagagtttcgctgttgttgcccaggccggagtgcagtggcacgatcttggctcactgcagcctccgcctcccaggttcaagtgattctcctgcctcagcctcccaagtaaatgggattacaggcatgcgccaccacgcctggctatttttgtatttttagtggagacggagtttctccatgttggtcaggctggtcttgaactcccgacctcaggtgatcttcccaccttggcctcccaaagtgctgggattacaggtgtgagccaccacgcctggcctccattttttttttttttttttttttttttttttttttgtagcagtagtttgttgtgttctattgctgtgtggtagttcattgtatgactccaccacagtttatttgatagacatttggattgtttccaggttttggccattataggtaaagctgctatgaatattcttgtacttgccttttaatggacatgtgtatttatatttcttgggtatatttcctaggagtggaattgctgggttataggatagtcgtatgtttaactcaaatagtactgccaaatagttttccaaagtgatttttaccaacttttacttgtaccagcaatgtataagagtctagttgctctacatactggctactacttggttttgtcagtctttctagtttccgccttctaatgggtgtataatggtatctggtggttttaatctgcatgacaagttgagctgaatgactttgtagctccttcccaatgctaaggttttctgtgtgttttacaaagtggagccgggcgtggtggcttttgcctgtaatcccagcactttgggaggccgaggcatgcagatcatctgaggatgggagttcaagaccaacttgaccaatatggtgaaaccccgtggtgtttcaccacatggtggca

SEQ ID NO: 113555 - DNA, 1072 bp, Homo sapiens
tgaaggtacttatttttaatgatcttccagctgggcttttcttgcattttttggtttgtactctgtatattccttactttttgtatcaaactcatcaccttccctttaaagcatgtcttttttcccacagtttttggtctcttactcagaaactctatttctactaaaggtgtcgttttataaattttaaaacagatctctccgacttgtaaattctatctagttgccctgtttaaagtcactggatatcagaagttaattatatggttagtttcccatctaggcatgctctaatataattaagatggggttgtaagtataataagggtggaaatacttataatttcatgactttgtcactcaaaaaataaaaatcactcatcctaagtaatatgaaaatacattcttagatataatggtcagttttacatataagaaaataatctttcatcattccaacttctagtctccagaagagttctatttaaaaattgggatgaaggagaaagacattaatacttgaagtaccagatgttgtagtgtactttttgtatgttgtctatgaagtaagaataattatcccttaacattatcatgttacagtgaagaatctcagcaattcagactatttgcctggggttatgcagccattaagtgactgaagccaggattcaaactcaggtatatctgagctgacttcagagcccacattgcatccattatatcaaactgcctcatcaaatgattgctaggtattatttttttgaaataatggatgcatttgaaatcagagccagttctcagacattttcactgatgtccaaagtgctaaacaattttgtttgccttctgaaactccaccctgtatctctcagtccaaaaagcatactaaaatgcaacaaaagagtcacagagattaccttgaacctaccgtaatataaatactttacacactgaagttgataagtgttttgctttcaactactattagtaacaaatcactttacacacatctcactgccagtgtgatgaaatcccaggtttgagaactacaggataaaggagccattcc

SEQ ID NO: 113556 - DNA, 1019 bp, Homo sapiens
tgattgaagtcagagaagccctcttgaaatggaagggaaattaacatggcaagtgaatgatttgtttatactgtgcattagccaggctcattgtgattatattaggtgtcagtcagcttttacatattagacatggaaattgaatgatcttaattttgctcattaaaataatttttctgatgtatcagtaagattaaaatttttacattgaattttaatatctgcctgctgcttaattccagaatgatgaaagtgtattgtatgtgatgtacacaataccacttaatacaaatcttgctgtatttgctgctgattatacatcattatagaatgccatgatagcataagggaataccgcatagcagagagaaaaataatctaagatttgattaaaaggatacaattattctgaactgttacgtcatgtgggatttttttacaaagttttttcttttatttaaatcttgctaaggatttgaagcattcattaccatctggacttggtctctcagaaacccaaattacatctcatggctttgacaataccaaagagggtgttattgaagcaggagcatttcaaggtaagagcccatatatttgtaaagatggctgggatagaggatgggagaagttcaccaaatgctacctttattaataaagcacaagaatggagccctttcattctgtgataaaacattgattataaatgtattcctttttctcttcaatttaagtaatagaattatttgagtagtctcctttatataaacagatcaatgtacatgatatcactggttattatttaagaataggttataaaatactgaaataaaaacaaaaattatgtcagaaatgtagatgtagattattttaacttgtaaccatgaaatttataaatcaatgttgatttttataaatacatatttcttatttcaaagcaaatagaaaaatgaactttttacgttatataggaggtctccaagaccacactcattaaaagtttgtattttaattactct

SEQ ID NO: 113557 - DNA, 1310 bp, Homo sapiens
cagcttaaaaacaacaaatattgaaatcggcctagcaccaaagatgttgcagaatcagtaatagtggaaatcatgaataaatcaaagctcacaagagtgaagtgtacttggtaccagggttttgttttaatgggggtataaatctttgcacatatgtattcatctttctagatttttgttgttgagatgaaatagatttaattccccaaatttagccagttagtaagatcctgtattattgagagatcctgtattattatttattttttagttggtattggtgaatgattttggtaacagttgtttaaagggttaaagtattaaagatacagaaaagtgataattacctttgaaggtaaatcaaaaaagctgaagtcccagttacagccacactacatcatttgctattttactttgaaaatttacatatcatttgttatatatattatacacatcccatgtagtgctatggtttatttcttatgcaagattaagaaactgtaataactagaacaatagagctcctattcctggggtcaagacatggaagtacagtggtcttcttttattttacactttattttagaatcccttatgccttggacggtagagatacagtctttgtttaaaatggtgattgaactggataacctattaaaatgccttccaactcagcaagtaacttgtagattagtgatttctatattgaatttaataatggagatattatggtgttcagaacatctgagtctctaataagaaactattttaacttctctgggcttcattaatcttaccgtttaatgtgacagtttagttgatttccatcatcccttctggttttaaattttataatttaacagatttaaagagaaaaatatctctcattttgaaagttaacaacaatctatttagtttaggtctattgcatgtttgaattttaatgtgagatccagttcaagttaaggtatattttatactgttagaactcgtgacagtttctatgtcagaatttagtacatctggaatatgaccagttattactaatagtaaagaaagtagacatgtctttcttattaggaaatttaattatgtacttaatgcatgtattttttccagagaactggggaagagtgtaattgaaataaaagtacattatagacattaaaatattctcagctaaacatggaaggactttaatattttttcagttttagaaacctattactccctttttttgtttaatgctagacattagcaacaatgttgggtagtcagtgtttctttctttctttctttttttttttaat

SEQ ID NO: 113558 - DNA, 1051 bp, Homo sapiens
ttacatgcctttgaatttttacttgaagagcttttcctttatatatgagagtagcaagttatgaaatatttactgaagctttaaatcatccagctatgggactgtattcacattctgttaactgattttggaaatagtagagtccagttaaaatcctggttagatgtcatctaccagatttcattatatagttacatattctgtttagttttgatagtttgatgaaaagtttatataaaaactgagcctggtagcatacatttattattagtccttccctgaaagaaaacaaatatattaattccaacttttaatcctagtgtttgaatattttaaaggaaatatcagtaaccctatattcaaaatgtacagtatgtggaggaggaaaaggattttcacagttaaaatgtctaccttttcaggttccccagcaccgccactgccatctgttatgtctcctagcagggttgcagctagtcgactggctcagcaaggaagtgatttaattgttcctgcaggtattcactgcactgattggataaagcacttattgctactgctgaagctacactaatttactcagtttcataatcacttgctttatattcttaggtgtgtgtgattctgacttttttggtggctgccttattaacaataaaggaaataatttttctaactgtatcctatctttgtggcttttcagaataattcggctgtatctcacacctgaaacttaatccattttaaaattaaaacattataaaatttgatttgctttaaatcattctttctttgctctggaaattgtaggtttactgtttgatcctaaactctcatctttgcagctctgccttctattttcagttaaaggaaaaacaaccttcaacaattaggttggttgtttttaagaatggattaaatgaaaaaggtcttgtcttcttacttttagctttaacttacaaatagtttgcagattgcaacacaatactgttaatttaccagttatacccaatgaaaaatacttgggaaaatcagtatctttacattcaat

SEQ ID NO: 113559 - DNA, 1032 bp, Homo sapiens
tagaagtattctaagaggtaatttgttattgtgatttgctgaactcttaatgaagatggaattctgagattctcttttaagatatttcatatcactttaagaaggccctcttaaagtgatatgacttctgttaactttactttttatgaattatcatatgtatataaatctttcatatttttcttcctgtttgttaatattttattttgccttttactccttaatcaatatcaagggttactgttgtaatatgttctgttaactttttctaaaagttgtaaaaatgttgttttctgtattattctatttccagtaacatttatgtagacttcagtgaagtgtgtaacttagcttgtggaaatttggtgccaaaaatcttaagctgtcctgcttttcattttagtttttacatgcattgattggtaatctttttatgtggtcctttatctgccaatatttgcaacaaatcaaggtctataatattttgaagactgagtacagagtggagttacatggacatctcttaaatggaaaatggttttagcataataaggataattttactttcctgctattttctgaattattgaatactttgtcacctaagaaacgtaattacagctattgcaatagcattaaatttgtatcttctaatattttagttaatttaatattacattatttgtttcaactgaaattgaaaagtgttttgtaacaaactggagaattatcaaattaaatgatacatcttagaatatgtgatcggttttttatttggttaggtgcatcctgattaatctgttaattagtaaaacttgcactggaaagctttcactgctgaatatacagagctagagttagttcttgccatatctgaaggagtcatgtgtaatgtttactgcaccaagatgcagtttattcaaaaagaatgaactaaagctggtgttgagtgatccttcctcagttgtgtgcctaaatagagctgagcttgggagtcagctagtcaccaagtttacaaagaaatatgtattg

SEQ ID NO: 113560 - DNA, 1049 bp, Homo sapiens
aaaataagaacccattggttctctatggttcacattttatcagtaggccttatacctgagtattagtgccctaagtataatgtggtataagatctcagattataaaatacagtatataggttcatttggaacttttgaacaaaattataaatcaagttacatgtacttggtggctggtttcttaagggaaacccttacacagcctctgtgtgtactttaaaaaacaacaacagtaatgttgtttttgttttatgtcatcccgtaatttatccttttttattcaaattacaatgtatgatcttattcattaagcttagcttggggtttgacttttctgttgtttatgaaatagctgtggaattggctagttgttaacactaaaaccttgcctactgatggataatagtcaaaaagaatccaaggttaaaagtttttcagtagctgaatttccttctctgtcaaagccagaatttactgacttttagggcaagggtcatctatttgatcagtgcaaaaagtggtaatttaggcaaatgcccgagtggccttttaatcctccctattatgcattgtgtacaagtatttcctagccctctggtgcttcatgtatagaaaatcttgtaacagcccattcaacacttctccacagcagcaccaacaagggagtcaattgtggtcgagacttttcagatgtggacacctgttctctagaagttttacataagccataaagtaaccgtcactaactttgttgatacggactcagttcagacgggcaaccttgaagtgaagttgctttttgaaaacttagtgagcttctcttcttggtggtaatgagcactgttagagaagctattatggaaagttttactttggtaccacctacaaactctgaatgtaaaattaagaaatataaggtcagtattataactttgaatatgtttgagttaatcactgttgtttagaaatgcgctccaaggctattgaaggatatttgtccttagattaaatcaccatgtattactatttatttagttctacttttttct

SEQ ID NO: 113561 - DNA, 1101 bp, Homo sapiens
tttaaacacacatggaagaggaaaaatttgcttgtggtttgcattgcctcctttctctctttagaaatgaggcagaaattaactgtctttatataaaccatacaaccaaaaagaattgtgagttgtaggttgatttttaaactagactcatccaacccatacctgtttggaataaatcaaggtaattgtaattgttgaagagtgagtagggatgaaagcctgagtgggtgctggggagaagcacacctagctaaccaattcatatagttttttttttttaccagttatgctaagattccggcatgacaatttttgtaagggagggatattttgtatacagtattgaaaagctttccaggaaggatagctttataattatgaattactgttcttatagacttggttcttttttggcaatcataaggtacttacatattttctaaccctttttggtcagaagctatcaacttactatagagtaggattagagtttcttattctgctgtatatgttggaggtgagggaattgttcctttcactttgaatgaaaagaattcactttaaaaatttactttttaatcattattgctgtgatgtatctgttctaatggttgatatacatgtgtgctcttcagatccacatttcacttattttgccagccttgggtattatccaacttgatttgccaggtttgtgataaaggtgagtttttaagtgatcaatgtgatacttgaacagatcactaataactgcattggttgtgctgttgatgatggtactgggtgcttatggctgtgactttgctatacttttttagttcttagtagttatggttccttcagtttgcttaaaagtaaaacctttaattagcatttctgagtaaagtctcagaagacactagcagtgtttaagaatttgactttgcaatgttctttttttttttttttttttgagacgagtctcgctctgtcgcccaggctggagtgcagtggcgcaatctcggctcactgcaacctccgcctcccgggttcaagcaattctctgcctcagcctcctgagtggctgggattacaggcgcccaccacaacgcccagctaagt

SEQ ID NO: 113562 - DNA, 1023 bp, Homo sapiens
aattcatttagttgaaaaagaatgttcatattgaggattgttcattatgttttgattggatgagtcaacacactattcttacgtaaatttgtatctgatttagaagatacactaccaaagttaagcttgtactacattacagtaaccaatactaatagaaaagtgagataaattatctgttttgttataagccaaattgagaacaattcgctttttagaaaaaaaaatagcttcttatatttgaggattaaattttatacttcatttccatttggagtttttttttttcttttgtttttacattataattacaaaattgtgaatcctcaaaggtcccctctataccagggaactgatctgatgtgcatgtatactttaaaaggctttacacatcagtcttctaacaattactgggagaatgtttcttgtgtatatgggtattgtatcattttgttgtgaaaactagaattcaatcctaaaaagaaccatctttgatttcccatggattaagttgcattgtggggtggggggccagtttaaatacaacaaatacactgagcctgagcctttgttagtgggctactgagtcttcctcagctacaaaaggagctgtctctgtgtttagtcagctacttgggggtggggaaacaaactgacttatattgacatttgcagggctagttaaaaatttttggatgcccttcccactttctttctgactctctaactttctagactattaacagcagctccctgcaaggccagtacatgaattaaatcccatactctgcttttattctctcctctaattctaaaagattggaagttaaaattctttttttttaagttatttttatttttaagttcatgggtacacgtgcaggatgtgcaggtctgttacataggtaaacgtgtgccatgatggtttgctgcacctatcaacccatcacctatatatatatgtgtgtgtgtgtatatatatatatatatatttttttttttttaacggagtctcgctctgtc

SEQ ID NO: 113563 - DNA, 2307 bp, Homo sapiens
tgcaatttcttttggttcataacaaaacctgcttaagagaatttttttttttgacaggtggacgtgggaatggaaattcttaatggtttctggagtagaaatctgtacttagaaaactagtttttgggtcagttccattttgatagaagtgaatacatagacagcttttattgacttccatatgtaacaataccgtttaagccttaaatcacagatatgtgccttctcagatacagtaattcttgttcaaccaatgtacaaaatccataaagaaacccctgttggataatgtttgatgtgtctattccttccatggaatggagcactatgtatgaatgttgggtttctttgtacttgttaagccacatttgaggtttatggtaaaaatcatcttttgagtttgctctttggtttttcttcattccttttgaggattgggaaaacagaaagattctttgatttgggtaatgaagaggtaatttgggacagtgtggtggtaccaggaagaaagaggattggaaaggccagtactgttttagttgctcggcactgttggttttgttttaatgtggttgccctgtccactacatggttctatcagtagtgtaatccattttcaatgtaaagctcttttagtttttgtcatagacataaattaatattttgagaggcatccctcacctgttcatttcttctgtgttgaaatgaagtacttaaaattaccgttatacatgaactttgtggactgtaagatttgttatatatgttcaaatgccttttagctggctttttaattaatatgcctgttttgagtgcttaatacaatgtaatgtgattgtaaatcatacctattttaaatcattccttcctgtatatttgtactcagagagccttattttattcttccagcagaattactacttgtgatagttcatttacattccccagaatgtgcctctagtgtgaattttgtattcttattaaacgtgtttgctgcagtaaatcgtttctctggaccttcatagtttaagaagtaactatttggaaattctgaagacacataatttgcgttttctgaaccttaaaaaaaaaggtacttctgtcacttataattgttttagctcagtaagctattttttttcaatgtgaatctcttttgagagctgaacatgtccattcttaaccacatttcaataacagttactgtagctaaggagctaaatagtttcatggattaatttttttcagaataaatttaaaatatccatgattctgatagtgggcacatgaccaaaagaaaaaagtaaatcaatatatttagccaatggtacatttactttgttaggaatgtaatttatgttcattatagaaaagaattagaagaaaatttcaagtaatagaagataagtaccttcccaagtgaataaatactgcatggaaccactcaacacctctgaagttggatattttagttttggattttaatatacaagctctattttgaatatcctttaatatacatttacatctttgcacttttacttacttactcccttaggttatagtcctagaagtgaaaatgggccctcaaaagtatatacatacttctaaaactttgtaatatattgcctgtttgctttcaagaaagactgtgccaatttacacctctaagagcatacacatgtacctgtttagtatattttttaagccagtgctgtatatataaaatgaaataatgaaagagaaaaacaggaagataaaggctgaacaatcaccaactggagagtttggggatgctgggtgtgagagcagggaatggatgaaaatggctggcttttctgtcattaaaatagaagttgttattctagaaaaaataatgcactgaggaactggtctgtgaaattaaacttttcatcccaaagcttccaaatcttagggtccaggaactatctgggtttgcaaaagcaatttagctgaaatctaggctttaagaagcatcttttccatattcaaaacacactgataatgttactgaagcttatcctatagagtgtgaaactagaatgttccttagagattatgtaacacactttttttttaacagatgaaactatcaaggcttcaaaatatgttaaactgacttagccaacccccatctccaaatgtaatgctggatgagtatttgcaactatatacttcaattcccctttaaatcctgccatttcaaccgcataattaaatcaatgtgtcaaaagtgtcaagtttcttctaaagttaagtttaatgtgtattaaatatcttcccatt

SEQ ID NO: 113564 - DNA, 1005 bp, Homo sapiens
ataatgacatactaagaggctattgtgctgtcttcaagttttcaagcttttggagtcactatttatgcttatgactagagcaatgaaaacaagtcttttttccccaaacacaagtagcttcagtccaagccactccagacttccttgccagtgacctcaacactgaccttgatttattctaggaagaactctgcctgtttagttcttttagctcatttttatgtgaattcccattcactagtagtgaactaacttcaacaatttcatttctagtctgctgacttttcattattatggttttgtttttccttacagtagcctctttggaatcctgtacacctagcttatggaaacgtgttagcccaagccatggcagagccaggtaattgtcttatcaaggccatacttagtcttgtttaaaagcaggcatccccatctctttggcgtagccctaaaagaagtggaggatcaaagccacatgcttcaattctcagtcctctttgcctgatcactttatcaaatttctgaagaaagaactcaatccatccctcttcttcccaaactgtgtcaaagctggagttgtttttcagtccaacactgagccacgttgctctgggtggagcatcagcatgtcttctgaaaggtttcacttaattggcctgtataagtctacatttcttggttcacctaaaatcttatgatacctggctgttcccttcatgcactcttacatcttaactcactggtactatcaagtagattattttttaaatgtaagtttaaatggtcatgagtatttgctgaatggctgactggtcagcttacccacgttgactttcaccacctgattccactaacaccttgaagaggatcaggcttcaaagagcttggatctagcagatttgcttctggcccatagaagcctcttgagggcaagaactgttttgaacatgtttgtagccctcctcgtgctttgcacgtaaaggtcactcaatgttttcaata

SEQ ID NO: 113565 - DNA, 1042 bp, Homo sapiens
tcagtgtggagaatatacaattagtggttgaggatggaggcagccagccttcagctccagactggaatgtcttaattctgagcatgtgtgtttgttgggtggggaagaaggcattttaccattctaccatggcagctaggtcagtgaagatggtcctatccatgttgccaaataaatctcacataaatcttaaatatagtacaatattatttctgtgtagcctttgaatcttaatactttctttttccccaccagacattcttaacatagaatgcttgactcttttttacctagtagcactagaatatatttggacagttgaagtggcagaattcatctgaagcttctaggtcattagggtcattgttggctagaacatttagcaatttatatgactttagttttgatttagaggccagtctaactgctgccattttttagaaggaaaataagttaataacgagttagcctacctgttcaagtgtgtggattctaactacaggcacacaaggactgggttgcatgggtgtttcaaggtcacccaggggagacagagtctacaaacatggctttctggaattggaaggcaattctggtagggaagttcttttttttttttttttttttttttttggagactctctgtgttgccgaggttggagtgcagtggcgcaatcttggctcactgcagcctctgcctcctgtgttcaagcagtcctcctatctcagcacccaagtagctgggattacaaggtgcctgccaccacagctggccaattttttgtattttagtagagacagggtttcaccatatggtcaggctagtcttgaactcctgacctcaggtgatccacccccattggcctcccaaagtgctgggattacatgcgtgagccactgcacctggcctgggaagttctttattatagtatctatttttgcaatctgatgaagaagaaattgactgattgtgacagagaacacacacacacacataaaatgtgtcttccttggttatctcaagaactttggctaaaggtag

SEQ ID NO: 113566 - DNA, 1037 bp, Homo sapiens
gcccgccccgcagtccccgccccgcaggccgcggcttctctccccgccgcagagctggcgcggcgcgtgtgggcgtcgatctcagcgcgcaccggcgccccaccctcgcgccgcgacgcccttctgcccggcgctgataaggacgcagctggggctccgcgcggcccgtgggccgcccactcgcgttcagtttgctgaccccagcgcggctccccggggattcgcggcccagccggtggcggctgagccggtggcttgttggtgagtggctcgggcggggaccggggtgccgggttggggatgtaaggaggctgcggacagctgtctaacgcagagagctggtgaactactacgtatccaaacttgaaagaagtggtgtcccaggaccccccaggccgaatttcttccggacttaatggtcggttttcaaacttccgtgtggacagaaacgacctccgggattcggccgtctgtgacccccttcaactgacccacagttgtcttcctggaaggagcagccggcgctcccttccctctctctagagcatcctttggcacgcatgtgcttttttttttttttttcttggttttgggacagtgagagaaactgaaaatgaacattcaaatacaggcgtttttcctctgctctcgggtgttggtctcgggcgcctatgaatatttacattgtgctgcagattgaaggcgcttactgggaacgcgttgtcctgggttctttcactactgcctggagcacaggcagacggaactcacagaagagctggacggtccggctctggcccgactgcgtaattgtaccgactgacattctgtgtttaataatcaagaaagcttttgaaagataagtggtggtggaggagccttttcccgaattagtggagtgggagtaaaaattccatagtttagaattgtccgtactttccccatccttttcttctctcccaaatacaataaaatagggctgtgtgtttctctacctctgctctccaaactcggcttgttctaccctggtttgtcat

SEQ ID NO: 113567 - DNA, 1099 bp, Homo sapiens
ttcctcccggtttactctaaaaaaatttctaataatctttagaatttctccttaaagtaagctttcgtgactttttttgtgtgttctgagaattagatgcaaataagttttgacttgcaaattctaactcagcagctgaaggcttcaagcagaggcccttatgttcctttgcctttctctacatagactcattcagaaacataattacactcttaaaaaacataacccttcttatttcaaaagcatcagtattgtaattgcctttattatgattaacctatacaactgtctttggaattgctttaaaataacaatctactggcataattaaacacactttagcaatgcatactgtatttatatggtatcttaaagcttttcttcaatgattttacaagccttacacttcctgcaaagaaatttactagttcattaagctatttcattgtcacttaggtttttaaaaacatgtactgccagaatcctcagctatagctttaatcttgctatttataactggaacagaaattgagtcagtacttccaaaacaaacctttctgattcagaggtcagccaatcttaactcagattcaaaatttacagatgtggcaagccctcctgtgtacaggctgtaggtagctccaaaactgtccacctgagacatctcatcatatttgggaagaagctcccaaagaaaatgaccagtagcctcagccctcatccccaaaccgttcttttctataaatggaggcagcatccaatctccagggcataagccaagagtttgacacccagccagtcagtgataaaccaggtgagcttgtggagtcggtttgtgcaacatgcgttcatcttagctttccacatcaactcacaggaagaacccaaaaagaaagtcgtctagttaaagatgggaggcagtaaaaacaaaatggagctggggtcccttctcctacagttaaggagatgatctacattggtgcccacactcaaaagcatctgggcatatgtagagcatatctagggtatatcaatggcatatgtagggcatatataaggtttatctaagatatatttagggtgtatatagggtatatct

SEQ ID NO: 113568 - DNA, 1042 bp, Homo sapiens
ctatctatctatctatctatctgtctatctatctatctaatgcaatttatagatggaaaatttcctgattattttctggcatatattttgcacatagtaggcagtcattcaaatacttgtgaaatggaggctgggcggggtggctcatgcctgtaaccctagcactttgggaggccaagagaggcagataacatgagtccaggagttcaagtccagcctgggcaacatagcgagaccttgtctatataaaaaatacaaaaattagccgggtgtggtggcatgcacttgtggtcccagctactcaggaggctaaggtgggaggattgcttgagtctgggaggtggaggttgcagtgagctgagatcctgccactgcattccatcctgggtgacacaatgaaaccctttctcaaaaaaacaaaaacaaacttgtataatggataggcacccccaaaagtgtccacgtgctgcctattgcattcatttgctcatcacttaccttgcaggtgcatagactgaggcctgtggcttcaaatcatgtcactgctctgatgcctacgtctactctgaactagtggtttttaaattagagtgtcatctgcgaacttaataaaactgcaatttctttggttttaatgccaaagacactgatttggtggatggaggtggggtggatggaggtggggtggagggaagtgggggaggtgggctgatttgggaggtggcgatggagttattttaatgtgcacttcagatgttgctaatgtgctggcctgcagactgcgctctgagaacagcagctccagcgtcttggccaccttcactaaatacttgccttggtttcctcttctttaaaaaaaaaaagaaaagaaaagaaaccaggggaaaaaggaggcctggcttactgctggtgaacatgaaacctcagaaaccagggcaaggctcatcacccagcttcgtggaaaaaaataccagcctagtcgccaaaatgaaagtagattacctctgtggctaaaaacggaagcggcaagtttccactgcaa

SEQ ID NO: 113569 - DNA, 1032 bp, Homo sapiens
gctgaggcaggagaatggcgtgaacctgggaggcggagcttgcgtgggccgagatcgcgccactgcactccagcctgggcgacagagcgagactctgtctcaaaaaaaaaaaaaaaaaaaaaaaaaaaaaaaaaaaaaaagttcagataaatctaacacctacagctagaatgctcttgaaatatctagatattttcatattgtaccttacttaagaaaatctgtcatctagtttctttcctttatagtgtatattgtatgcagcatgtggctgtgttttcctgagccatacataggaatgaaaacagcagaatggaggtggaaacctcctggttaatgtcttcatttcaccatgtggaataaagccaatgtcaagaaacactcacctccaacgcttctttggcacccggccaggagaagagggctgcctcagagggatctttgcacagatgggcttattaatacaaaatgctactggctgactttttgtaccttgaagtgtattcggttttataagcatcactctggaaaaatttcttttctagtttgtaatctaaaataacacaatatgctggctaggtgtggtggttcatgcctgtaatcccagcacttttggaagctgaggcaggtgggtcactggaggccaggagttggagaccaagcctgggcaacctagcgagaccccatctctaaataaaaatcattagccagatgcagtggcttatgtctatagtcccagctactcagaaggctgaggtggtaggatcacttaagcccaggagttcaagacaagcctgggcaacatagaggaccccatttctacaaaaaataaaaataaaaattagctgggcatggtggcacacacctgtagtcacagttacccaagaggcttgaggtgagaggatctcttgagcccaggagtttgaggctgcagtgacctatgattgcaccactgcattccagcttgggcaacagagagagatcctgcctctaagaaaaaataagcctgggcacggtggttcacacttgtaa

SEQ ID NO: 113570 - DNA, 1031 bp, Homo sapiens
tacctttccttattgcaaaatatcaaatgaatctggcctttttaaaacaagatataagtgaaatcttgagccctaggccatgaattccatgagtgctgggaccatgaccctagcacatggccagcccctaatcaatacttatcggtgggggaagaaaggcaaaataggccaagaggactgggtctagaatgttccttatcgagatccttaatttgaacccccgctcctgagaaaatgactcatgcctgctatgtgatggtgagtgagaaaaatacaggtttctatgagcacattacgtagaagaatagtactcatttctgggccatgtgttcaatgtcaacacaaatatacaggccatctgccatctcagatgctgggctctcttggcatcaaggtttgtcaggcaacttgaattcctttttttattggcgtagaggctcaggtggaattccaaaagcagaaatttcatcaccaaatacacatatcctaagtactaactgtgcacagtaggtacaatgaaagctaggcccggattgcaaggataaaagacagagttggaagaatgagcacacagttacaacacagtactaacagggtcacagaggcaggcagtgggcagacaggttcacagaagaggggcgtgtcactcacagcagtgatcagagggcaccttctaggggaggtgacaggtgaaccgagagttcggaagaaaaggttcagatatgctacggttttaaatgtaaaagcctctcccttccctcctgacttaatgcgcccttacagagtcacagtctttggtccatgatggagtcagatggtgaattttatgtgtcaacttggctaggccagcccagttgtttggtcaaacaccagtctcactgttgctgtgaaggtagtgtttagatgtgattaacacttaaaccagcagactttgagtaaagcacatcactccataccataaggtggatgtaatggacataggggtgtcacccattacacattgaacatgttaaagacaggctcccctaatg

SEQ ID NO: 113571 - DNA, 1078 bp, Homo sapiens
ttcacaggcaactgggcaataattgcatttccaggaatgccaaatggagccaaatccttttaatagctcactgacatgcaggttattccactggggaccaaaaggaaggaactagagctctcaaaatatttgattcttgatttgtgctcttcactggatgattctattttcttgagagcatttttaacgaaacagcagcaatcagtgatttcttagaaatgtggcccctttaaatacacttcagtgaggctagctcttgtgtttcctggacactctgtgtgttctggacatactggaggcacagcataaatattaatgctggccattacaaaaagaaaatgaaaagaccccataaggcagcagtgaccctagaagccccagaagccgtgttggaactgtgacaaggaaggatagtgacaagatctgaaaaaagcagccctcttcccacactcaacacatgcagtaaacccagacatgcagggcaccattgtctgagctgtcactggagggctgggaggagacaggggatggggcaatggcagcctacccacccctcctcatcactgtccaggggcattcaggaaacacaggcttccaatatgaggctgcctttttttctcacaagccatgctcactaggaatccatagcggccatctgcacaccgacctggtggtgtctcaagcttccaggtgtggttttgggggcagggtccttgaggaagggggtgctgctgacagtgaggtaacctgaggtcagctctggacagggctgggtggaagaagagtgtagtgactgctgatccctgtcctttctaggaattggggttactgggtcagagaaacatctcaataccttccaggcttccaaggctggttgtaaacctgctccttgataaaagaaactacatccaacctttaggagcaaggtggggtaacatgggagcagatcttagttcatttgtttgtttgtttttgcttgcctgcttgcttttttgttttttctttttctttttttttttttttttgagacagggttgcacactgttgcccaggttggagtgcagtggtgcaatcatgg

SEQ ID NO: 113572 - DNA, 1035 bp, Homo sapiens
gagggagggagagggagaaaaggaacgaaagagtgaggaaggaaggaaagagggaggaagggaggaaggaaggaagggagagaggaaggaaggaaagaaggaaggaaagagcaaggaaggaaggaaagagcgaggaagggagggaggaaggaaggaaggaaagaaagagagagagaggaagggtccctactccaacttcttttacggagtaaaaaggcctaaagagacagtcatgacttatcatttgcaggactgattgtatcatacttgactcatttgttaacattcacttgaaggaaacgcagagattttttttcttcgctcacattcaggagctgtgcttgcttataatgaactgtcatgatggaggccggcccgtttcagctctctcagccccgtcaagctgaactcacttcccctgaaaggacagtgtttgcatttgtgtttacgggactggggaagaggatgcgttttcaggagacctgaaaaccgagccaacccccttttcctgccccgctgtgctgcgattggcccatcttggaggctggctgcaggagcctttagtcatcgcacagggaaatctttctggaaccgggcaccaacttgcgtgtttgttttcatgctctttgtgcggggattagctgtcgtgccgggcctgaaaatgctgcgagcgccgggcgacatctaatccaggatttgcctctgcctcgcggttgatggaaaacagatgtcttactgctctgggcctgagcacagaatggaaatgaccgaccagagagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggagaggagcgggtgcgaagtcctgggtcgcctgcccgctgcctgatgtcgtgagctagggcacctcggccc

SEQ ID NO: 113573 - DNA, 1050 bp, Homo sapiens
acactgcttgagagtgaatagtagataggcttgagctttgccttaattaagaggatgagatcgggtctctttaatcgccaaaatagcctctcagactacacaaagacagaactgtctcttttgctgactacatgcaatttatttaaattagtgttgcacattcaacgatggtgtggaagctatattagaaaaccaccaaattgaatgagttttctaggtctttggttagggataaaaagggcattagccacattgaatgggatttgcatctcgttagcttgcccgtatgtcctcagctattggacacaatggagggtgcacgtctctcttttcagctgggtagtctgcttcagttgtgattctcctgggaattaaaattgtgaactagagtcatggtgggggaaggggaagggctggaacttgtctgaccacaccctcccccgctttttgtagttcaagattataatagtttgccttagcagcagcaaaatctatctcagtgtttagtactctcctcggtattggctgtgaacaatctccttgcagatattgggcagctggctctccttattgttcagcatatgtccagggttccctccaatgcactggattctgcttatggaaggcaaaataattaccatgttagtccaagaaagagattataaaagtgaacctcttatgcgaagtaaacattttggatatccccttatttagcgtgaccagtgagatgtcacccacagaaagtggataaaagggtacccaaatgggctgaaggccacaggatcagctactctctatccataaacacccttgtcaactgtgtggatgcttcatctgacaccctgtccttcctctccttccaagtatgaatcatccttgtcactccatttccttcaccacccaaatcctggccctatacttagtacttcctgagacctctagaacagaagtacccatgggtcctcagccactttaccccatgtgtgggtctgatggctaagatgagctgtcctgaatagctttaaaagtaactccagggagaaaaactaa

SEQ ID NO: 113574 - DNA, 1425 bp, Homo sapiens
tgggactataggtgtgtaccaccatacctggctaatttttaaatttttggtagagatgggggtctcactatgttgcctaggcctggtctcaaactcctaggcttaagcaatcctcctgcctgggcctcccaaagtgctcatgtaatatgcatgagccacctcgcacagccagaggattatgtcttaaacatctttgtaaacttacagtatcaaggacattacattgcttgtcttttctcataagtgtttgaggaaacaaatagaattgaaaatcagctagatttggttgtgctttctgcttgctaatttaacttttgggggttggggtgtgggaaattaaggtttaacttgtcttttgactcttaaatatatttcttctacatgcaattggagctggagttgctacatttagcaattaggcatgtaaacattagtaccatattataaccacattgttgtaggcatttttgattaattgattattaatattaattttagtactaatatacctttaatgctattgtttatggctcttagttacttaggagtgtgcatactaataaaaagagtcaagaggccaggagcagtggctcatgcctataatcccagcactttgggaggctgaggtgggcggatcacgaggtcaggagtttgagaccagcctgaccaacatagtgaaaccctgtctctactgaaaatacaaaaaattagccgagggtggtggcaggcacctgtaatcccaactactcaggaggctgaggcaggagaatcacttgaactcaggaggcggaagttgcagtgagctgagattgcgccattgcatttcagcccaggcgacagtgcgagactccgactcaaaaaaaaaagagtcaaaatatatgaaatgtgaaaatgtaaatacataaacacatttatgagtggtagttgtatacatacatactttctactttatcaaagtcaggacatctatgaatggttatacaaatggttatacaaatattatacaaatattacaacttaattgtatctttttttcaaaaaaacagaagatccattggtagtatgctctccagctccctccctctgtgacttacaccttcgctagtcatttgaaagcttctgtgggagtgtgtggtaagtgacctgccattgtggggagtggaagtggcatgacctcaggagccagttctgagtccaggtgaaccaaagctcagtttctttcatctttgaacctgaacctcttacctccaagaaaaagggcccaggaatttgggccttcttgtttatttgtccttctgcccctctccctatctaacccctgggtaagggtgagcttgaaggtgatggtgacagtggcttctgtgtgtgtcagtccaccctccaagcaatgcttagaaaccagtccataagccaattaacacatca

SEQ ID NO: 113575 - DNA, 1029 bp, Homo sapiens
atgaacaaaatgtgctaaattcacgcaatggaatatcgttcagccatacaaaggaacgaaatactgacacatgctaccacatggatgaacttggaaaacattctgccaagtgaaaagagcaagacacacaagaccacatattatatgattccattccagaatagggaaacctttagcgacagaaagtagattagtgattgcttaggactgtggggatgtgatgtgggagggaagagagagatagctaaagggtatgggttgggtgtttgtttgtttgtttgtctgagatgatgaaaatgttccaaaattggctgtggtaatagttgcccacatctatgaatatactaaaagccattaaattgtacactttaaatgggtgaattatatggtatgtgaattacaattcaatgaagctttaaaaaaatccacaaaacttctaaaatagggtgttaactgggattttgagaactgtgtatcacctaaaatggcacgccaaagttggcatgtatgtgcatttctggggtctgtcaattttgctgtattctctgtgatccccctcctcctactaccaccaaaggtaatcaccactgctctgcagagctgaggccccttcaagggctcactgtaatgcttgactgcgtggaaagaatgtgataaatattaatgtaatcaaatatgcagatgcccagttttttaaaataaacattattagcaatccctttgaaactaataactaaccaaggaataggatgcaatactgttccctgcgtttattgttgtagaaaaaggaacggttgtgaattctactctgatatgtaagattttttattctaaattattatttgtaatatggagacctaatcactatcatatggctacttgctgatcatttttacattatttataccttttacaactaagtttaatgacttggcaggaaattaagttatgttatttgtcaagtttctcaacttttaactgaaaacttcatgatcagaagaagaacaaggtctggttatccccgaatca

SEQ ID NO: 113576 - DNA, 1064 bp, Homo sapiens
cattgcagctcgctgctgcatccctatcccataatcccttgcctggtttgctgcagtcttttcaacagacgctcagtgagaaaaagatgtcctgtaagatcaagaccgattggtgtgaatactgaagggggtcttccacttgttaatgacccagaaacattcctgccgacttccagccttctctcatttcctccatttttctcttcctctgttctgtgcatgaactggcacatcactacttagagcagaagatatgctgggcttctgatgatggctgcactgcatggtagggaattttaaccagtctctttgcatggtgcttcccaacttgaagtgttagcagaaacgtgcgttgttcttttggattgccgcgtagctgcagcgacagacttgggaggatttaattctttgcctcgttggttagtctgtttgtcttcagaaatgggtaggtcctaaatgttcagactgcttagtattgtgccaggtggataactgatttctcctgctctctcggttcttttttctcccttcatctctcatggtgatgctgcatcctctgtagctgtaaaatgcagacccattctttgcttaaacaaaggcaccaaattaacaagtatggggagaaaatcatgcaagattttcttatcaagttctaatgtgatctgactagatttgtatttttaccagtctttattttagtgtgtatcttggcttgttttaaatagaagaattttgccccctgcatctctctgttgggtgcaaacatggagatgaaatatttgatttgcaggattccttcctcgctgccccagggtagaggagaacgtgcgaccctccccccactctgtcctctattagagaatcctggggttgagttccatggctggcagttaccattggaaacccattcattcataatgcatgactcgaccctccgaattctgaatgccattgagggccagcaaacaaacatgtaggagataatttgctttttttctgacaattttttttcctgtctttgaagtacagtcaaatctgggtggagctcaatgatagcattacac

SEQ ID NO: 113577 - DNA, 1047 bp, Homo sapiens
gcccaggagtttgagacctgactgggcaacatggcgaaatcccacctctaccaaaaatacaaaaatcagctgggcatgatggggctgcacctgtagtcccagctgttcagaggctgaggtaggaggatcctgtgggtccagacattgaggcttcagtgagccatgattgcgcctctgcgctccaacccaggtgacagagcaagactctatctcaaaaaaaaaaaaaaaaattaagaaaaaaaaaataaatgttacctccataagtaaagtgagaatgtcatgaaattcaggcaacagcttatagctcaaggaagcggctagaacatggagacagcggagttgagggtgggacacaggtgggcctgaaaagatagatgtggagagattgggatgagctgtgaatatcattaagaacatgtttgacgtcaatttcttaaattgcaaaagcatcaaagccttctgaacaggagataggtattttattgacattttggaggaatggggtggcagacactaaaggctgggaaaccaattatgagtttactgaattgtccaaatgagagataagagatggaactagaatggcatcaatgggcctggggaagacagcgtgaatttcagagaaaagagtactctttgactcaacaatctgcctcccacaaataaaaaggcctgtgctaaagtctgttaagctaagctattagatcgtgagaacttcagcaactaaaattaatcttatactaggtcacaaagaaaataccactatattttcccattgtgtaaagcaagttcctgccctacaatgcactaaaattacattagtaacacatgtttatggggaaaaaacaaatctcctttaaaagttaataattatttaatcaatagaaaataatagaaataatagaaaattggactatttacaaagtattggaagtggaaactttttatatccaatgtgtagggtcaaatctctacccaggaaattttataggtttaagtattttcctttatttaaaaagaattccagcctgggcaacatagtgagtc

SEQ ID NO: 113578 - DNA, 1053 bp, Homo sapiens
taagacacaagtgctgcatattcattgtaggaaattacaagctgaaaataagcaaaaagagaaatagaaaaatcatagcacccgtaatctgaaaatcttgaaggaaaaattggcaatcctccccctaacccccaccaccaacgcccctcttccctgggagggtcttcttgtgccagagctgaggctgtacggttggcagagcatgtgatgcctccctgtcactgcatcggcattgcaggagggaggggatgtgtgcattgcaagttgcaaccacctccagctgtgtgtagctggagagcagccccaaggagaggaggaggggtggaaacttggagaaagaatggggttgaggcggggttggggtggaagcaagaaggtacccgatgagccaagagagttaggaatgcaaatagcccttccctcctctgatttatggtctctctctttttaaactttctatgttctcagtagaaagcaactaaatgtaaacagcaaagggcttgatgattcttaagggagaaaagtctgcattttagttagcttcaaaaagtagctccagcagacttcttttcctccctcttccatttaacaatgcagtatctctgaaagagtgctgcactgtatattagctggcacatgtagaaaaacaattctatggttcagataaatttgggaaaccttaggctaaatgaaggaagtggacttttttaaattgcagaacttcttaaaacctttagaatctgctgatgtacattgtaggtctctgaggcaggagagggatagataacaggcagcacatccaaacttccaaccatagaactttttccctggaacgtcttgggaaatgaaggctctgtggaacgttcttgggcagagctgctcaatgttaatgcttcaggctgaatcttcgcaaagacggtgatatgatatgtaacttgtctgttcagagcatggaagccctcatacattcacggccagatgtgcgatatgggtgcaggggttgttgattctccaccagagcagagtggacgagcttgggtggatgcaggactg

SEQ ID NO: 113579 - DNA, 1048 bp, Homo sapiens
agccatctttttatttatttatgttgtcttcggtttttttcatcaatgtcttatagttttctgtgtacagatcttttacctccttggttaaattcatccctacattgttgttgttgttagtttttttctttttcttgcattcgtctttaactttacattcaaatccagtatctagtcaaaagacaacactcactatgcaataatatacctcaaaaaacatttctagggcacctagtgcctgccaggcgttattctaggtgatgggaatatagagatgaaggaaatgacatctctgtcaccctcttcagctgacagtttgggatgatagatgtatgagcaactaacagcatgagataggtgatggtaagctgtagaaatgggaaggaatttaaactgggactttaatgatgggtaggacttacccaggttggcaggcagaattggtatcccaggcaaagggaccagtgtgaagaagtacagaaaggtgaagaggagaagacatgattgttattttggagacacatcccatatagtgtgaaaaggtcaaagggattaaaagtaatgaggttggacaaatcagcagtggaggctacttgaactccctctgtgctctcacacacctttgtgcatgaattcttttcccaattttatcttccctcaaaaaccaccttctctttcaaaatacactttgattattgttacttatgcctgggtcttattacccaagatggtaaattccttaaggtcaaggatggtgtctttaatcatttataattcccaaaaaatacacagaagaatgctttgcataagtactttgcccatttgaataggataagttgtgaactacctcatgatttaacttccctctcaccaccgtcatgctcgtttggaggcccaggaacacacagatcaggtgacaatgcattcagctgcaggggtaatcattcacattcacacgcatgggactatgctaggcaatatcaaacagcactggcctaagaacttggcttttcaacatccatacctttgactacaaatcagtagagtt

SEQ ID NO: 113580 - DNA, 1052 bp, Homo sapiens
tgtgaataatgccgcaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaatacttttacactgttggtgggactgtaaactagttcaacccttgtggaagtcagtgtggtgattcctcagggatctagaactagaaataccattcgacccagccatcccattactgggtatatatccaaaggactataaatcgtgctgctataaagacacatgcacacgtatgtttattgcggcactattcacaacagcaaagtttttattcttaagagaccctggcttgtccataccacctttgaaaaattatttctaagctgagcattttagaattgtttctgtttctagcccatctgttttgctgtacctgttacctagctattattcagacatgggggaaagaccaaaaataatatttgttttaaaacaaatataaaataaaaatggcagtgcccgtttcatctagattctttcagaaatatataagcaacgttagacaaacagatgttcctccaaccttgtgatttaacttacatgtgggaaacagactcaagctctccttaacttcaaaccatgttggcacatatcccccttcgagggccaaccactcctttcctgctccccactaccagaaacaactcgccatttcacgagtgttcactgcttccatattcatgcatattatggggattctatgtgggtcgtgtattgaagatcctttcttctgatacatttgaattaaaatatgacagtatctggatctcaaatttttctttcacgctagtgcgagtagatgagatgcagagttagtgagtaaacttgatagggtccatgattcaatgaactgaccaccacctgggtctggtgag

SEQ ID NO: 113581 - DNA, 1047 bp, Homo sapiens
gcaaatcacctgaggtcaggagttcaagaccagcctggccaacatggtgaaatcccatctctactaaaaacacaaaaaattatctgggcatggtgatgggcgcctgtaatcccagctactcgggaggctgaggcaggaggatcacttgaacccgggaggcagaggttgcaatgagctgagattgcgccattgcactccagcctgggcaacaagagcaaaactctgtctcaaaaaaaaaatatatatatatattttttgttgtttactattctgtttaagatggggttgacacaatcagggaaatgcagggattcttacctttcacttggttgaatccagtgcagctaaactaggagtgatgaagggaagtgtaaagaaattttggttcaatgtttaagttattctttcagatctgccctagttgtcactacatgatagaatggaagtaaccctttattttctctttttattctagataattatccatttgatattatttggttgagtcatctaagcaactacaagtgttcataatgttaggtagtaatgacattcttgttttaatcatcgaagtgccttctctcccttttgatctctgctgacttaccctccatttagacatgaaacaacaaatgccatttctttacccaccattgtgttatagcctctttgatctttgggctagattggagaatcagaatcaaatttacacagcagttcctcttgccaagaaaaccactgtttctttcctaagtaattgtgttcctttgctctaaagagatgaaatctgaatcttcatcatttataaacttagaagaataaaaggagcatataaagtctaaagtccccatcatgcaaagtcccatcctgctactagaaaatttaaaaatacatatgtggttcacattatatttctatcagacagcactaatatagagagataaaataagaaggctaaagcataacctatgagaatataactttttgggttttctaagatatagacgctgatttctcacttttccttccagaagtctatgtacatac

SEQ ID NO: 113582 - DNA, 1047 bp, Homo sapiens
aaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtacactcgatggtaatatgtaaacccccttttttatgcttcttctgctcacatttgcatgatgttggagcatgttgaagacaccgcatccctagtgtgtttgctggctttgggaaagatgctggggataaaatctaagcaaaagcatgtttcgttgcttgagccttagtcaccgccacccacccggcagtaagttgagctgcagtccttgtgtggtttttatcggtggcagttcacaactcagaagtctagctttgaaatattcatattaaataaggtataaattttaaaataaaaatatttgaaaaacaaggaataactactgtttcagcctagctgtaactttgcttaaaaagccactgaatgagaattttttttcacctttctaggttattgtaagagaacaggagtctagaatatttgctaggtttaaggagggcagtctgttttacgtctctttggtgtagcactttgcaatcacaagcttatttaggtttttgcatttgcaagaagaggctgaaaatagcttattaattttctttttgaaaggatgcttttggcacttagtattaatttgcataatatttgtttatgctttgtctccagttctgccaagtttctgaatgtcacccagaattatagtgtgggttttctgttgttttgttttgttttgttttgtttttgagacagggtctcgctctgtcacccaggctggagtgcagtggcgtgatctcagctcactgcagcctcgacctcctgggttcaagtgatcctcctgcctcagccctccaagtagctgggactacaggcatgtgccaccatgtccagctaatcaatttttaaaaattacatattggagtctcttttccaatgctgagttgc

SEQ ID NO: 113583 - DNA, 1049 bp, Homo sapiens
tctagttatgttgatgtagtaaaatgataataaattctgagcatctggcataacaaaaaactcctactctctgatccaacttttaatggtcatccatcctgttagaaatataaatataatgcccattcttgaaattagcaatttctttaaaggtgggaagaataatattattgaaaattatagcacttcttactcatacttacttgtacagtattttataacaaaggtatcattcacataaggatttaataaccagatataagccaaaaaaagtgatgatttaacaaatgataaatcagatttatacagtaatttggggaaccacaatgatatgcagtctgtcttgtagatttcattttctttttttagaatgtcttaaatgataagtcttgttataaataacctgctcaaatagatatttttttaatccatcatgttggttcaagtattttgatgtaaaacaaaataatttaaaaatatttcatacaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtagatcaatgtgctaatgtatatggttagagtgtttggtatttgttaaaagtgaagaatttgctgtcccccaaactggaatgttttctcttttccattggttaggacatagaaccatagatactctcaccagaaggaccaaactcagcaagatggagtagaaaaaatgttaccagactgaaaccctctaaattggggttttaatatggaccccacagacccccacaaagggtctgaagatagaattcaagggggccattgaataaaaatactacattattatatttatgaacctctggctgaaaattatcatttcccttaatcatgaatataagcaacaatcatagtaattttagtaatgcctatgactttgtcaccaagaaaaatcacagaaattttcatatcatattgttgcaaaa

SEQ ID NO: 113584 - DNA, 1626 bp, Homo sapiens
actggcattacagatataaaccactgcacctggcttatgctaatgttttaaatataaaagcatatatactgggcatggtggctcatggctattatcttagcactttgggaggctgaatcaggagaatcgcttgagcctacgaattaaaggttacagtaagctgtcttcacaccacggcacaccagcctgggtgtcagagtgagaccctgtcaaaaagaaagaaagaaacagaaaaacattagcatcaagagttttctaacccatgttcagcatattactataacttctcctataacattctgacttcctatttgtttacaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtatta

SEQ ID NO: 113585 - DNA, 2761 bp, Homo sapiens
tttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactccaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgt

SEQ ID NO: 113586 - DNA, 1048 bp, Homo sapiens
ctataagcctcatggttataattaacgtttctctttaacgtcttctaagatagcagacaaaccagcaactgctcattggctgtgttaactttggcggttattttctgtgtggctgctccgtgcatgtgctgtgctaagttttttgggcaataaaaaaataatagaatatgaggttcacatccagagaatttacactttaattggtaaggcaaaatgaattcctgatatagttaattaacttattggaaaaagttatttaactgtgtaatgtttaatgtatactcagtgccaaatactgtctttgctatgggtcctaattgttatacaagtttaaaggatggcaggatttttatacatttatatagctatgggagacttcttagaaatgattattttgagctgaaaattgggtaggtttagagggatggaggaaattcccaagggaaaacagaaggaatatttattgagcacttaggtacagttttaagagcttttgcatgttttgtatcctttgattcttacacttgcatgaagtacgtattgctgctaactctattttatgtaagagaaaatggaggcactaagagattgaataatttgcccaaggtgacagtattagtaaatgatgaagcaagattcaaatccaggcattcttactccataatccttgtttgtaaccacagataaacaaagctttaaagcagattacatttagtggatagttggtgaccagcttggaaaagatatgcaattttttgttatatagtaatgggaaaataaggttggaaatcaaatggaggccataatatggggtgttttatgtttggttgaattttgttgtgtacatgtacaccaagcagaggaagctggaaattttcctgtcagaatgtttttatattcttttgcttacctaattgcttaaaacaattagattatatgtaagcttagaaaatagctgttatattctgatattaagcaaaaaattttccttctctgtatatgtggttgaattttgctgaaaataatttgaggtgtagtgatttatttc

SEQ ID NO: 113587 - DNA, 1041 bp, Homo sapiens
cactgcacttcagcctgtgcaacagagcaagactccatctcaaaaaaaaaaaaaaaaaaaaaaaaaaatcaggtgttgtggcgcacacctgtagtcccagctactcaggaggctgaggtaggaggatggcttgagcccaagagattgaggctacagtgatctatgattgttccacatatttcagtctgggcaacaaagcacgaccctatccccccataccaaaaaaaattattcactgtagatgaaaagaataaagaaaattaaatggtctgtggtatcattcaaaactaattactgtggacatttttatataattttttttctcttttatatgcatgaatcaggatatttttagccacaaataacagaaaagtagatcaaagttggcttaaataataggagttgattatcttatgtaacaaatttggaggtagcttctttcaggattggttaatcccaccacacattgatatcagaggtctggactagatttctttttttttggcattttttggattttcctttttacatgcaagtagttactgcagctactgtgtcctaccatgacaacaccaaagcagaaagaaagatgaactgtcttcttggacatctctctttatccaggagaagtatcccagaatgtctcctgtcccaagtaggctttcttttatgtcttattggccagatctgaattccttgctcacactgaaaggatctaagtgaaaaaaattcatgctctgggaagggaccatcctctgagcacattaccacctcagtctgaacagaaattgtagttctcttaacgaagaagggctggctttggagaggcaactaacaggatctgccaaattatatctctgtgcacttaaaagccactttttctaaaccgaattgtcttattacttctctgttgacctggataatccagaattagatatataattgttgaaattaaacgactcaaagattgtggggggaataaggtaaataaactaagatttttttactggtaagttattttaaataatgctgaaaagtata

SEQ ID NO: 113588 - DNA, 1341 bp, Homo sapiens
tcagtgatagtgattgtctaagattgtttcaatgcatgatacctggagaactattattatattcacattggatgttcaccactctgcttctcctgtctttttttctcctcttgattttgttttgttttttggtttgttttttagagatggaatatctctgtattgcccaggctgcccttgaactcctgggctcaagtgatccccctgcctcaacctcctgagtagctggtactacaggcaggcaccaccacacttggtgacagtgttccttttgaagcatttttatttgggtattgatggcaaataatgaccatcttcttatagttattttaaaatctctcctgagctgtgctaatacgatatacactaaccatgtgtggctatttatatttaaataaaaattagctacaattaaatttagtttctcggtcccagtggccacattgcatatattgagtagccacatgtggctagtaggtcttgcagtgaagagtgcagatctagaaagttttcctcactgctgagattctgctgggccgtgctgcttctgagcgtgctgctctgtatatgagtctcttgtacaaatgctagcaaaggaactctcttcactttggaaccaaaaggaacagctaaaagcaaagtagaaaaatacaaataaaaaatacaaggtagctggcaaccttacgagtcgtgttaggcagtttgaactttacttgattttgcctcggatttatcctatgattctgtactataatctttgccaacatttggtttttgtttgggcttacttttcaggtttcagaaatacaaattgaatatgtatagcactatgacttctacctgctagtgagaaatatggctagacatttcaaatggtttttattggatcatattgtattttgaagctttattctggtttacctttaaagaataggtggtgggaggcctcaaactacaattgtattatttctttaaatgtatataaaatataaaggatatattaaaatattcttaaaaattgaaaaattgtctagaacacttttaaagataattgtataatgatcgatgtcttaaaatgttacttacacatatagacataatcttgtgaaactactcaaaaagtagtataatttttttctgtaacatacaacgacatggtcatcttagagttctaacatgaacctcccacctatttatgagcattccattctacatattaactcccatttagttattcaatatatataaaagatacttgagatttcaggaaagatgagaattgagcttattcttatactgtgaatatctgtgtgtgtatacttatatatataatgtcaaaag

SEQ ID NO: 113589 - DNA, 1016 bp, Homo sapiens
tatcctgtaagctatacacataagacttggccttttctctctgagacacctatcactttgtaattgtttagtaataaattattttttttcactcttatgtcaacttgaaggcataggtttttcacattctgtaatacctgcagtgcacctgatacttgtcttatgtagcagcagacataacatttggatgtgattagcaagaatgtactggttgggcagagactggtaaaaattatcctagaatatcttatggtgttattttaacattctctcttaggttgttaggaaaagtaaagattcattttagattgttacaaagagtaaagatcattttaatatctgttgacattccataacactttgattgaaagaagttaattttgttaacattattctatttgatgcagtagtattctccataaaattcattccagaaatgtgtttatcaatatttgatacttggaaataaacttccatagaaaaaatattttaaaaagtgatgaaactccatgtattagtttgctagagatgccgcaacaaaacatcacagatagggtggcttaaacaacagaaatttttctcaccatcctggaggatcaaatttcaagatcaagatgttggcaggtttggtttctccaggtcttccttctccctgtgtcctctcacagtttttcctgtgtctctccatgtgtccaaatttccttttttttttttttttgaaatggagtcttgatgtgtcgcccaggctggagtgcagtggtgcaatctcagctcatcgcaacctccacctccctggttcaagcaatttccctgcctcagccttccgagtagctgggattataggcgcacaccaccatgcccggctaattttttttgtatttttagtagagacggggtttcaccatgttggccagactggtctctcgaactcctgacctcaggcaatctgcctgcctcggccccacaaagtgctggcattacaggcgtgagccaccgcaaccagccaatccttttct

SEQ ID NO: 113590 - DNA, 1013 bp, Homo sapiens
gtgtgatctcggctcaccacaacctccgcctcccaggttcaaacgattctcctgcctcagcctcccgagtagctgggattacaggtgcccgccaccaaccatgcctggctaatttttgtatttttagtagagatgggtttcaccatattggccaggctggtctcaaactcctgacctcatgatcaccctgcctcggcctcccaaagtgctggaattacaggcatgagccaccgcacctggccttaagtactttttaattagttgccattactcttaaaaatacagaaaactccttattttgatatatctgaaagttaatagaaggaagtaaaagaacaatgaagataattatacttgaaatgttttatgattgtgtttttctcaaaattatttctcaattttctttatagataacatattcgcaataaaatcttgggccaaaagaaaatttgggtttgaagaaaataaaattgatagaacttttggaattccagaagactttgactacatagactaaaatattccatggtggtgaaggatgtacaagcttgtgaatatgtaaattttaaactattatctaactaagtgtactgaattgtcgtttgcctgtaactgtgtttatcattttattaatgttaaataaagtgtaaaatgcagatgttcttcaccccttttggtagaacaaaagcaggatgataaccatatccccccagtgctcatcaaagtaggacaataaaaatccatccatctcagtccaggcagatttacaaatgattttttttttaagatcaaaaccatgacgtgataatgctttagttttgtttaaatattaatattaactattaagggtatatttgggctgggcatggtggctcgcacctgtaatcccagcgctttgggaagccgaggcaggcagcttcacttgagctcaggagcagtcacttgagctcaggagttcaagaccagcctggccaacatggcaaaaccccgtctctcttaaaaatacaaaaagt

SEQ ID NO: 113591 - DNA, 1025 bp, Homo sapiens
actcttcctaggggatttatagcttcaaagaccctgcaaatactcccttttggaatcatattgcaaaattcagccagcctctcctgaaatatggttggggtcgaggatgtggttagttgcctgtttctaacattagtaggataatggaagtaatacgtggaaatacatttcctagttccaggttttgatgcctataactaacaagtccaaaatctggcatctctttaagttaacatcctgcctttaccagcgatgtcgcaaacaagggcttattcagaaatcaatttgcataacctagaagtatgggcaatcttatgattttttaaagttaacttactgcttccactgtagcttgtatgaaattcagagaatatgaacaatatagtatgaagaggggaagtgatgggacacacctgtttaccttaatcctctgtttaattgctccttgtgccttacaagccagactatagaaaaccagtgcttgcatagcagacacaatcctgagaaggacaaaatgaaatctagatcctctttcctaaagacgtaatacagtactgtgaacacagtctcacacactgtctgcatttaactccaaacaaggttaaatagtctaattgcttggccagacttaacatttaagtagattagcataaacgtaagttgttgatgtgaaaaaaaaaaagggacactttgcattttccaacttgaatacctccagtagtctctgtttcatacttttttctgtattccttgccaacatcttcctttatttagcaaggatctccagtgccatctcaatgtgccctttttttctcttcacttctccaagtttctatttgccccttggattctgaaggtcccccacgcagttaaagggacctccagtgacaggaatatttgcacagcccacttaagcagtaactgcaccttcaaagtttgcttctaaatgaaagttctctcatgggcctatttatttacagaatgtaattttaagtcctcatatgagtataatacgtataaaggaa

SEQ ID NO: 113592 - DNA, 1036 bp, Homo sapiens
cccccaccccctcctgattttgacaactaaaaatgtttccagacattgctagatgtccctggggagcaaaactgccctggttgagaagcactggtgtatatctatgtatatgtatttgcatttttgctcaattatagtttctatctcttactggctagtgttggaagccaacccagactaaaaggaaagtaaattataggtgattgagtctagtagtatatactctcatttgttagagcgttagttgaagatttagtaggtgtgctcagagatggaaatgtcaaggcctaaatgattatttgatttatgggctcaaaagttattttatacaattcttaatttctggtttatttgtataatacaatttgttttgataatagatgtcagaattcagaagctgtctgggatattcagtatagagggatttatagctaagctattttaatcaaagctataatgaaagtgaaactggttttcaaaataattttctaaatacttcatccatatctctacgtataccttttagaaactatcttgccctgcttatacctgggcccaagggtaagggagacacacacacacacacacacacacacgtgtgtatgtgtgtgtatatatatctcataagctacagagagttttgaagaaagttattttaagtgaattattttcaaagtattttgaattttttcagcaaaaattccctcatatgtgtcaaacggagtctgttgaaaagagaatatttataggtgttaatttaaatttgagggttttctgcttaattaaccagtacattgggtttctttcatgcaggaagactgaaagatggcttcagaggctaagatttgtcagtagtagatgaaataggaactttagaggatgtggcattaaataaaatactggccaggctggtggctcacgtctgtaatcccagcactttggaaggctgagaggggtggatcacctgaggtcaggagtttgagaccagtctgaccaacatggacaaactctgtctctactaaaaatgcaaaattag

SEQ ID NO: 113593 - DNA, 1035 bp, Homo sapiens
ttaggtttgccctgctgttttaatgtcatttatccttaatcttatttatgaagttattaacatttgtttacacatttttcaaattttattatgattttaattttaataactaccccacgataccagcttaatgaaggtcaggtggacttaaagttaatagaagagcaccatttatcagttccacaaaatgaatgcattgtctcttaagaacccatacagaggagtcactactaactttggacttgagaaataatttgcctgtaagacagtcttagcatgttccccaaatgtaaaggaagcgctgatgtctatcactggacagaaagaatctaaagagtgaggaggtctctgttttactggcaagactgcccaaggtggggctggaacgggaccagtgtgaattctgggcagcaggcttcctagagcagcttgcctgttacctcaaagtctgggaaagctttcagggtaattggcctcattgaagattttgtttatgttattctgccttcatcttctgtggatgctatgtaattgtatttggtcgaaagccaaaaaagcaatatttgagaaatgttcttccctctttcctcttcatccccatttttccctgggtattctcaaatatcaacagtaatatgttcctttgctgagaaagatcgtttttgggaattcagtgatgagagcaaaggggaactgacttcagctcttactagaactgaatgccctgggaagcatgtctggctctctgtatatatctctctctggtaagcctttttttgagttatatttgaatagcagaagtttaagcattgacaatgtatgagtagtatattcaggttttaaaatgcgtacaaaaatcataaatactgtctaggtacaatgtctatgaaagttttttttttggtggttttttgtttttaaaatgtacttttatctgattagtagtaacagcagcaaaatgtgttctcctgaaatagttttaacaccagtgaaaggtggatcttgggagccagaacatgaagagaatctcattgt

SEQ ID NO: 113594 - DNA, 1008 bp, Homo sapiens
aatgatacatgcatgttggattaaaactgaacttcttctgtaggaaagatgatttgcccccctgtgaagtgcccagatacccactgttgcatttgaaggtggatcccagagaatagcctcagtaaaagcatagtcatagtgtgtggcctgccaagtgaaccatgtaaaatgtatatagtaaataattcatattgatattgtgccttgtacaacattgactttgagggttgtaactaccttgtggatgttgctgccactaaattatttacagtaaaggttctgtttgaattacaatccaaacagtgttcgattggtagttatgacaggtgtatgtagtatgcatttttggtggagtaattcttctaggattgtaattaatcctgtttcttcaaatcaggtcatgttaatccacttaatccataaaaattggatttaagtaattgcccttgtgtaaaccttatggtttacaaagtgctttcacatgtatcttccttacataaccaggtggatatgtggtagtattcccattttatagatgaggagacaggttcatcaaggtaaaacaatttgttgaaggttatagagctatgaagtgacagaacatgtgcgtgatcctaggtgtcctctctctgtaagtgcatacttgtctgctttggagtggaaagccactttcccaattagatgtacagctgtctgtcgaaggagactaagtccgagattaacggatggaagcaactgaatactttcttaggccctagtattatatggttcctagcaaatccctgaaaaaaaaagagcatgactcgtgtaagatagacccagggttggtccttcagtaatattttactgtatgctagataacttctttagttttatgctaattctaagtgtggattatccacagatattcagctacatagcttttgaaatgtggaaaatttaaatctgaaatattgggattagtttgtggaacacatgccattgtaatgtgtgctgagaggttgcctt

SEQ ID NO: 113595 - DNA, 1100 bp, Homo sapiens
ctattggtccatgccaccatgcttagctaattataaaaaaaaaaaaagaaggtttttaaaagatggaggtctcactatgttgcccaggctggcctcaaactcctgcgctcaacagttctcccattttggcctcccacagtcctgggattaccggcatgagccactgcacatagcccaattttttctttttagttcactttaaattaaaaatagagtttgaagaaaattagaattttagctaaaccttatccaaattattacattttccaaattgatgaggcttcagggagattttcaaatattctgaatccttattaatatgcacaaaactttgtttaaatcataggcggaatctcaaggttgtgtgtaaaataagtctaccactttggacttgggaaaacaaatattctgatgtaataagtgattagaagaaaatataatagtaatatgaaactggcatggcatgcctgctagacagcccctgaagcatattggttaaactagtaggttataaacacagtctgtgctctgaaggaatgtatatagttttaagagaaggaacatgtgacttgggctacacttaaagtgtaaggtgtgtttatgagcagagttttaaatttaggtgttttttttaacttatatatcttttctggctttgtataatttggctcagggctgggggcagggtggaaagaatagactggaaagtggggaccaagatggaggagttgagtggataagagcagcaggctgagctcaggaggagaacttgataaggagtaggggaaaggaaggtcaggaatgagccaaggctgggagatcagatggtgagatacaggtggatgtggtaatgatgacctgaggcaggagatttttgtctaacctcaaggtagggtagtagctcagtggctaaaagatatgcttgggactgggtgcggtggctcacgcctgtaatcccagcactttgggaggccgaggcaggtgggtcacaaggtcaggagatcgagaccatcctggctaacatggtgaaaccccatctctactaaaaatacaaaaaattagccgggcgtggtggcaggcgcctgtagtcccagctactc

SEQ ID NO: 113596 - DNA, 1047 bp, Homo sapiens
cttttggtgagttgccaaacctctccatgccttagtttgcccctctctcaaataggggtattgttaatagtacctaccacagagtttgttttgaagattacataaatctgtgtaaggcatttaaaagccttgcatgtaaatgctctaatgttacctgctatgaagttgaaaaggtcattttcttagtggtggctgctgtgtaacagtgataaggtttcctgatctggctgacaccgttccctggcttccgggtgacagaatcctttttttaatgagttgtgtctgagaagctagaattgttgtgggtaaggacctgggctctgggtttgaatcctatctctgtggctttccagctatgtgatcttgagcctcagttttctcatctgtaaaagtgggccagtagtacctatctcgtaaggtaaggatcccaggggttagtctatgtgaaagaaactgttaatagtggaatttgtagttggcatcgcatatcaaggtgtgtgcgtgctttagcgaaattccattcttaagaatttcttaaggaagtaggataaatttacaagctgtatttacaattatatccatctgtttatattggggaaaaattaggagcaacttaatgtccaatagtacatccatatggataatgtagtacaatatttgacagagaaaggtgtttatgatacttctttacagaaaaattttctgtggagtctggaagaatcttctaaaatattcagtgttttcatttgctaatgagattgtatttttttattatgccataaggtacattaaaaagtaagacatcttgacttggggaaactcacaataaggggaaacagacgtttagacataactatctttaatatctgatacaacagtcttattgtcctgagcaccgtgaaccgaggaaagccccttctgccaaagttttcatcctgttgcagaccttgcctatggctgtctcacctaaacaataggaagttgtcttcttgcaaatgaggagtgattatgaggctatggaaaatggaaaagctggaaagttcttta

SEQ ID NO: 113597 - DNA, 1016 bp, Homo sapiens
atgttgcccagactggtcttgaactcctaggctcaggtgatccacctgcctcagcttcctgaggtgttgggattactggcatgagccagcacacctggccaagattttcgaagggaatgtttttgaggactttggggaaagtttgtctcccctctgaaggatgcccgtgagtgtgtgctgctgagaggatggcagaatggcaaggtgggagcattctgcaagcatcatgacatcattgagctactgaatcaaccttccctagaactggcttccaggactttgggtcatatgagtcatgtgagaaaaatattctcctctacctttttctgagttaggcctcatgctgcttgaagctgaaaacatcctgttacacctcggttttaagcaccctcccctggcctctgagataagcctctcaggaacctgtggctctctaacccagtttgaaacgttttgctctccatagaattgtgtaccaggagagttatattgattaaattaggtcttacattttatgttatatattcagagacatatatttgtagtctgcatttcaggtaaagcgttttccatgttggaggtcaaatcccacgaggttcacgtatctattgctgctgctttaccctgttctggaaaagaaagttatttgcctgccgaacgcacagacatgagattagaaagtgatgacaagcgttaatgcttggctctttttatcatagactatactcttttctactctattatttcatctgtgtttgtgtaacatgtatctcacaatgcagaaatcttttttttctttttgttatgaaaaatttccaaaaaaaaaaaaaaaaaaaaagaaaagttgagagacttgtacggtgaacacccagatacacatctcctagcttctacagacatccttaagggttctgatggcagagatccgtgtgtaagcattttgaagtttttggctaaagaaaaacgttgtgttccgttctttttttattgtgtcggatttaaggcacagctcctgt

SEQ ID NO: 113598 - DNA, 1040 bp, Homo sapiens
tcacaagatgcaaatgtttttccccttagggtttatagagagtgtgaacaatgaggagttgagatcctgtggccctttggtccccagggtcttctcattcggccctactgagcaaggctggcttcccatttgctctcatctttttctccttcagtcactctggaaactagtagttaggagctggaaattgagaagctgccatttaggagtttatgcaacaaatgcagaggagagtctgttccagactttgcagttatatcaacttagagcttttgccaacctttcttggaaaaaaacccactggaattaagtgaaacttcacaacactgcacaatgtagccaattctgcatttggggtatgtaagcctggaactgtgggaagctggaagttgccccttagtattaacgtttgtttttgttgtccttttccttgaatgtagtcttacgtagagaacttggacagcctgtcattttccaaaacctctgtggctcatcctaggcacaactcatgtctctcctttcttctgttagtgtttagggatgggccaggcctgaactaaccgtttcagggctccgaggctgcgccttgtaacttgtgagcactggttctgggcagtcgcctccctgcggttagtggtgcccagcctccagtcgctgtagctcagacatggcctcgggaggtttggaggatgcccagcgcttgtctgcccattgttgctgacctgccgcattgtgtgatatggctccatgtgcacatcttccatggatttatcagtcttgacaggagtcttccactttctgccagtgatgaaatagatctttatgatttttttttttttttttgagatgcgtctcgctctgttgccaggctggagtgcagtggcacaatctcagctcactacaacctctgcctcctgggttcaagtgattctcctgcctcagcctcccaagtagctgggactacaggcacgcgccaccatgcccggctaatttttgtatttttagtagagaggggatttcaccatgttggccaggatggt

SEQ ID NO: 113599 - DNA, 1036 bp, Homo sapiens
caattctgcctcagcctcctgagtagctgggactacaggcgcgtgccaccacacccggctaattttttgtatttttaggagagacagggtttcaccgtgttagccaggatggtctcgatcgcttgacctcatgatccgcctgcctcggcctcccaaagtgctgggattacaggtatgggccactgtgcccagctgagttttgcaagtattaatgtaaataatgtgagtaaagcctctactgtattttctggcacatggtaaggagtctcagggtatgtgtgcaggtgttgtattacttcttgccatcacttttcttaccatcatcactgtcactgctatggtggtgaagaagcatatcagttaggattaggaccagtttcatgagacagaaaacccagtaacataaatgagatagaagctttcctctatactgcttatctgagagagcagagggcaggccaggactgaggtgacagcttcataatcatcaaggccatgcctcctctgtctcctaatccaaggtgactgcccaacccgcaggatcatcttcatttcccctccaggatggaggaaggagctagagtaggatttcccctctaccttttccaggtcacttcctggaagtatcccccaaagggtttttttttttttttttttttttaaatggagacagagtcttgctgttacccaggctggagtgcagtggcatgatcacggctcactgcaaccttaacattcagggctcaagtgatccttccacctcagactcacaagtagctgggaccacaggtgcccgccaccatgcctggctaattttttgtagagatgagttttcaccgtgcttcccgggccggtctccaacacctgggctcaagcagtcctcccaccttgtcctcccaaagtgctgggattacaggtgtgaaccaccgcggctgtcccaaacttgtatatacatctcatttccagaacttagtcatatggttgcatctcagctgcaagtggtagactgggaagaggagtcttttctgcagccatg

SEQ ID NO: 113600 - DNA, 1063 bp, Homo sapiens
ttcctgaccatgtttattcctattgacccaaatacttgagatttatttttagttagaagaactcagagatgcctaaaggctaatcttaaactctataaactacattaaaacaaagatataatttcagtttctcacacttaacttggagagtgttttctcacttagaaactttctcaaaaaccttaacacttagcaaatgcacatgtgatgttttccattgctataactttctcatttaattcactttttcctttattcatttttagaatacgggggaacatttcagggatttggttattcctcctttctctgggagcataacatcacttgtaaaattgtacaaagataggacaggattaaccttttaggtaggatagagtaggataaggttcaagtgacttggcataaaagggacagctttttaaaataaggcaaaatgagtagcttctgtctatgagctactgttattttcagatttactcattatttatacaaaattctatttaaagtaactaagatattttgaaaaaacctgttaggatatactattgggtaaacagaaatactaatagttaaaaaaaattggtgcatattaaattaatgccttcatttcatggccggactcaggacaaagagtcatgatgtgggtcctacaacttactagtgatatgatttggggcaagtcacttaacttctgagttagacggggttttaccagaagcagaatgaggctaatgtctgtcttgctagcctcattgcaagaatgtaataagacacgggttataaaagtactctaaaagtgatgaagggtcatgaaaatgtaaggttatgttttacaaaactcacagctgagtctagaaacaattctttaataaggaaagacaattagaaaacctcacttctctgatttttcaacgtatattgaagcctttgcttttaaatatactgtatagtgaatgttaaatgcacttgtgtggtttttttgttttttggagatggagtcttgctctgtcgcccaggctggagtgcagtggtgctatctcggctcactgcaagctccacc

SEQ ID NO: 113601 - DNA, 1052 bp, Homo sapiens
cctgaactgaaaagttcttcctttccctactgaaaaaatacaaaacctttttccatctatatatgtatatgaacacattttctcagtgcctacatctataagaactaaacaaaataatagattttgtgctgaatcttgtctcattccagtaataagtaatagtcttctacagagactgacctgattggagaaaaagttccatctgtctcattaagatactcgtttccaataaaatgttatttatattgaataactttatagtttcttttgagcaattttgcctttaaaattgtatttaactccatttaaaataaacatttaatactgatttttatggttaaatacacaaattttatttgcagaatttttgttgcagcgtagaatagactttcaaactttaacaagatggaatactgtggaggaggtggaatggaaagttgagatcgaggagaaagggaaatgatgtactgtttccaactcttttgaaagagtttgttcatttatttttttaaaatggatatcggttgtggggatggctatggcatttaggtcagaatggatacgtttaagagatgtaatggttttatttaaaactcagtatttataacatgccagaaattatattctttgcaaccgtttaaaattacagtgtgaaaatttgaatattaaccttaaaaatgtgtgaaagagtctatagtttctccaggtctctttctggggttatgcaaacaaagatgtgaagaactgtgggcaaaggctatcatgggggcagaagtaatgaggaggacagtaagcatttatttattttttcccctacttaaaattcctggaaagatgaactgattggatatttttaagtcatagcaacattttaacagaaaagaatacttgccaaactttaatatgacatccaaaatacactctttctaagatcacttttacaggccctctcctcatccctgagcctttcttcatgccattcctgacatctagatgtcttctgctttcatcctttatcttttgagacagagtcttgctctgtcgccaggctg

SEQ ID NO: 113602 - DNA, 1034 bp, Homo sapiens
tcatagcatgaaaatatttaataataaatgtaatactaataaaattgctctccattcgaacatgtcttcctgcttaaaactggcttttgttgctcccatttcccatctggtctgtagccagtgtctttgtgttggcaattgacaaggataatgtgtttgatgcttcaaaagaggatggtttaaatgtcaaaacattaaaagatggccttgtgtaaattaatgtggttctcagatgttttagcaaaaatcacctctttatgaccctctctatgtcattatcatgctacaattttgtcaagaattacactaaaaattcttgactcttgactcattctttgtcatgctgagacttaggtcatggttgggattataacaaaattgattaaatatgaaacacttattttcataacattttttaggaaaatctcagataagtctcattttttttctctgtctcataattgtggattttaagtggattcctttgagtagctttcttttgaggtaccagtttccctcagatactgcatagcacagctttggaatcataaaccttggtttgaattctggctcaccctcttgccctgggtgaccgtagccaattaatctttgcagctttgattttctcctctgtaaaacaagactaatggtaccttttctagaggattgttgagaaggcttagtggtgcagttcacataaagatcattgtgtgaggtctacacaatgcacatgctctgtagcaggaccagaggctatcgtgaattattgcccatgtttctcttggatctcaattgcttttcacttggcatttgtctcggctgagtagagaattgctttttaaatgatgagaaatgagtcaacaatgcatggtgatgtaaataggagggcatgttttggttttcaaagtggaaatagccacttctattataaaagttacaatagctgattattgagggcttactttgtcctagattctctttaaagccctctacaaatggcatctcatttaatcattccaataaaactatgaact

SEQ ID NO: 113603 - DNA, 1479 bp, Homo sapiens
agccttttgttcaaggaagcttggttaccagtgagtgggctcctgaaaactatggtagcagtgaaagaaagactcttggaaaatggttatgattaatcttgtgtgcagtgtctgtgtatatgcagtcatgtgttcccaaaccttattaacaagatgaaatacctattttagtacacacttgattttctggataacccaatggtggtagtaggcacccaaatagcctctctcctaactctttggttcaccttgtttaaagcctttagactgagtaagaatcttttggaccctgtttttttggcttgaaaatttgcccaatttgagtggtgggtgatatatttactagttttctttattccttgaacttacgatgagtgtgtgttttataatggggtgaaaaaaaaaacagtaacctttttgttgaacagacagaaaatttccaacttgcttttagtgagagctgagacctgacaatgggagtgaacatgccgggcttgattccagccaggttcctgtttagaattgaggccgaggtcagtcagcaggtgcttgcgttctcacacagtccttggaaccaagcatgctgtgcactgtgattgtaggactgaacacttgcacattaaaaactcctcctcatttcccgagcacttcttgtgggatgctgctgcgcatttcgaaagacagtgtttttgctataatagaaagctgtgtccaccaggggtagaagggaacacacgagagcaggtccagagagaaaaaagaatcagaagaggctgaacctagtattgaggcctatgaaaataagatgcagacatcatacttgagaaactgttaatggaatagaaaagcttgaaaacatagtgaatacattcaattttttggtctcagcacaaaatcactggagagaaaaatgtacgtaacaagtgtgatgtgtttggtgctacagggaagggatatagaatagtgatactcttaagcatcatagaagcgatgggaacatcaggccaattactgagaaatttcctattgactgaaatcatgtgtgacagtttcagaaataatgataggctctcgtatatgttggtacgagtttactgtaaaaatcaatagcccgacttggtgctcaggctctgttttctccttcggtgatatcgaaactgactttcagccctttcattgcacttgtgactccgggggacacgtgctgatttcctggttctatcctaacggtgcctgcccttttctgtttactccatgtcagtgcaggcattgataagaattctagtcggtggggtggtgaagacatcaagagaccttaacctggggtttccttgctgtatcttaaacttttgaccaccattcttacatttgctgtgatcagtttgtagtctttatgtgtaatactttttctccccaccttcctggggggaaaattccacatgtaaaggatttgtcaaattggtgataagaccaaacagc

SEQ ID NO: 113604 - DNA, 1020 bp, Homo sapiens
gtttgcaggtaaatatgtcaaagggagagttatatttttatgagctttatgtgtgtcttattttgaagacagtttatacaataatgatgcatgctttttattttaagggactttgtaaagaagataagcttgtctaatagtgcatgggattgcttggtaggaggcctaggtttgtttcttagctcagctgtttaaccagatccttgactttgggcaagcacccctctgggtttccatttcgtggcctggaggaggagaaatttagaccctgtggtctattaaggttacttccaacataaaactcccatgttatgggttgaagcctgattttatcactttatgttatttagaggatttgtagctgtgtcatagattttgtgcagtgtcgccattgctgtgatttatttggtgcctttggccaggatgtaacccttcaattacagtgtagttcccatgggaaggtatgatattggcttcatgttgtgggttctaggaatgttccatggaggtaaagcaggggctatctctgtaagtagtttcattggatggctcgtgttttaggaccacactgctgtttggctagtgaagcatacgtaatgatgctgagtgtaatagcacactgtccaggtatttgacaggcatttctctctggtttatgggttgatgcgacttgatacataatgattattctccttctttccaatgtgtttgagtggtgcacacaaatcaggcatatattggaaagttttaggattttttaaaaggatttttccgtttttaaaaacttgaaatagtgattgtgatagtacctctagagccagtgcctgttctttcatcacaggtttaacagcctcataagtaaatccttttcctttcagtttctttttttttgagactggatctcactctgtcacccaggctggagtgcagtggcgctatctcggctcactgcaacctctgcctccaaggttcaggcgattttcgtgcctcagcctcccaggtagctggggttacaggtgc

SEQ ID NO: 113605 - DNA, 1035 bp, Homo sapiens
ttccaagcctaatagaaatagtcttggggagagagggatttggttgggggtgggggagccaacccctccctcggagagtgtgggccacagatagggtagactttgaaactcaagagaaacatctgcaatggtttcttatctgaccatgcacagtgtatggtgggtcacaccagtctttgaattttggcaccctttcggtagggtaagtttctgtgggtctggcctccgagagttgtggcctccggattaaagaggtgggatccagtgagctgaggaagaaccttccattgcttttatccccactgtccagagggtcccagagactgcccatcagttgcctgttctgtgatcactggtgatttctgggaggttttgtgattaattttatctcggtgcttatgagaaatgacacttaacctcatgtctttgaaccttgactttcatctgtagaaaatggaaatgttctgttccatagagagtcagttgtacttgcactggtaaaagaaatgattgattactttgaatattctatttaaggaaatggtacacagcatacttctaaaatgtagatgggatggaatcctttttacaaaagaaatgaaagtaaaatttccactaaaattggcaagcttttgtgggtgtacctgtttcatcttcagcatgacttgaagaggaactttagtcagtgtatatgtttccacttactgaaagtgagtatgtaaagtaactaaacctatagtggactctttatttagaaatagatactgctactttggaagggagtggattgaaagagttgaaaaactaaagagaagagaaaactgaatccttggggggaaaatcttaatgcaagcacaaatataacaccaaattaaatctaggaggaaaagtagtttgagcacaagggaaaataaattttaaaatttaagggtatgtgtacgttttatgtcacgctgtggtatactctctggtctgaatccttgtgataggaatgatttcatttgcttcaaacacctccctttttctcccctaccc

SEQ ID NO: 113606 - DNA, 1194 bp, Homo sapiens
atgtacactggaattgtctgagagagctattcctcaaacacagattcctaggctctatccctagaaattctgatacgggggaagtgctggaacccttgaatccatattatctctgagagatggccacattggctattactggactaaattatttcttgactctaggagccagtgcccatgagaattctttttaaaagggaggaagtgtttaggagctacacatttttaaagattccactacagaggatataccttttcttggatataaagggattaatcctgtaaatactgtcagaatgtgaactctacaggatttccctcttttgttattactggaggaaaggaatatatttcaaaaatgttactgaatccagaataaaaattgagttgtctgtaatgagagttaaaaattcatgtgactaccttattatacagtattttattatataaacgtggcattttacagtataatacgctattttattgtataaagtgctgttagtatattttcttatctctgtttatagttaaaggaaaaagacaatggaagttatttaaaatccggaaatgcctcctaagaagagaggtcaagggattatttggagaactggcgaatttaggataattttgtactgttagagtttgctgagctctggaagccaggtgttttaaggatcacatgtctggtgtaagcacttgttcttctcttattctatttccccacctctccaccacctccccaccaaaccccagtcctgatttctgcccttctcttcatcttctggcccttttaaggtgcatgctaacagatgaagaaggaaatcaccattgttctccagtctagtagagcctgcttgattgaaattgattagctctagatgattggagtccttgtagcagcaggggttatatgtcaaatggatctccactgaaggccaaagctgttcttcctctgcagctgccaggctgcttgaaattaggcagaatgattttgcacttggataatagtcaggaattaactgcagcttacaaagcactgcataattatgggaaatgtggatggtgctaatcaaatgcatctgcatatggcattttcattatgtacaggaggcgtatgtgtgcacagaaagggaatgagcttgtgtagagcttgtatgggtacatgtgtgagaagatgcatctgtagaaatggcc

SEQ ID NO: 113607 - DNA, 1079 bp, Homo sapiens
tattttcccttgtaaggttcctgccagccaccccacaggaaggaggtaatgtgtatcggtatttgaggatgttttaagcaatcttcaaagagtaggataattcttaccccttgccttccctgaaatgtaaatggcagtggttcttattgactatgctccttccaggactttgttccttccaggtggggatgtcacctgtgtgctccttctagcacctcttttctttctggtgtggccacatcagtctggaataccctcccacctttggttccctgaagcatctcatggaggtccttgtacgtccctgcaggtctagttacgaagcagaaggataggctctaaaccagtcacatgcaggcacttcccagtttacatcagtgcagggccaaagccaccctaggcccccaccagaaccaatgggttttcccagtgaaagacagcaggaaccatcctttccatacttaggattttctttgttttaccatcagatttgggttatgtttgagtgacttttattgcttcagccacttagctttctggtttattgggatgctctgcttctggccgccctgaaaggctggcactgctgaaaaacccgcctccctcagggcaagcaggggctggagtgatgaggccatgtagtattagttccgctgagcagctgctgctggcaatttctggtgttggaaaagaatgggaagctgttccagttagaattaaagcttacatcttaagagagtgttttctctctcctgagagagtctgcagatatgcagccgctggctccaggaagtctttagggaccccacgtcgccttccccagggtactgggatctcctactcgtgggacaaggtggagacgtttgttttcctggcagcagtttggaaactgccggcgcgatacttcggctttcaccccatttgctggaacttagtcccgtggccgtacccagatgcagagaagccttggaaatatgcccacttaaaaattccattatgtgaaagaagacgagaaggggggatattaggggccaaagagcaacctctgtcacagaaccttgggaaagaaacagtgagat

SEQ ID NO: 113608 - DNA, 1034 bp, Homo sapiens
gaattattttcttacctactgaagaaggaagcattgaaagttccttatttattaatacctcttcgtatggagtcctttcctatcatgtgagtaactttttccttttgtcacaactttggttggtgacttaactgtaggggtgtgtgtgtatatttttaaaaagacttttggaaatgttgtcacctggtttatgtcgttaaaatacaagactgttagtgatgttaaaatcatcagcattcacccttttctgcctgacatgccacagttggctggctttcctactgatgacggagctatagtcctactgtgggtctttggaggatactagaacaaagcaaagcaatctgtcacacagtttcccatcataaaatacagaaggctttcaaaactcatggctctcacctcacgggcgttcagaaggaggtgctctaaggacagtctctagtgattttgcctaccttccctctttggctcaggaatatttctaattaggagacattgattgtgtgcttggaggctggttccaagggagctcactattcatatcaaggtaccaggaagggagcttgaagaatcttgttgctattctcagaaataggaatctttaccttaaatggtacctgatatggcatttaacaagatctggcatcaagtaatttaagttccaagatcagtaatttttgtggttatttcttactggattccattaaagaggtcccatatcagaagagttgcctacttgtgaacagatttgctacagtgaggaacattcagcttaaatacagcattctaatctgtttcattttttattttttagtttttgaggcagggtctcactttgttgcccaggctggagtgcagtggtgtgatcaggctgactgcagccacctcccaggcacaagcgattctcctgcctcagcctcccaccactgcctggctaatttttgtatttttagcagaaacaggctttcaccatgttggccaggctggtctcaaactcctgtcctcaaatgatccacctccctgggcctccc

SEQ ID NO: 113609 - DNA, 1087 bp, Homo sapiens
gctttagcattatggcaaatgtgttttaaaactcttaacagaggagcaattctctctctttttccgcaggtatctggaattggcactcgtagaatctctacagaagggtctgcaaagcagctaccaaatgcttattttctgcttccaaaggtccagagcattcagctgtctcaaatgcaggtcattttaatagatttactttgaatgctggtggccaccaaactttgtaaccttctcagaattggttattttactattttctgctttttgaaaaaattatatagaagtaatatacatatataaaatatcagtggattccacctaacttctttttaatggctgtggagttcacagtgttgatattccagagtttgcttaatcttattgttggtcttttgaaatgtttcctgtttttcactgttattaccgttaggccatatacctattttataagtttctttaattttccttctgaatcctctgtttccttggggcatgtttcataaagaggagagattctttagttaaagactgtgaacgattttgtagagcttgttaaatcttaccagcttgcttttcagggaggcagcccccatggtcacaagtaataacaggcccctaaggatgtcctgcttttagccctgcccggatggggcttggtgggaagaactatttctgatgttatagtagatgtataatgataagtttaaattcttttaatatacatttcatgaatcattttatagggttggctactttttccctttgattatccatatttccttgtaactggataattttataattgagaaaagctcttgaaccaatatattatgaaacttacctcttctttctgattggtaaataaagaacattgcttagaatttgtagtcagtaccattagtacctggggctttcattcattcagcggttttcctgagcctctgctttgtgccaggccttggtctagagtttgtatctgcgtagagcctacattccagttggggagaagaaccaaattaatttacctctaggattatatctggaatctttatcaccaagtacataattcttagggatcttaaat

SEQ ID NO: 113610 - DNA, 1038 bp, Homo sapiens
ctgtgccagacatgcagggcctacttgtcatttgtttgaggcccagcatcatccaattgtataaaaatagttacttgcctttggacagagccaacatacgctgcctgacctatcaaggtgaaaatcccacatggctctgctgaagctgccagcccaggttgtaatagttaaaagctagttatccaggtgtaaaaaccaaggtgttgcccaacacagatgacttccacttggccaaaccaaaagtttagatagtacaggggttatcttagtctcccaattgttttttgtctgtctttcagggtttctggcacatttcagggagtgggaggtagtgtccagtaaatgacacttctttttttcttgagttctgttccaatcatgaaataaaaagaacttgaagtgttttaggggaaaaaaaatctcttagaaaccaaaggagtgtggtaaagagttatcttctaaaagctttaatgtgggaaaaatgcttcccccaagcatctaaattatttgttgtggaattttattaaataaatgcattaattgtgaatgagcaaatcaatataatctcccctttgaggcctactgtgtacccagtggtttgcatatgtatctcatttagcacccatcatattgctgtgaattcaataacttgatttcatagaagaggaagctgagtcttagagtgggtggggaatgtccccaggcttttatggctggggtttgatctcaaatctgtgttggctaagcacttggccacactgccttttctaaaatgatgtggataaggaaaaatgctatccatatgcagtagcctcttttttcctcaaagcaaactaatttcagccacttcctaggtttttgcaaatgtttgcatgagtgggtctggcagtatagttagattttgttttagtggttaatatctgaggaataaaagggtagtggtggtggtggtgggggttgaaacacaattgctatttaatatcagggaaaaatagctgtacagtacttattaataactcagctgagcctgctgttatg

SEQ ID NO: 113611 - DNA, 1062 bp, Homo sapiens
atatttagcattcaaaattgtgaaaggggagaaagatgtctgagaaatacagaatctaagattgggatttgtctaagtaattctttcatatttcataagttgtagtccttaaataaaaaggtttcatgtggttattaccaggaacatcaagcctcttgttcattctgtctggattaatatagattctcaaatatatttatttattaggctgtgctttactcttgttgataagacatcagaatgacttaatactttaagtctgttatttcctttcctgtttaattgcacacagtccccccaaatcacacccttcttgtggcccagggcaccagcaattccttagcaagtgaagggagatgattcctttctctctagtatccagttccctaaattcatacttcttcaccacaaaactgtggaaatacatgacatacaaaaggagttttaacatttctattttcttgacctttgcattttatcttggtatggttttctaatatatatccctgtgttgatggatttttaggcctttaggtacctaggagaaacagatttgatctattttaatttgttaaaaaagtactgactgcagttgaaaaacctgatttttttttctgtttttctactacctagccccaagatctttgataagtctcttaacccctccaagccacaatttcccccatcttctaaaaggggataatactttatatgaaataatatgaaatatataaactatattaatactttcaatgaagactacttaagaaaaagttgtttatagagttactttttcttttttctataaaatatctgatctgatttgttaaaggagtatgggaggtttcaaaactagagaattacgtttttatttgtttttcctgtctaatcagcccaggctcactctggatgagggcgtgtcctgttgtcacacagtgtgctcagttggggacagttggggaacttgtaaccctagtatgtggttgccccctggctaacattttggttagagtttcttttttatcaagttaatattgctattgttttgttcttttttttttt

SEQ ID NO: 113612 - DNA, 1151 bp, Homo sapiens
ttcattttccttttcttaaatatgtgttgacatcatcccaggggctgttaagatctttaaatttgacagagtcttgcattctttttatatgcttttgtctctttcatccataactcttccctgttaaaaatgatagtcagttgaattttggacatctctttttttttattttttgtttttttggtctaacttgagggtcatggtttctaggtcattgtactgatggaaggcacacttagaattttgttactttgtaaacctactttaaaataacaatagattcctgtgtttaaataacattttcaacaaacatcagaaacaccaaactccagtgttcctgtgtatatttagaacatattcacctgcttataggtgtaataaggaattttcatgttgcccgagggagaacttatgattttcattagaatgtaagctcagtgacagtcctgagaacagatttctctgtttagcttactgttgtgtatccactaaaaagaataatgcccagcatttagcagatactcagatatttattgaataaatgaaaaagtgtagtttctgaatacttgataaattgtttattattagtgtgagattgagccttttacttaaagttcttttcctccttttttcttcttttaggcagaaaccactaatactagcctcttgcaggtgcaactggaatgcagtttacataataaagtgtgtcagcaattaaaggtaaaataaaatgtgtagtgttttctctctgctttcctcctgcctctttgcttaaaaataaaacacaaggctgggcgctgtggctcatgcctgtaatcccagcactttgggaggccgaggcgagtggatcacgaggtcaggagattgagaccatcctggctaacacggtgaaactccgtctctactaaaaatacaaaaaaattagccaggcgtgctggcgggtgcccgtagtcccagctacttgggaggctgaggcaggagaatggcgtgaacctgggaggcggagcttgcagtgagccgagatcgcaccactgcactccagcctgggtgacagagtgagactccgtctcaaaataaaataaaataaaataaaacacaaaacagcatattctgttctcacacacgtcccattacgttaaatgcttctcctt

SEQ ID NO: 113613 - DNA, 1881 bp, Homo sapiens
gtgatatgatttgtgtgattctctctctcactggccttgcctccccttgccttagcattgctaacaggcagtgaaagggatattagctgagtggggaaaaggaagtgaaataattcagtttatgaaataggttcagcatcaggcatccagatgtgtgaaaagagtacatattcacatggtgtttctgagttggcttcaggttctggtttggtcctggcggcctctgtgagctgtgctggccgcagcctggttgcttcccctcgggcttccagttgctccctatgtgagccagaaggttgaaggaggcgattgccgaggttgtctctggcgctagctttcatttagtaacgttttatgatgctcctgtttttgcaattagaggctcataagagggctgactgttgtcccacactcaggcctgatagcatgcatgtcgtctgttcacaggtattttagaatggactcttctgcaacccagtttcacatagagactcatgagaacacatcaggactttggtcaatatggtaccgcaaccattttgaccgtagtgttgtattaaatgatgtgtttctttccaaggagaccaagcacatgttaaaggtacatatagtattttttccccaagttttagcttattttaagctttgtttaaggtcagatgctgtgaaattatttctataaaataataaaaaatattccaaatgctatgaagttattatttatataaaattttatgatttttaaaacatgtatttttcttttaacattttcagaattacttttaggagacttctctttctctctttttaaaaaactgtttttaaaagagctcaaagggaccaggatatagcctttcaaaattatttgctcttaccattattcaaaaatattatgtatatgtattgttctaaaaagattagtaaaaatgagcctggttcatgataaaatagtaggttttttgcaaaatatcacttactgaaatttcaagattacttttgtgaaatttaaaacagtgtcatcttaagcattatttgtaacctatcatttctataaaaatattccaacttttgatctggaaataactgagtaaaatcatactttctgaagtatagaagaatgttagcatcatactttataatgattttaatcataattagtgttaggaaaagtaatttctcttgcttcttttctttttagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggtattttctacaatactatatgtgtgttacagttttcttaattactgttgctttttattaacctttagtgcttgagttttattaactgggttaagctcacgttctttaaggctaagaaactgaaggatattaccaggccagtcttggatgataaattgttcagacataaaaatctttatttggaaagagttttcttttttataaagtaatttgaagttcttgaatgaaataaggcatgaccaatagattaatagatgtcattttcatttatttccaaaatttgtagagcaaccagtatgtgtttgctatagaaaacacaggttggcttttagtacatacttgcaatgacttaataaattaaattgttaaatgctttatttggatctcttctaagtgactcttagttgctcgtaatccttgaatttgcttagtgggccaagtataaagcctgaaaagattcacagttaagaaaatgctttctaaaatctgggtaaattatatttaatttagac

SEQ ID NO: 113614 - DNA, 1026 bp, Homo sapiens
gctttctaggagtatgacatggtttaatttgttaatttgcagggtacgcattctgaggaatccaggtttggcatcctccacttacatctgcagcctttggaaatgaaaagggttggcgtagttttcacacctgctgactatggaaaagttacctcactcatactaatccggtaggtgtgttcctgttgtagaatctgtttctttctcaatgactcatctgtgtaaatctctttagctgatagttgacgttcacttctcagtcagaccttcaggatgaaggctgtgttgcggggtaggaagaagtggaagctgagaaagaggtcactggaggcttgacaagtaatccccaaggcctcagtctcctctcttctccaatagggagtgtgcgtgcatgtctccaggagaggtagtgctttccacacagcttctcgtctgtgctgtctcaaaaggcagaacacactcatgcagatctactcctctgtccttagcatagaaagatcgttaaaggactgctgtagatattttcagtctttagtatttgaacaaacttatatcactttcatctcttttttgctcctggaattctcagtagcccaaaggacaatagaaaaggtgtttcattgagcccattggctctttttattccttttcttcctttgaagtgagttactgctgactgatttaagcatgcttaatgtgtttattttttaattgttttcatctttaggtagtcttgagagtcttttaaaaatttacagtaaatacagatgtatcttgaagctctcctcatcagtgagaagtccaacacaaatttaatttttaataaatgacatttgagttattttttcaaaacttgtagtatcagatcacctggcaaaaaatttattattcagaattttctttaatatataagtttgttcttttgcaaatgaatgatactaaaaaaagttaaagttcttcagagtttattcattaagcattttaactaaaaatacttaatgccctgttgacttagtgtttcttttt

SEQ ID NO: 113615 - DNA, 1008 bp, Homo sapiens
tgtaggaaagaagatggggaatgtgagtggaaactattagctagaaattgaattgtttttgtttattaaagggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagaggtctgtattttttttcttgcctattaaaaacaaaatccatttttaggactgtgtattaagtgaatatgtgtatttcatatgtttcactgcatttgaatccatattaataactggtgagtttgatgtgtgtgtgttcagagaattttatttaccttctaattatatagacgttactacagtaatttttagagaaaccagatagcttttactctgaagagaatctgttcttaagcaaatgggtcattcctaggtaatgatggcagagtagaacttgactaacatattccttctatctagttattactgaacatctatattttagggcatactcttgctgagttgtattgctttttgtctgtctttgtcctcatatctattatcgtcttctgtctaaaagatgagaaaaggattcatgatataatagaagaaaattttcctgatatgagggaagaactaactttgcagatcaaaaggggacaatgtgtacaacaggaaaaattgatacatcataatgggaataggcacttagttaaattaattgaacttcaaatataaagagttgtgcatagacagaaaaatcaagaagtacaaacttaagcttgcctcagacttttcaataggaacatctaacaccaggaaacagtggagcagtatcattgagagaatggaaatgtaaacaaagaatattgcatccagccaagttaatactcaagtacaaaggcaacaggcagacatccttaaatacaaatgaaatcataagctgttcttgtaaaatcaagttaacgaaa

SEQ ID NO: 113616 - DNA, 1064 bp, Homo sapiens
gggttcacaggagacaggcccatctgagggatgtggatggcataggctgtactttgtggcccaaggttgtccccaaccaagtcaaccaaggtggattctctggtgcagatttgcgggcagtggtttgtcatttctttcctgtctctgtgactcactccttgttttgtagagctgttctttaaaatcccttgagtgtattaatactttccatttcattgttcatttggcgaaaatcattcttaataagtacattctcaagtgcagtgcccagtgtttgtttttcttgcacattcttagagcctaattttgcagcttacaaaattgtataaatctgtctgtataatacacgtggaacattcctctggatttattggcaaggaaggttgaagcccaggtttggaatccgcaaactaaattttaaccctagctttggctttttattttcttttaagcagacttttttcccttagaaaagtaattcatgattattatagaagcataaagaataaggtagaagaagatctatccagaataaaccacttttaacatttttgtattcttttctatgcagatttttaaaaactattatcttaaaatagttaagataattattattgtctgtagctttgccataagattataactaaattttctataaaaattaaatggggagctttgttttcagtggttacataacatttcatcatttaactgtgccataatttaaaccattctcctgcagttggacattaagattgtttccaactttttactttcataaataagtctgtgatgaacaattttgttcctcttacctgtgtacctggtaagtctttgttatagatgtcaaaaaatagaatgaaagggtattgatatggtttgtctgtgtccctacccaaatctcatcttgaattgtaacttctacaattcccacatgtcatgggaggaaccctatgggaggtggttgaattatgggggtgggattttcctgtgctgttctcgtgatagtaagtctcacgagatctgatggttttaaaaatgggagtttccctgcacaagctccc

SEQ ID NO: 113617 - DNA, 1092 bp, Homo sapiens
catagtttgaaagggcaaagggaatccctctcccgttgggtctgttaatagaccatgcctgacattgaaaagaggaaaaggctccaattgaggaaactatacttatttaatacttatgtatataatgtttatgcatctcatgctgatgcttttcagaaccacatttttgaaacatcaggcatattcttgcctatttacctgagaagcttacactagtttggagcattctatagagatttggctgttctcctaaagttcgtctataaacaaaaacataaagacacaacttgatcctaagttgagtttttacctaatttttcttcatagtacagtaatttatgtgagttgcacataccaaattaacaggtgaaggttggaggatttattgctgcaaagttaacagcaagctggtcataaattgctagcagatgtttttcctttttagcctcttaggaattttataggcaacaattcttttttcttctttttctgtggagcttgagggaagtagcgcaagaggggaaatgaaaacaaactagaggctgagcaacatacttctcagttttcaacagcactgggacattctgaattcagatggagttggtcttcaaacatttaaacatgtttttattcatatttagtttaaaccattaaacatttactttctcttctttagcaagaagatccttataggaagaaaaagcttcaggagaaaagagaaggaaatttacaaaatttaaattggagtaaaagtcgaacatgtagaaagaacaagaaaaggggtgttgctccagtctcaaggtgcgtaattcttactatctctaatattttgatctatttttcactttataattttgcatttggctattcacttttaaacttatttcggtgatattagataccgataatatgagagtgtaaatgtttatctcttaagattaaaatacatttgtaaaattaacattttcccattatgtttttattttgttaaaaataccttaaagtgaccattttgtatctttcctttataaaatgctaacagatttggtagtttttaggggaaaagcataagccatccctccgtgtggagac

SEQ ID NO: 113618 - DNA, 1204 bp, Homo sapiens
ggtcccagagctccctgcctgtgagcacaccctccctgctcagaagcccgatggcttctcctttcacatccgcttgacacttgtttttgtttttttccagataaagggtatttggcctgtgggttcttccccgggttgcaaataagttcatcccattagatgaggatttcacaatcctccctttgagaaaaaatggagttaaagcaacccagatttaaattgagagtagtctaataacttccaagtaacttgatagcattgtagtattcgctgatgtgtattcacctttctaaggcttttttttttcttttaacttatttttccttcctcatttatacttcagccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatgaaatctgggtgctctgttttttttaactcttcataaatcagtggtaaaaacaaagcatccatatgtcagaactttcaaaagtcaagaagtgtgtcaggcatgccgaatgttttaaatctgaacacgggagacgtcttttttttttttttttttttttttttgagacagagtctcgctctgtcgcccaggctagagtgcagtggtgcgatcttggctcactgcaacctctgcctcctgggttcaagcaattctcctgcctcagcctcctgagtagctgggattacaggcgcacgtgtgccaccacgtccagttaatagagattttcagtagagacgaggtttcaccctgttggtcaggctggtctcgaactcctgaacaagggagacttctaagaaggtaggagttgagcaagaaatggctgctatggttttcctcctcctgagcatcacaacc

SEQ ID NO: 113619 - DNA, 1049 bp, Homo sapiens
ggagctttcaaaaaatgaagttgctcagccgttgagaactgctggaaagcccagcttaacaagttgtttgcttgggtggactctgcttgggggtgcagcggggggttctttccagtcctggtgtgttgctgggatgaagcagagagccctagaactgttctctccatcccacttacggcaagggctgttcctctgtcaggccagtccttgggggcaatgacagcagcaggaacattctggtaagtgtgtggtttccctcccagtgagcaggctaaccctgagtataggaacttaggggaggttaggtggctgatgcatgttttccagaccggtttgtatctgcttgtcattgatcttagaagttcatattatggtggaattatctatttgcatgtgtaaactttgaatatgtttttaacttttaataaaaagttatttttacattttgttttgtctttatattagaaattcagtaggcgtgatttgtgagtggaatgcagggtttgcttgctttgaatttatttctctttgctgtggttgtgtggaggcctgagacaagtgtcttgtaagcttggggggctgccctgcacggagagcctccaggcatgcactgcctctagaaagtcccaaggttgccaggttagaatcctgatctgcgtgaagcagacacttccctccccgacccccagtattgaataacattaaaaataattatgttctaggcatatagccaaaagaaagcaaggattagacatattttcacacccaggttgatggcagcgttattcacaataggcaaaaggtggaaacagcccagatatccattaacacataatgaacaaaagtgtaatgtgtccatacaaaggagtatcattctgccctaaaagagaatgaaattctgatacatgctatactatggatgaaccttgaaaacattatgtaagtgtaataagccagacacaaaaggacaaataatatgtgatcccacttctatgagggatctaaagtcaaattcagagacaaagaacagtggtgggcaggggctgggg

SEQ ID NO: 113620 - DNA, 1035 bp, Homo sapiens
ctctgactgccagaaacctaggggtcaggaatgcttatagcaaaaaataagggtgggctaggctgtggaggggcttgtgtaccacaaaatggggaaacttaaaatgaaactccatgactttcttgctggtttcaaacccagattatcgaaagggaggttctgaattgatgaatgcatgccaggagtgtcagaggatctagtactggtggatttgctgctgatctttgctcttccttaaggctggcatcactgcctagtctgctgccctcaggaggtatggcctctctgttgaggctgccctaggagggactcacagcttttcccttaatcccatatggcaagacagtgtggtccaggaaccagcagccaaggcattacctgggagcctgttaaaaatgcagtctcagttcccacgccagacccactgaattgaaatccgcattttaaccagatcccagggtgattcatttgcacatcaaagttcaagaagtgctggtttcttgactttactagagctagggataagaaagtgaaaacagagatagttactgaccagcctattatctgatagcttccctttggtttgaacctcaccctattttattttccttcatcacccttatcactacctgaagtatgtctatgtgtgtatttgattgtctaagaacctccttcagcatgaaagctccagcagaaaagccatgtggtctgccttgctcgctcctgtatttccaggacctagaacagtctcagcaaacggcagggcctcaataaatatttattgaatgaataaatgaacagtaacgtacaatcttatgatgtaagaccctaactccagcataccttactggacaaacaccatctccctattccccatcctccacctccccagctacaacccctggggtcttttgagcctgcaactggttaggtatgtttgaaactcctaaaatttggagtgtgagagcagagaccatgggtttaggagttccctcttctgcttgtctaaggcttgctttccaggctcggatttct

SEQ ID NO: 113621 - DNA, 1609 bp, Homo sapiens
cataataaattgagtttaaactttacggccacagagggatcatatttcacctaaaagtcaggcatttcttttcatgcttaagtttccaacagaggaagtcatttgttggagagagcacacaccacatgcaactttcttacaaacacaagggtgagtgaggaaaggagaagaaaagttaattgagtcccgcaaagagagagttttgaaaaaatggctgattggaaaccaagtgcctggcaaatgctttgaggctttagcagtggagccacctgctgcccctagctcccaacccccgatctgcagcctctgagggtcccattagctctaggaagcctctctttcctcatccaggccaagtcacacgagttggcagaatggggggaggtatactgtattccctcattataactggcatgactctttctgccctccctcatagcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttacctattctt

SEQ ID NO: 113622 - DNA, 1095 bp, Homo sapiens
gatattttataggctttttaatagaaattttataaaatgatatttttctatcttgcccttaatgaagtgatgtagcatgggggctgagaactgtgttttggtaaggctctggtgatttggaattatctgctgctaacatgcctggctcttagccagtttgagggttgtatacatttgaaaacaggcatatgaaaccccgtcagccccatttgtggctcctcctgaggggaaaagttgctaaggactttgagctacctcccttctttctctttcctcagcagtgtgaagcctttcccaacaccgggactatggtagttctgggaccagtcagagttaaacccaggacactttctggaagagacctggagttgtcaaagagcagggattggatggttccagagttttagggacctgaccaggcctgagatttctgggatggcaaggtaaggagagtgagagctggagtgatttccctcagtctcgaggactatgttgaatatgtagaagtgttaatatgggtctattagactccattattgattgacagagcagggaacatatctgcttatgagtaagttcagccttgtgcctgaataaatacttttttaaaaggtaccaataattccaacacaccaaaaggtacctgcccttggaaaaggataaaagcaagaatgcctctgggtgaagttcctggtcattcccaactctgaatttagcattgatcctgtgtctagctgggctcctcttctgacctgagagccctgaagtcagcagatgaggtgctggtagagttccatgtagacaaagccccagctctctttccccttataatcctgtcttcaggggagtgacttgcaacttatggaacatatcacatgtgttttttattgtccccaaacaccatgtgatctatcatgtatcttgctaaagtaaatttctaagctttttttttcctttttaaaactattttcgaaactgtggcaaatgtgtctagacttagtcatacaaaatttacaaaaaccttttaaaagggattttaagatggtgttttaaggttgttaggtgttccatgttaggtgtcttctcagtaagcca

SEQ ID NO: 113623 - DNA, 1530 bp, Homo sapiens
ttttgagagtttgaaacaggcacagaagggcaagaagaacctgtaccagggagcttgcagataacaatgaaatgaatgctgcctaactcaagcacaatcttggcagaggcacaaggtgacacagaaccacttagagcaggctgttgtaattagtgagatgtgttttcaaggtggaaacagcccacatgtggaacgctagccagtcacccctcccagtccagacttggcccccctgagatacagagctctgccgagtagagccaactacactggtgtcctgtggctgagaaagacaatcttttgtctatattttctagttaccagttttcccaaattcctcaagtatctttggttctttgggtgctttctccttcaaaaggccttgggaataactttttcagactgaatttcccagaggttgggaggatgagctgaaaagctgcaccctgtctcagttaactataactacatacacttgtatactctgcccacaactcccttttgagagtcataatttattaaacacaacaacatataggcattctcattttgctcccaccacccctcccccccaaaaaaattgggaagcatgggaaaactttcttaggattgagtgttcctgcttttatagaggaggcagaagctgaggttaaataggacaattgctacttttgtctggataagtccctttgagttgtttacaaacgccacctactgttctcttttaagcaaacttactaaagactgtttttcacatttctagctccaaaggtatgtgaagcctgcaaaaataaaaatgatgatgacaacgacataatggaaacgctttgtaaaaatgattttggtaagtaatacaacaacaacaacagatttcacattcagaagttttatttaccagtaaaacttcaaggtgcaaatcattatgatgttgctagataaaggttgggtaaaacaccattatagctcatgtatcccaaaatcatctaacttgatctatcctagtttcctccttatgtaactgtctagcattgagttgtatcttgttaggtgagactcattgttctgttaagccaataatcaaataatgaaaattattcagattatcaatttccagtggcacattttaaatccctttttttttttttttttttttgccgacaggcataatcccgagttctattttcttttgattacttaacatgtgcaccagggatggaagtgtaaatattagccccagccaaacagattcaaggctttaaattggccacaaataaaaatatttttactttctttataacccataatgattttaaacctctgtgttctaccattagtgaatatatccaaggcactgattaataatttgtcaaggaggggttccttaagttgaaaaagaagagtggcttactgagaagacacctaacatggaacacctaacaaccttaaaacaccatcttaaaatcccttttaaaaggtttttgtaaattttgtatgactaagtctagacacatttgccacagtttcgaaaat

SEQ ID NO: 113624 - DNA, 1137 bp, Homo sapiens
gaggaatggggttgaggatttggtatggggaagagtcttactttttcatggttcatctttgaggttttggctttttctcatttcatgtcattttcccaattaactagctagttactttaaacattgagcatatacatattagttgtgcaatcttacattagttgtagagaactgtatacaattatttcattttatcatcttgttttaggatctctcgttcatagtctttttactacatattgggtttatacatttatgtctttagctatggatagtataaattttaaatctattagataatgttttcccctctatcccagtgtttaatgctttctggttatatgtattaaagttgctaaatctccctaagcaacattttggattggaacagttgtcaatttgtatatacaaaatccagagtcagacattctggaaggaatttaaattctatcacttaatagctgtaagaccttgtatgggaaatttaaccatttccaactcttctgtctctctgtctgtccatgtgcatagagtcaacattcacaactatttttcagaccctcagttttctctcagagaacataaataatgacgccatctttcttacctaccttacatgtttgtgatgagcaacaaaagagaatatacatgaaagctttcgtatgttgtaaaacaatatgcaaacataaagtgtgattgttcgtagtcctttgcttgactgtaaagtgttaagtaaagactactgagttgagatgtccaattttcccatattttgaaataagaaaagacattgaaggagtcagataatatttatgaagccaaaaatctaaggcaaaaattggatgtatcatttgtaacttgagacaaagagcaaccaaagatactctatgttaaggggataaaaattctggataataaaagatatttgttgtactgaagagaagggaaggaaggcatctcatcttgttgggagtggggcgggtgaggtgggtgtgttcccgccaggtggtttctgtccctttccttcctctgaattttaaaagcatgacctccctcttgtgcttttgataagtttaacatcaagtgcagggccttgaatgtcagctcctgacctcagggacaactttctgggaagcc

SEQ ID NO: 113625 - DNA, 1033 bp, Homo sapiens
aggcacaagaaagtgtgcggtgtgttctgggacaaagaatgttctgctactgtcgaataatgggactaaagctggcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacagcctttaggaatgtagttttctgggatttattgaaactttgaaccttttggcctactaagttcattcctaggaaactgcctaatgggaatgatctgacaagtgtacacaagcaaagtcattgcacctttgttctttaatacttaaaactagcccaaatgccctgtcagtaagggactggtttaatagatggtacctttatgcaatttgtttctaagtattcgttaagagagtgaggaatgtctggattattagggcaagatttctaaacttgggtaaaaaaaaaagttgtgcaagcatttttgtggacaacttgatgctctaaaatataagtaacaccacattactaacagtggctttgttaggaagcagaattatggaagaactttcatgggtggctttacatatttctataatgttttaattttctataagcatgtatttcgtaaacttaaataaagaaaaaagaacactacacttgcattcctgagagattctgatatgccttctaacaagaaaaatcagaggtggatgctgttccatctctaaaggccaa

SEQ ID NO: 113626 - DNA, 1155 bp, Homo sapiens
tgtttagtctgttattttttcttttaatgatgaataaacatttgtaatgcttctaagctgtcacacttaagtattatagcagcacttgcctggttagggcatatttgcatgttattatgtgtgttcatgcatattcatattacatgtagtatatttcatagcttagtcctctttgagttcccatctaatgaatctcagggatttatgctgggaattgcttaaaattttgtttattattctggaattggatgtcagattttcaggtgctttttaagatctataagttctgaacccagcccaaatgaaagtagacaaaccaatattaagagaaggtggagtgcctgtgtcttatgtatttttataaccgtagtattcccatgcttgggctaatgatgcttcataaatgtttgtcaagctgtactgctgaggggataccaggtgtaactagatttttccctttaagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccgtaagttctgtgtttcacattcgttaagtaaaacagctataccaatttggcagcatattctcatttaattatcagaaggaaaaataatctttatagtatttaagatatctgtcttcttgaatagtgtccatttatatatttctatattgtttcactgatgccagtgaatccatggatggctttaattttatcccaacttcctttgttatagttgctgggaaatgttgcaccaagaataacagcaaataaatagattgctatgtaaattaattcgagaatcataagctttggtgttagtagaatatccaagtagaaatgttattttagatggaaaactacaaactaaacataatgaatccatccatctgttattagacttggataatgccagaagtttatcaactcttcctaaaactgtcaaagaactaagtgtataaagccaatgaataatgttagataccttatttttgttagaaaggaagcctattagacatgaag

SEQ ID NO: 113627 - DNA, 1105 bp, Homo sapiens
gcagtgtatggtttggatttgcacccgacaatcgatgtgttggtaacctgtagtcgagattcaactgcacgggtaaatgggatagagttgtgtatttatctgtaaatatattgcatcttgtagggtgcactttcggtttcagtgtcttcaattgattgatagagaattaaagatagctgtcttgagtcatcaatatcctagtccctaagtttcttaacttgcatttttttccaccttagtcttcagttgtatggcctcaccatgttagtgttattagtgccctgcccctgaaatgtgatattctcacgttccattctgtaacaactattgtccattagttctttcattcagtagtcttaaaaagtagtcccatcatactcattcttagattttcagtaccctgatcttttagctttttagaattcttgcaagttgtctcctatttatattcgtcctccagtttgtaaatcattatctttcacttaagcattttctttattatattcaggcactagttatgtagtaaattttcagccttgaattgatccagttatcttcttgagataatgaatacctattctctttcctaatatgtctattgtgtttttatagatttgggatgtgagaactaaagccagtgtacacacattatctggacatacaaatgcagttgctacagtgagatgtcaggctgcagaaccacaaattattacaggtatgatcgatacttttcaagtttacagaatattcatgtcagaatccatgttattatacatatacttttaatattcatgatgactcttgctctgtattgtgtttacagtgtttctgtgtcatattttaatcatggacaattgaaatgtattcaaatgaaatttcattccactgtttttacctcatgctttttacatatcatagagtatgccatacatagtatcctgtaatgtctgactagaatactgtgttatgaacaattattattttatagtgtcaaaattatttttctaagaaattgaagttagaagacaaaacatcttgagactagtaatctttagaactgatttgaatcttactttgctctaaataaagttagtaacaatggatc

SEQ ID NO: 113628 - DNA, 1074 bp, Homo sapiens
ttttagacctgaataaggagtaaaatttatcatttatactaataagtgttctaaataaatatctgtttgaaaagtgctatttaaaccactttttctttacctactgaatacctaccactaattcctttatacttacattgttctctccaactggttacaaaattaagagcatgctcattcatagaaaatgtggaaaatatagagaattaggaaagtacatagacctgtatataatcctaccattgttagatatttggataagtttcgttttagtatttatttctgtaagtatcaataccttcacttctaagctcttttcctgtgtgtgtatcttttaaaaaatcattcttagtatgtaattttgtatcttgcttttttcacttaacgttgtatcaaaggcatattcctgtgaaaaatttaccatcttttaaagtggttgcataatattatatcatttagatagtctgtaatctgttttcctattactggacagtagagtttttagtctgattttcaccattacaagtaatgctgttaagttttgtatataagactttttctgtattttaaattattttgttatggtagagttccataaatggaataaatgggtcaaatatttttgaagctgatacccaaagtacaaattactttccaaatgggtgaatcgatacttgcagtgtatgagaggatccttttcagcacattggttgtacattcctttacaaatatctaatatggtaagcaaaaatggatacttaatctttttaaaaaactttgtatgaaatttctaatgagtgtgaactttttcatatctgtatttgctgcttttaggatttctttaagttgttgccagcctcagttaatttaataccatacttttcttactgttattatcaaagatatcatttatataacaagaaggttaaccttttgtcatctaattgcaaatatttttccagtttgagcatgccagtttttttcttgcttttatttggaggggagtcattttgcaaaattttttatttttacgtatttgttatctttttccttttgtctttgaaagctcagttt

SEQ ID NO: 113629 - DNA, 1064 bp, Homo sapiens
tttatggatacgttcttatgtttataatttctaaatagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggtgagtatggtattatcagaaatgtcagacttatatgtgaattttaaaaacagaaaaataaaatatgttatttttgcccctcctggcaggacttattgtggtcgtacagtatttaatggccgtacctgtattataatggaagttttgatcctcatgggaatactgttgatgacttttttcttataggaaataaaaatggtagtataatgatggcagagattcttagagtgtggagaaggtcacagtagagattaaaggaaaaaattggagaatattcttaacctgtgaggacaccatctatcttgtctgtaattcagaaagatgaaattaaatactgaaatcttaataagtaaagagaattcaagattccacaggaaaccatttgcttggaagaaataccagagtggattgtcacttgataggagggcttctttgtataccattgctatatagcaaatggtcaaggacatggtttacagagatcaaagcaaaagtgatcaacttcccttatttctgaggcttgactttagttgagaaaatttgatagatccagttgaaaacttaatattacttgatacatttaaagagatgataacttttgtataaggtaaattcactactgttgattttttttgtgtttttttaggacaagaagttgaatactttgtggcaggtacacatccatacccaccaggacctggttagtgagctgttatatattgaaaatgtcttaaaaatgtcacatatattttcactaacgagccaataatgagattcttgttgcctataaaatgcaagataagctcagtagccaagcatccatgcatagctttgtaggtaataatgaatactcatatgccttcattcagcaaacattcttaag

SEQ ID NO: 113630 - DNA, 1383 bp, Homo sapiens
tcagtgaccaatgcagattccaaaacgtagtgtgctacgatatgtaatgtggggtttattaatttgttttcaggcccttattatgtgtgataatgttgtgtggggcttaatgggcagtaagacatcattgcaacctgcattcagggagcataaattgaattctatagataaaagcaaacacagtatggagccttatctgcaaataaactatataatagtgtttttagggaatgatctgaatcctaaagcaggtgaatatggaacttgaaggaagagactggcttttttttttgccaaggattttgctccaagtcatattcctaagccaactcatatttgacttaaaagatcacaggtaaaatctaaaattgattttttttccttgaactttttgcttttttatctattttttttttttttggatgttgactgtgttggtatttagagagcctcttcctttgggaagttacattactgtactggaatatgttttgcttcagcaataaatatgacaatatagccttttggtcttatgctttatcaacatagcttatataacaggaaaaaaatatatttcctccttgaaataaaaaaaattggtagtgcaccctaaaatatatctgtactttagtagcattttgcacactaagttatactttgttggcaattagattgttgaaaatgtgtgaaaagtttcagctgatcaaagtttcagcctttggttcatcatacaaatgtgcttcttagtttaataatctgaagcacatgcatattaagtagagaaaactaattgcagtaaatcctggaaacaatctggatgtttcaataatgtcacattgttttttctgaatttacttgtaacactgttacataagggttttgtttttacattgttttaagtcttgttggcctctgtttctctgatgattattaataactatatgatttaattagattttatatttatatgtcatgtcaaggctcttgagtgcattttatacatttttctacttgaacaatgtctatagatataatgaaatatacatatgctgtatagttattctttctagaaatttgtattgtgataggaaataactaatttatatacttcagcgataatggaggatcactctttgcttttaaacattggatatatccattccagtaagtggaatataactatttttaatgtgaccaaagtcattttaatgtgtatgtgttccagcatttttgtttctttttcattttacagtaagtggttcttaaacataaatggaaatctttcatattccatgaagttgatccacaacctttgatgagtgccaatcgtatatagatagttgttggtttggtgcaaataaaattaaaagcctagcattataa

SEQ ID NO: 113631 - DNA, 1058 bp, Homo sapiens
ggccaatgtcatcatcagacaagttagcaaggcataccgagactttcttaatgaacataagaaaaccagataagcagaagctgaggtctagctctgagataatactatcagtctccatgagttattttgataagaggctatctttaacttagaccttttctctgcatgggctggtaaaactcttccatcgacagctctgttactatgtcagtatttctaggactgtgtttgttgaggcaggtcagaagctgcattttcaaactcccaaaacctgacccatgtttgtgttgggtgctagtgctctgagctgagaccttagcagggaatttcccaaaggctaagttctccaattcccttttagcctccttcatggtacttttactctggtcctgcccccaccatccaacatcctgggctcagggccaggcttagcatcaggtttcagatgtacgttgcctataaaaatgtctctgaattggcaataattagtctgtgcaactgtatttagctctaaaatactatgtgtgctgagggattgctcttactggaaataggcctgtggagatagattgggaatgacataaatattctcaatgaatggaaaagcatatctagaaatatttcttttactctttccttatcaaagcttttaaaatgactgaactctgatcttgggttccgaagtgtctctggggaaggtcatttgaatctgctgtattgtcaggctgtctaacatctgcaaggtgattctcaacctggactcttggaaattagcatcagtgttttttggttatcacaatgacaagggagtaatacaagcatttagtggtgatatggtttggatctttatcacctctaaaactcatgttgaaatgtaatccccagtgttggaggtaggacctggtgggagatattttggtcatgagggtggatcctccatgaatatgttggtactgtcttcctgataatgactgaattcttgttctgagtttatatgagatcctggttgttaaaaaatgtagcgcctctcccactttgctcttgcccttgctacctga

SEQ ID NO: 113632 - DNA, 1054 bp, Homo sapiens
gtctggattatctttctggaacaattataccgaaacaagctatttgagtttcgacttggcaaggcaagatatgtcagtggattctctttgtgaatggaaaaaaaaagcatccttattttgtatagaggccgcctctttttgtaactaattttttattggtaaaaattaattcaaatgtgcttaaaattatgttgagagaaagaagatagacataaaaatacttaatgcatattatatgaagtctaagaacaggcaaaactgatctattgaaatagaaatcagaaggtggctgcctccaagtgaaggtctgttggctggaaaagggtacaggaaatttctggattggggatatgttttatatcttgttttgagtatcaattacatagatttatacaattatcaaaactcattgaaataaacataggatgtatgcattttattttatataaattgtatatcagtgttccaagtgttaaggcagttgaataacacttagtgtaaaacttatattctgaaattggctctgtatcattccttaagaagggatctgaagtacagatcccagtctgaggaagaaacagtgggattgaagagctaaggatgttaattgggaagaaaaactaggggtgggcaaataagtatatgctaggaatgttaactaatttattaatatattttctgaaaattagaatttctactttttatttcctatgatacgaaaattatatgttacaatagatctgaggaaaacatgattgtacttttaggttcatcccactaagcattttcagcttacatttcattcattgaagtttggtttgtattgtattttccaaccagctagatgtcttcctgaatatatttagattcttagtgattttagtaaaaaattttatttttgaaatgcttgtaaaatcttacaaacttctgaaaccttttgtttcctaatctttgttatttgtgaaggatttttttcctttggatttatgctacatgaataaagtcatcaacttttaattttgtatttaatttagtctccttgaaaatatgcagt

SEQ ID NO: 113633 - DNA, 2467 bp, Homo sapiens
acaaaacaaaacaaaacaaaaaaacagaaagatgccttgtattagggccttcctaaaaagaaagctaagtaagtattaatttcttaggattgcttctgaggtaggatgaggtgtttgcatagacccaacaagtcattcacttcaaattttttttgtcttactatgataaataacatattatttcctgtttacagcaacctgcactgaaattaactagttgaataaaatcacctcttctagcacaaataaagctgagttcggggaggtgggtgaaaatacagtactgttgtttacttcctaagatccaagggagagaatcaagcttggtaatattctcttgaatatacatttacctatttaaaaggtatgattttcccatatttccttaggaagtatgtcatgtcaatatagatatttactcattaggtttacattaatttgtattataagggaatgtttaattcaaattaaggacattaaaagtatatagactttcatataaaagttccggttttataaattgcgttgatcacttaaagaatgcagagatctcaaagtaaagaaaacaaattttatgaatattttaaaacattacttaaaacaagtttccttagaaagcacatttgtggataaatttaaatattaatactaaataataaagtagtatacagaatttaaatttcataataatgaagaaagtggtaatgctatttaacttaaaagatgcaatatggcattttagatcaagaggttaaagttttcttaatgaaagaaagtaacgatttatgggataaaaatattccagtggtttgtatttgcttcatacttcaaaagtgttagtccatttattgtttaaagttatattgaaactgatattttcactgctgccaaagcagtacctgacagtagataggtatccacagtcttatgttccttagagttatagaactatgcctctgaaaggggttttaatactttaataaacctggcctaaactgttttatttctaagttgaagaaactgattgtcaagtactttgacttgtccaatctcatacaactaactatggtacatctagagttagatctcagtatcaggggtcccagttgtattctgctcaccattccacaatttcgatattgataaaactttcacactaacttttgaactgtggttattattaatttagttgattcatgtcctcttatttatctccttactcctccactgctgccttcataactgtccaccagatcaaagctatttgggtacctacactttaaagtgaggggaaataatgaagtttcttaaatcctgtgtcatggactaagatacaataaagaaaaggaatttcacaaagtaggggaaattacgtgttagttataatcattcccaagaataaactagtaaaagaaacttagatttccctaatttaatcttgactccgattttgatagtgctatataaaaaggtatttaaacccatatgcttccttttacataaaagaaagatatcaactttcctagtttgcatttacactggctaataggataataaaatgctgtgtaaatgttaaactggaagtttctctgagttatttttactttaaaatttcatgtgattatgccattttgaatatgtatattacatgtaattgtataatgttaactcgggtaggcaaaattcttggtattaaatttaggatgttttaaaaattattaagaagatattaatgtctgctttttgatagcatatattttcatgtaatgtttagtgtattaaaatcaaccattcaagatttattttattgggtgacactattgactgtgttccaaaatgcccatagtgttaggaaatgtggtgtgagttttatttgtgggctaaggataaaataatcatatgctaatataccttttattataaatgactaaaaatttggatataaaactgatgttttactacacaaattacagagagagataatataattatataattattaaataattagaaaatgcaaataagcaaaagtcacccatgttcccagttctcatctcctgaagatagttataactaacatattattttgtactcttcctgttaattagtttctagtgtactttctcctgtagctgaaattaagctgagaaaaaaggaagagatagttcctccctcctctttctctctcccactctgtctctctcctgtgctatctgtgtgtatatacaaatatgtatgcatatatatataatgatgtacataatatatataaaatacaaatactaatgtgcatattttcaaacatacacatattttttattatttgaaataagaatgagtcagactacatatttggtagccagatttttttcactcagtgatatatcatgaacatatttccatgctaatataattttctaataattttagatgctgtaactacaatttcattgttaatgggcaattt

SEQ ID NO: 113634 - DNA, 1039 bp, Homo sapiens
tcccactctcagagccctcaccactactgtttgcaagcaaagctcttccccgatatttatcacgagtggcttctcttatccatcatgtcacacttcaaagggactttccctgagtccattttttgttgaaagtaaatactcttttttattccttctcatagttttaaaacatgtttcagagaaattcacacaatttggaattatctgttgtttattttctttgtttctgtccattttgaaagttccctgggggacagggaccatatctgtgtgttgggattttaaaaaattatttttatttgcaaatgacacataaaaagtgcacatatttatggaatacagtgtgatgtttccatctacattgtatacattgtgtaacaatcagaaatgactcacaaaggtaggcaaaatgtttgatgcaaagatatcattaatatttattataggaaagtacacaaattactaaaaattaaaggcaaataccatacatttaaatgggccaaataattgagcagaaaatttacaaaaggctaaagaaatgtttgaaaatgtgctcaagttcaataataaagaaacatgaggcagaatttttaactatttgtaaaaaatttgaagtatctcatactgtcatgacatattgaaactttgcacccagtaaacttacttctgagaatttgttctcacgaagtcaccaccaacttataacagttactatatttgagttataattataggtctttttttctattttatacaattcttttttaatgttttcacttttaaagtttaaaaaattaagtgatattagtacttgcaaattgacaatgtttactaatttttttcttgtttccattttttgtttgtttgtttttttgagacagggtctcactctgttgcccaggctggagtgcagtggtgcaatctcggctcactgcaacctccacctcccaggctcaagcaatcctcccatctcagcctcctaagtaggtgggactataggcatgcaccgccacacctggctaatttttgtgttgttttg

SEQ ID NO: 113635 - DNA, 1010 bp, Homo sapiens
ctttatgttttgatactattcaaaattaagatttaaaccaaaaatctgcatcttactgcatggcttggccaatttgccttactctaacttactttataagcccataactttactgatttttttttcaaatattttattatgaaaattttactataccacttagcctattacagtttattttgatataatttgtttagtacactttcaaaaataatagttgacatctttctcattaataggtcaatatgtgataaatgtttttagaaaaggacgttttaaaaccaatgaataattcagataacattctttgtaaattatctaagccattctaaataaattacctactttgaaagttaatttctaagtataatgaatatcagaggactaaagataaatgtatatgtgtatatttatatctagccatatttgtgtctatgtatatatacatatatatgtatatcactctattattttttccactgtagaaaaaagctgctaaaagagaagaagcattagcatcatttgaggcctggaaggctatgaaagaaaaggaagcaaagaaaatagctgccaaaaagaggcttgaagaaaaaaacaagaagaaaactgaagaagaaaatgctgcaagaaaaggagaagcactacaagtattcagaactttgcacatcttaattattttaaaacatttgaaatccaaattaatgattaaccatatttttatttattttcaaatattcacagtaagaaaattattctgaactttttcaggcttttgaaaaatggaaagagaaaaagatggaatatcttaaagagaaaaatagaaaggagagagaatatgaaagagcaaagaaacagaaagaggaggaaactgttgccgagaaaaagaaagataatttaactgctgttgagaaatggtaatccaaaatcataaatattttgatatattttaaattatagtaacacttcaggattttataaaatttatttacttgaaatttagtaatgcattt

SEQ ID NO: 113636 - DNA, 1099 bp, Homo sapiens
tgattatatgttgtatatatatatgattatatatacatatatatacacatatataatcatatatacatatatatgtatacatatatactacattacatatgtagtatatatataatcagtgtacatatatactatgtacatatgtacagtatacatatatactatgtatacatcatatatgtataatcagtatacatatatactacattatatatgtagtatataaaaacattttataccttagtagatttttgccttttgctcacattgattaggctacagaatattttagagcaaaggcgaagaactttttctcctggaagctgccaagggtggtgttcaattttgaacacggcacaaccagaaaacaaattgaatttttgtttttcttctgttaactaaaactctttattgactaccagaaatgattattcattgcaatttaacaagtatttgtgttcctcttgtgtgccacaaaatttgcctaggtactgtgagtgtaaagatgaaacagataagattactattcttgttgaggctcagtctagtcattgttttttaaacagaatagaacatatcagagtgggacaccgtaagggaaagaatgatttgatgaagttatttcacatactgtgtgtgtatatacatgtacaaaatgtttcttattgtaggtcttgttcaaaaaagtttgatagccattactctagtgcggtggttttcaattgaggtgattttgtccttcagaggatatttgacaatgtctagagatatttttgattgtcacagcttggagggtgctactggcatctagtggggtggagagtgggatgctgctgaccattctactatgcacaggacagcccccacagcaaagaatgattctgctcaaactgtcaattttgagaaactgctgctgttaagaaactgattctagtggaagagacaggcacgtaaacacatgaaagagaatagggacgggaattagagggaaggtggaaggtgagcttggtaaggagagggaaagcgggggaaccacagttactgactcaccagctctactgggcactgtcctgagtggggaaataattttatcatatgt

SEQ ID NO: 113637 - DNA, 1359 bp, Homo sapiens
agaaatactttacacagagaactatagccaagtcccccaaaaccagatgagctacccaagaatagctgaaagagcacactcacctacatggcaaaatagtgggaagattcatgagtagcggtgacaagcctaccaagcctggtgatagctggttgtccaagatagaatcttagttcaactttaaacttacccacagaattacttaatttcccagtaagtttaactgtcagtctaaagagggacagctctttagaccctaggaaacaaccttcctacagagagtaaaaaatattaccaccatagttggcccaaaagcaaccaccaattaagaaagcatttaagctcaacatctaactatcttaaattctaatcactctactgaactcctaacatcacattggactaatctattatttaatagaagcaataatgtcaatataagtaacatgaagacattctccattgcataagcttacatcaggccagaataacccactgacagttaacagcctaatattaataaacgatataataagcaccctattatttacactgttaactcaacaaaggcatgctctaaggaaagtttacaaaaagtaaaaggaactcagcaaatcttaccctgcctgtttaccaaaaacatcacctctagcattaccagtattagaggcactgcctacccagtgacatatgttcaactgccacggtatcctgaccgtgcaaaggtagcataatcacttgttccctaaatagggacttgtacgaattgctacacgagggttcagctgtctcttacttttaatcagtgaaattgacctatctgtgaagaggtggatataaaaaaataagacgagaagaccctatggagctttaattcattaatacaaataaaaactcaaacaagccaacaggccctagcctactatccctgcattaaaaatgttgtttggggtgaccccggagcatacttcaacctccaaacaacgtaaactaagacctcactagtctaagcgagttaacatacattgattcaattaatttgatgaacggaataagttatcctagggataacagcacaatcctattctagagtccatatcaacaataaggtttacgacctcgatgttggatcaggacatcctaatggtgtagctgctattaagggttcgtttgttcaatgattaaagtcctacctgatctgaggtcagactggagtaatccagtttggtttctatctatttaacatttctcctagtacaaaaggacaaaatagggcccacttcataaagcaccctcgcctcataaatgatgctatctcaatctaacaaaccatcacacaccctacccaggaacagggtt

SEQ ID NO: 113638 - DNA, 1054 bp, Homo sapiens
cctaataagtgtaagttggtgattttcatttttaagattgctttctggagaaattatatgaattttacaatctcacaagctttgttttttctgtgtttaaatttacgttgacaattaacctgccatttcttcagccgtcctttgtcttggttccatatatccattcatctctctacttacagccacattcattctactcttaataaactgtctgcagaagggtgagatctgatgagttagaatttgacaagtggttatgctgttaagccttgcagaatgttttgaattatcattgtgtactcctaaattacacccctccctccatgcaccccctccaccccccacactttgctaacagggtgcaatccatcaatcttatctgtgtaacagattaatgaaagcctaaagcaagaaagtgtgcctcctggacagcagacttaaaagttcttgaggcctttgctcaggggcaagggtccctccaagcccctggatcatctctgatgcttttatttttctctttttgctctggatgaacttcatgtcagcacactctgttccccagaggcaacggtctcattgattagaaacctacctctgcaaaattccactttagattccactggccacaatgatttctttgtaatagtaaaaataatattaactactagtttatagtagacaattaactttctgcattgaggtttgtcaggagtgcctagcacaatgccattcacattgtagctgctcattaagatttcatagaaattcagccatttcatcttagagttgtccaaaacccacagggagctatactaccttcctatttattatatgtcacctttgttcctctcacacaacagagataattcataaaccggaacgcagtagactcacaggaatgacaccagatattctgctgtcctaatatattacgctatattaccaaagacacattcttgcattagctaaataattgccctggttttctttttaggggaggcagtgaggagtgggaattagtgggacatccactgaagttaaagaattgagtgca

SEQ ID NO: 113639 - DNA, 1022 bp, Homo sapiens
acaagcttatgtgtctttccaatccttcaaatttttttaacttccaaaatctgaaattgaagattctgaaccacctagattaggatttgaggtcaccaaaagactcaattttactatctccatctactggcaggtaggaactatatccaagcatctggactggcatagaaaagaggagaaagaacatttaaaaggtaagcaaaacgtatatttttatttactctgagtttttaagcttttcttatcagaaactgttgtactttcatgtaattaagcttgatacaatgaaccatattagagcaagagaatttgtttaggtagtacaatactcttatctgattcttcaacatgagcaagtgtgaatgtgaatgccttcctttcataatgggagtactttctgtctttgcacttagtaagtttccatgtagtcattccaatgccctcttactgttttcactcatactcctaataatctttaaaccgcaaaaatgtctacattcccacttctgtatattctctgacatgttagagatagttttacctggcaaattatttttattaccatcatttagaaagagtagaagtatgtttctcaaagttgaatttattattctgttgtttcttatattttttcattgtctgtttataattattttaattgggcagaaagaactaaataagtttcctgttaattgaccagtaataattacatcagttctttttaaaattgatactttgcttttccctcaaaaatcttgaaatttccttggtttacttttcactatgatcaaaagttgcagtatgataactgctataaaaaatgctttgagggtttatgtggttgtgcagtaatagatctttaagtttaaatcatatattttaaatagtttcatattttaagtcttacattatgcattatgcatatctttctttaaaaagccatatctacacttgagaaaagaagtaaaagacatttgtcaagataattagtattattactattgctgcaattaaataagtat

SEQ ID NO: 113640 - DNA, 1087 bp, Homo sapiens
gaggttttcttttgttgttgttgtttgctctttagtttattaatttgttttccttaaaatttgccattgctttattgggaatcaataaaaccatagatttattaggaaaactatttgagaaatagcctttagcgttatctagtaagcagtagtacagaagtataagcatgctgtcaatacatcttcaggttcacttttatctttctgtgtgcaaaacatgactgggattctaatgtttgtttacaagaatacttaaatatgatacactgtcctgtaacacttataagtcatccatagactcaatttaatctggaataatgtttttaaaatagtttttaattaagctcaacaataaagtacttatatagtatattctaagcaatatagtcttcttaataaattatattcccaggtgtgtctcgactaatttgcatttgaaataaaatattttaggcacattttctatttagtttatgtataaaaatatgtacatattgagcaaaaattgttgaaggctttaaaataagccgagattgataatagataaggtcttttacacatgacccatttatgcctggcgtatttcttcacccattttaactttttgattgtatgtgcatcatttcttatcttcagtcaaatttggaaatcaaaatctcagaataatgctttaattttttggttagactcactgggtccttataattgctagttttctcgatctgcagtctttgccagggggggaaaaataaatctaatcccttttaggcctgtttatctataaattctctagttttgttccagttcctgccattcatttctgttttagtgctaatattttcaaggagtttcttgcgcacttcccattataagctgattaaaacccctgtcttggcatctactaatagaagttgcagctgctcctataaactgagcagttaataggaaggaatacgaaggattatagccttttccttttcacattgtttttcctgcaccagactctatataaaaagctcctgcttgtgaagaatcattttgtttgcccataggattttctctctgcattaacttttagtgttttgaa

SEQ ID NO: 113641 - DNA, 1044 bp, Homo sapiens
taatggtttagataaactcctatccaggttttctttaaggtacactgagagaaagagaaagagaaagaaatctcagatcatcaaagatatccttaataaagttaagaaaacacactaagactgctgtagttcaatgatgtatagtagtaaatggtcactggcggtattctagttaatttgttttcttctgcatattgttaagtgggcagtgtaattaatcaaagcaatcaatcaatactaacttaatttgtattttttaggtatttccaaaataatctaacataaaccttgcctcaaatgtattattcttggggtaaagtaagtatgaaagagaatgcaatgtagcaggctgtgatgagttgtacactaagagtctaaaaatcacctgggttcatttttagtttcagtacccaaaacccaatgactttaatccaatgactttaatacaatctttccattgagtataatcaaatatgtttcatatgtaaacagagttggacctagtgatttctaaaaaattcttaactgtgcaatattatgaaataatagaaaaatataacactatagaaaagcactcagtttagactaatataaagacagaatcagaaaagtgcttagaaatggtactacagctagggcagggttgacttcaagtgagagttactcagtggcattttcttttttttttttttttggagacagaatcttgctctgtcgctcaggctggattgcagtggcgtgattttggctcactgcaagctccgcctcccaggttcacaccattctcctgcctcagcctcccaagtagctgggactacaggtgtctgccaccatgtccggctaattttttgtatttttagtagagacggggtttcaccttgttagccaggatggtctcgatctcctgaccttatgatctgcctgccttggcctcccaaagtgctgggattacaggcgtgagccaccatgcccagcctgagtgacattttctaagttaaatttttgaatctgaaagatgcaggtgtcaaataatacagtcacaac

SEQ ID NO: 113642 - DNA, 1028 bp, Homo sapiens
gattccattcatggaggaaaccagttggctgctgttggagattgggcaaccgacaagattagaaaaaaaaccaaaaccaaaacaatgcctgttagcttcagatctccttttagttttggagtttgctgtattaaactgttccattacactttgtagaattgtgtggagtggagttctgttgatctaagagcttaatacccatgacaaaaaggttcaagttttgtatgtgaactcctacttacagtattgtcatcatagacatgaagaatgttaagaaacgcagtatggcaattaagagcactaaccttgaaggtgacccaaattggaatcccagttttaattcttggccaaatattttaactgtactaattcaaagttttcctgcatgtgtcatggcaataatttctgttctttttcattaaccttgggaaattattaatatgaagattacgtgacatcttatttttgtatgtatcctagaaagtataaaatgtgatatgaattaagttggtattaatagaaaggtataatgttcagggaaaatatcagacctgtatgtgagattttgtaatcaccactgggtatttgagtagaagaaaacatgagaaaaaaataataatgtgcatagtgttaagaaatcatggctgagaagaaggtaggcctctgtctgggcaagaaaactaggtttttgaagataatagctttgagtgaaaaatgagagatttgtaatcatccagaataatggtgtctgaattcttcagcacgtggtagtagacacacgacgtgtttgttgtctcagaattctgagggcaattcacaaagaaattgttacaaaccatgaatcattacacaacattagaatacctcaaaagagtgagtaactcaaagctcttaacagatcttgagaaacttgaaataataggcatgtttttcttgggtgagcaatctctctaattatgtgagagttgtgtgtgccctttcctgctccaccatattatgaatgtttagtgtagagaattactgaaggt

SEQ ID NO: 113643 - DNA, 1032 bp, Homo sapiens
tgggttcctgtgcctgaatggctgaataacttcctaccctctatcccctttagttgccatagtaacttgctgttcaaataacacagtggtatctgcacagtttcctctctattttcacctcttaatgcacttttaatgtgttatgtatgacttttctaaatatgtaactgaaattttgattgtccatcttaaatattgtgtcaactctttaagtaaaatttgcccagtttaaattgggattaaaggtgttctgggtatgttgaaagtcatagctatgatacagggctggaggaatccttgtcaggtggcatttctcttttcagtctaacctttaaagctgtgtcttgaccaggagcatgtaaaactcctatattcctaggtttttcagctgtaaagtcaagataccacacacctgtcagggttgttttgaagaataaatgggaatggacttatgaaagcatctagcactcttccagtcataggccagttactcataaacattggtggagagttgttaatcctcaaaaacttcctcaaaacaacagtgatttttatatctaaccttaggcattataattattaatttattttgaattaacctaataaggattaaattatactctatatgtttctgaattatgtatttggtaaagaggtacattatgtttgatgtgttgatcactttaattaatatttaattaaccagaattctttaatcctgatatcatttttattattcattttctttgtagtctgtaattaaaatgatataatcatttccagtcttacttaatttttttggagatttaactaaattaccttcttttgattcagtcaaatgaaagtggcttaagtattttttagcaccattaatgttaaatatgttaatcatgtttgcttttccagtaaatcaacactcagctactctcactgtaactttcctgttttggcatttcattcttaactgttcacttactctctctttttcctgtgtgacccgtgtctcatatttttgtttaaaaccacttatgt

SEQ ID NO: 113644 - DNA, 1038 bp, Homo sapiens
gggtacaccgaacttctgaaatattcttgtttttaaaatattcttacttgttttgaaaatttctgataacttcagaagtgctagtatgtaaaatgtgtgttatatgtcatctataacatatatacataaacatgcatatgtatagattataaatgtatatctctgtgtatacttacacaagtatctgatgaagcatcttttaatactgggtttcatctgttgcttttggtcactgacactttacataacaggcttgtaagcagagctaggatgtatttttgaggtgatgtatctacagtatattaaatgtgatatagtacatggcaattatgttgctttattgtttcagatctagaatgtaggtcttgcgtgtagatgtaagcccttgggtaacacagcataatctttctaatgtaattaaaataaagctgagcccttcaaactctagatagacttactttggtatctgggcaaatagtgtttctttgagaatgaagcagtgattagatgcagatattctgaatggttgacaggagagagaactagagacatattttctactccaggttgaactgcttgatagtttggaaaatgttgatcagaaatgtattttagacagaatgtgaagctttgaaatcacaggcttgggtatgcatcctggctctaacacttcaaactctgtgttatttgggttaactttattaatctccttgagtcatgatttcagtttacgcattgcacattatgggcaactatctcatctttgagaaaaaaataaacataaatgattataaattggcacatataatacaaaagtgatattatggtcactatgaggctttttttgagaattgagtaaagtcatgaatataaaacatcaaaaacagtgtctgtcatataagggacattcaaaatatggtgtcattattcagtaggtgctctcagattgccaaacttttatttgctaaggaattatgattaattcattcaatagagcttgaaggttatatttgaaattagtatttatttctcaatcta

SEQ ID NO: 113645 - DNA, 1071 bp, Homo sapiens
aagcagggtatttttcttactttagtatgtccaataactaaaagagtgccttctatattacaggtgttcaagaaatgattgatgaataagtgggtaaatgattttacacagaataaaaggacctgatttcaagaatacaaattgtaggttgaaactattcggctgcccacgaataaacacttgactgtgtgctattgaaattttaacttttatatggagcgctttgcagagagcaaaaattgttagctattcgtttggccaacatattgagtggcttctctgtggattttaggctaggctgcttggctggtgtggcatattaagcagggctttaaatgaataaagaataatattttaactgatgtagcttgttagaagaggggccatttcttctcaggaatagacatcagcaattcccagtggcagtcttttttactatttccttccccaccacacacagctgtcttcccactggtggctctgttcccccaaaccccaatatccctgtttactgcttttctgtcttctttttcagcactatgagctgcataagtgcaagaatggattttttttttccatctctttgtccccagttcgttacatgtattagtaaatgatgaatagatattttctcactgatatgatcttttgtctcttggtgtgtgagtttacctgttgcatcatcatccagttttgggaattttataggttatttttatgagcaactagtagcaaatgttggtcactctaatgatactgaatagaatttagaaaaagaatatttgctttcatatttcattttaaaagatggcttgatgaaaatggcttagagttttctttgaaactgcttctttctttacaaattaatcgccttctacaacatttcctttagttttagtaattagaattgttttgaagtaattagtaaccacatccagtcctagttttctatatctattcattgaatacaattgaatagtggggctattttctctttattgtttttgagctagttctcttaagctatttctcttaaggctcaaaggctggagatgtgaacgatgagaaaga

SEQ ID NO: 113646 - DNA, 1115 bp, Homo sapiens
tttttcagcacacaccttgcttttttcactcagactcatctgtccatatgcgtgcagtgctgtctacgtggatgttcccttagtgcttcaagtttgacatgttcaaaactgatcttatttctcagctcttaaatttggttctggtcatgaattccattgcatagagcataatatttttcatcaaattgttcacatcagaaacctgagtccctcttcttcgttcctattttcaaatgttttccaagatctgtttttgctgcttcgttgacataccttaggcattcctttcagtcccctctgctgcttagttcaaggcaatacgatagtattcctgattactgcagtaatctctaatttgtcattcttcttccattcgtctactccatcccatccatcaacaatggtgtccgacatgtcagtcttttaaaatttcttcacagctctgctttgcgtttggataaattcaagttcctttgcaagacttttcaaatatttcctctttttccaattgccttttcctgattcttctctagtgtttcttctatcctacactcttcatctacctcatgatctaaatacatggagaagaacagaaagctgagtgctgggattggtaggttccagagaaagggtaaaaaactgttgttgttgtattttttaagacaaagtaatcatttattaaaccaactaattgtattagttcttccctctcctttggttaggaatgagttgagaggtggaggccaagggggagagagacctgaaatgtggtagaaattctcctctgagagtttccatttctcccaattttgatccattcttgagatgcagtcaaggtttgaagtttgaatactctctaggggaacaaggtcctcctcatagtacctgaagaaagatactttttgaaactcattctattacgacgttgggtggatactgatttcactaaaagacagatccaactgtgatgggaagtcacagagctagcaagtagcaaggtgtttttagtattttctgacaccaaccaaagagagtgcttatttatattttaatattaatctccaatgaccataacaggaagaggaaagatactgatttgtaattacaacttcaca

SEQ ID NO: 113647 - DNA, 2613 bp, Homo sapiens
cagttcgaaataagtcaccgagggctgactgagaaggtgactttgagcacagatcttgcagagatggcagagaaggccttcacagacagggccaaggggagaggcaaatgccctgggtcagaatgtgcctagcaagattgaggatcagcaagggggattgtgttctggagggggtcatgtagatgagtgatgaattttatatagagatgattatttctgccgagtgagaatacactgtaggggagcaagggagcaaatgccgtgatagtgacttaggccagagcaaagtaggtaagtggtcaggttttggatttattctgaaatgagagctgttggtatttgctggcggactggaaattgggagttgagatggattgtcaggcgccagcctgaaggtgccacctgtgggacttggcaggcatttttgtcttcacatgcagtttttgtcttgaaaatcttcaagctacttgttaattgccctagcgtgctaacagtggacacatgaattgattgtgatggtgaaagtatgtaagagacacacattggtgatggattttatttttcatttttaatcatgataagaagtcagtgcatgtgagtagatcaatagaagagaaagaagcaaacattgcattgatttggaagcatataaataatgcctagtggaagacaggccctttttttatttacagaggaagatgtgccagaataaagaattccatttagtgataaatatagctaagacatactcagtgtttaccatctactagacatgcatgtaagctcttaacacatattgatacctttaatgatcacagaagacatttgagtgaaattactagcattaatcccaatctaagaagaatttaagccacaagccaaggtcatgtggttttcagcaagggcagtctggctccatggcacatgcctttaatcgttacagtgcctctaatagccactttaatttgttagaactaaagctctaatttggctaggtgctaagcagacttgctcaatttacagtttcatttcttaaatgtagacaagtcaacgagagttcttaaataccttggagtttattcttactaacacaacatatttgttttaagggaaagcctggacgtttgggatgaggaaaatccacagtggaagaaaaggcagagtgtgaaaatatggcttagtgaaattaggtttaaattctggtttattcactttttagttacatgatcttgacttcaccacttaacccttctgagcacttaattctctaatttgtaaaatgttaacattaagaactagttcacagggacttctggcaacatgcttggtctgcttaatagattttagtttctctgcccatcttcttggctagatagactgaaaatgaatgtaggggtttctgaaaacaaattgggtcgagtgaaaaaaaaaggtttgatgcagggaggccaataaaacactccaatgtagctccacaggagaacatttaaagcaagaggttttgtgcacttatagtggtgcttgtcagagttgaaagtgcatttgaatcctcccggatcttgttaaaatgcagattctacatcagtaggcttgcgggtggggcctgagattctgcatttctaataatttgatgtgatgctgatcctgctggcctgtgcaccacacttttactagcaaggacatatgaaaatagatttatgaagaagtaccatgggaatttagagcgaataatatcaaggttgataccagtaaaacagtttaacagagcttctcagagatgaaatgagctacatcataggtattaattccctgcctaaggctgtatttgcgtcatttctgatctgtgctgttgatatattgatacaccggggggttgagccagacttgaattttctgttactcattggtaggggttacccttaaatagaagtgagtagagcatttaagcattattagttacataggttcctgggctatagggcaccaagcacagattttttcgagggaattcactcactgaaaagataatcagattaaatgactactaatgctcattttaaccttgggataggacgttaagtcacacatactctagccgagagggataatctgagatctgtatggtatctgtctaacacatattactaagcagaaatctcagaattccttaaaggttttaagaggaaattattcattgtattcataatcattcatatccatttgattgctctctaatcacaatattgcaattatacataattatatattgtaattatacatgttgttacaatataattataattatacatatataattacaatataataatattataattatataatatacatgtatattatatacatctattcctttagtgtattggtagcagtattttttttgtctgttttaggtcttggtgatttgtgctcttactgtttctcagaatttttcaaaatttagcctgtaagttactaagaaatgtaaatggatagggcatggttattgacacaaatacattcttcttttcccctcaattttcatacagctgtagtgttactagaaaaaagtatctatttatgggaagtgtttttctcttctcctgtggaatc

SEQ ID NO: 113648 - DNA, 1047 bp, Homo sapiens
cagattacttagggtgtttaaatcctgtacagattagtaaacaataccaaggaaatttacttggtgttactagaaggttgaggaaggttactggcttttgcagtccattagtagatcaatttgttaaatgtttagtgctaggaatctcatttatcaggaaatatcttaggcattggggagaattggcctgtggtatttacattttagtctagttgccaaaattgattttcacgttttgtgtgtgacttagctctttgtactgcagtagataccaggttaaagcatagttcatatcttaaaacattaatagattttgtttcagtgctgccaataatttcagtgagtaacaaaaaaactccacactttcattaaaatgttcttaatgatttctgtttgattttctacgtagtgataaatgttgccatttaccccagcggtttaataacaacaaataagtattacattttgaagaaacttggcagtatcattgaatgccagtgtgtaatagctaatctataatttaggttaattccatcattagtttgtgacttgaaattctttgtttctgactgtttcatgacttctttaagcacaaagaggatattggtagaatcaggtatgtagcaaaaggtctagaaatacagttttgattatttgaaacactagtattttaaaatccagcagatgcattcctttgcctaaatatattgtgtcttatgctataaagaggacacattttgttttgttttagtgtacatattaaaacagtttatatcccaaataagctaatatgactaatggttgtcactgccctaattttggggaagaaagtttgaatcagaaaagtgttcttggaagaagaatactcttttttcctatctatttaggcattcactggaactttctttacttctaaaatttatgcttgaaatggctcagagtttgtgtatgtggagcatattggaggctgattgtatctgtgagtttaggaaagacttaacttgatcccttgtgcaatgaagtctttcaaagaaaacgagggttttt

SEQ ID NO: 113649 - DNA, 1054 bp, Homo sapiens
attatagagaagagcatgaccatcgcaagttcattttcagtaactttgacgtattttttgttttgaattatttccccttttgctctttctagttaacataagatataactcatgtgctttcttatttttagtttgtttttctcttttgctttgaggttttgagattgacaactgtgatttatcccagagaaggcaaaaatcttgaaaaagtcagtcttttaaaaagtcactcaaagaatatagttttttttcccttggaaataaagttgattttctcagctctgatcctatgagattatgggcagaactaaatagtccttagttctggcatgtggacaaaacagaagcagaccctggagagagagttcaaaattcatgacagtaagcacatgttcggtatgccaatatttatggtgtcacaaccaaattgaaaccataaccctctgctatttacgtaagtatggtgcccagactgcacaaggttatgcctatgtttcccagtaaatttaaggcaatagaaatgttcagtacccctagagaccagactatttattttcatgttcattttgtttctctatatgaggcagagtgaattgtcttaatttatattcatatttgaagtcagccagaatgagaaggaatggcatttagtgaggatagagaatggttttgtgctttcatatgtaatgtatccaggccattgtgtcctggtattcttagtttctgagctggggtgagttgggggtattgattattgatagtgaacatagactgcttcttagatgggtaaagctcaatgttcgtatcttacgtcttatgctcttagagaacctgggtttcaccactttggtcaaaaacagacacacatactgttggtaagaagtcatgttttatgtctttttatagaaactttgaaagtattatcattctaaagtatttatcgtccggtaaaattttaagaacaatgaagtttcagaaccactattgagagtacatctttttttctctactttttcaagacaaagatatctagtaacttaaattatagtaacat

SEQ ID NO: 113650 - DNA, 1207 bp, Homo sapiens
gtagcaaaaactcagaggtgcaaatcttctggaagaagtgtaaatgccacaagtttacttggaaaaatggaaaaataggacttatttaatgtatctgccgaacatttaaaactgcataaagcactggaaatacttttggtatgtaggaatgtgtggtgtttcaaaactacaaacattgttctgaaaatttccccggtagtggtgaattatatgagaccacgtccatctaaggaaggcttgtttaactagcctgtggttctggggctcattcaaacactcttaaacaaaataaagggaatggatgtaataacttctttatggaaaggccataaaaagctacagggccatgtaaacaaattgggtcatttactagatgtttaagtgatagatttgcagtccaaatttaggggtgtgtattatgttttataggatggtgaccatgttctaccttgagaatgaggttgcaagcttattttttgtttatttgtttgttttcgtttagtgcgtggaaatccattattgctattttgtattgcacttggaaagcatacctaaaattctgggcaattgcatttataaagcttttcaactttgaaaaatggctagaaactcaggtatgaagattgaattgatctgatttctggtatcattaggttcttttcaaggaaaataagatgattgaaatagaaattttccttctgggctcagacatgtctaaactaattgtaaaataattgttctggcttacaagagtagactcataactacaactatgtaaagtaaaaaatctaacaacagttaggatttatagttactgtcactctgccagtcttgtaataaaactgctattataaccaccctagtgtgagattcatttgtcttacttgagaagtgggcaataagtcctatccaagttatcttgcttttagcagagccactttattgcattaggatattaatttaccttctctgaaattgggtatgatgattgtgccaaaatggttcagtaaaggggagttgggtgggtggatgtataaaaatatgttgtgctgcgcattaatggtgatgactagtggcaatgggagctagaaataaacttggaaattgaagtaagcacaggaaacgaaataatttttatgttgataccataacatttattcattctgtaacttctgtcaaacatggttggctcatttggccttaaagg

SEQ ID NO: 113651 - DNA, 2005 bp, Homo sapiens
cactgaaaggtgtttagaaagtacagaggtttgtaggaagcctcagggactaatatatcgtttgttaaatagttgtaaatagaggatgggattggacattaaacttccctcagtgctgccatctcttctacgacctctagttctgtctcaggcacggaagccttagctttgtctacttgtatttcacccttcctgaaacttatttcttaaatatcttctgtatattagcttccacttcatgtttttttcaagctttagactgataaggttctaagttttatctataaacttttgcaccctttgtggaaacaaaattctaatgataaagtgatatgttgaataagtaataacaaattaagacattcataaatttcatagtaaaaaaaaaaagtttccaagactgatgatattttccccgtaggtttctgtttgtatcaaccaaaatggtagaagtcataaagtcccttcatttacttactctgattttcatgtttctaatttggaagcattatacgtaatcagaatatataactctgtgtaactctatgtaatctctatataactcatttattaagcaatctctgttgcttcttgatcttttgggtaagatcagttgtaaacaatctgtatgttgtattatttttcaccaccactgcctccaactatgattttatttttcaaatctcccattttttaaatctcctaaggagacatctaatatttgataatcatttagtatgcaccagtgttagttccatactgattaccaaaatgttgaaatgttgaaatatttccaatgagttgggaagagactagtgcaactcctctaagacaaatggaccaacacgtgatgaagcagaaattccaatgcctggtactgcttaaggcctctgagatacttctgcaaccctgctggcctctgtcctgatcgatcagtgttcctgccgtactgattgttaagcattttgacacttttagctgtggacaattttagttcatattggggttaaaatttctatcttttttcctctctgcttggcagctcaggcctgacccatgacttgaaggacctggagtaagaaggggtatggcttctttcaagctcccttcctgcagctcttttggctttagctcctcaagggttatggctgggggagtgatgagatggtggacatggcacactcagcatacaattgcaacttccagtcatttgcccctgcctctctggctaacactaaccagctgctcttgcatggataacaccttcccttcatctagattaaatgattcacttcctcagagaggtcttttttctgaccactaagtctaaattaaccacccctcactgtcttgtcaaggttaattaattaattatgtagtacttaatactccttgatattcttgtttattaattaattaatttattatctaccaacatccctcacccccaccataaaatctaagttgttgagagcgtggaccttgtttgaatcgcttcctgtaggaactccagcacctgagacaggtatggcagagtgtgcccgatgagtatctgttgaaaggttctggaggtagttagtatcttattaaagaaagactatgctgttaactctaacaacaggccatcttttaagatatctttttggtcttggagcttgcacactacttgacttcttaaataggaagatagcttgttcatgtattggtagtgatggttgtgccaatcagagtaccacgttttactcttgataaagattatgttaccaagtgagcaggtaccaggcaaatggataggtttcctagaactggttactcttttaagtgtcattgctgtgcatagccttacattttctgaagatggggactgtcatgtgatgcagaccaaggactcttgaaaatgttgcatagatgacaagcctccaaaatctgtgtactttctatattttacctgtggctcaaggataacttgcacaggctagaactcagcaacatgtgtggtatgagg

SEQ ID NO: 113652 - DNA, 1965 bp, Homo sapiens
ttcacacctccaggagagatgagttcattaagccaggccacacacattctgttgccatctgaggctgggccatttccattcctaagatgcatgatgctaaaaattgctgcttgtttcctaatctgtgggtagaggattaggctatgtttgggggttggtctatgttaaggatggcagcaggaagtaactagaagtagaggaactacttgtagtttttagcccaaggagaagtggcactggccagcactagggggcaatatagagctattttcttgcacatgctcaggttgatttttatacgtaaatgtttcaagatttgagggtaacaggtgggtgctgaagaagattcccctggaatgtaaccagatttgttagagctactaccattaccgttactactactacttctacttcttcttctttttgtctttcaaattttccattatgtgggtaatcttttgcccacatactgaattatgattgaattttgattgccctgttgctgtctcaattttgacagttgtacagtcctgtaaatacgaaccctccttgaggataccacgtagaagatcccattggcccagtttgtgcattgcatcgttttgtgacaggtcttctctaactctgaaatgtccaaattgatatattatgactgtagcagctcattcttgtctccaaggacccctcctcatgatactctcttttcttgagtattctaaagtccctaatggtgattactcaatcaggtacctcgggctgctcagttttaatattaacttggtatttcaagaggaggtagaattggaaattgattgctgtagccaatgctgcatacatggatttagactggatcatgtggacatggttcagaattagctttgaagggttagtgtcatttacactattgttaggtatctggtttttgacctaccattggattgcaattcttgccacttttactgtacaaagttttatcctctaatattataagttgacttcatatactatacttaatttttaaccttacttctgaccctgtctcacttatgaaaacaagagtcttcagatttaacttgaggaaagagattaaaagataacattgacttgcttggagggtgtctggcctgtatacttgttgtatgaccatggtgaaaaatactcatattttgtgcacactggttttagatgagaatgcctattgtggaatgattaagttctgggacggtgcttctgagttgtagcagaaagaatcatacacccaggaacaaaacaaaacctactttgtctgttgcatacagcacaaagagatgtcaatgacaaagttgttggtggaggaatgcctcttctacctgtgttgttggtgagtgatttttagtttactcatagattaagagcatgcgtatcatttttttctcattttctttagccattctgaattttgatttggaatatgccgctcttcgctacggttggtcttattaacatcagttattgtatgtgttctttttctcaagggcttttgtggcatgtggggcaatttactttggtctgctggtcgtgcccttttgccggtatcttgtgtttatggattttccatctctttttatcagtgccagctttctcttcctactgtcaatgctcctgtatctaacaaaatttaaattaaaaatggaaaattaaaaaaggtgcccagtcccctcgccatcatttttaggtggcagcttcaaatctctgttttatcaaaaacagataaccacaatatttagaacagtgtccaagagtaaataggctctaactgcagactaaagggactttcctgtaagtttccctgtaagttttattgcgtgacctttttgacatttatttttgttgtttaaaggcttttttacaaaaaaaaaaaaaaagaaaaaacttcctcctggttctctgctgtttgaaatagttgaggaagttgaacaagtacag

SEQ ID NO: 113653 - DNA, 1038 bp, Homo sapiens
ggctatggctattgctgtgagtaataaactttcttttctctgaccaagaaggactgtgtcttctgcacatccatgaaactatggcaacctaacatagcttgcaagcaggataaaatctcaaatctttcacaatttttgactctactacatattgcttaaggacctagatactgtcagctacatagcaatgaagcacttttatgcgcctgaaataactgataacaaataattgtggtaaacaggtatgtgggaaggaattcctgactgcataaagagttatgagaaatcatcttcccattggtttgggataggccaaaattcatggaatccttagaatgtttctagcagcaactcaaagaaaaaccacttcgtagtggctgagaacacagtcctgatatgaaaacttcctatgctgtaatctagtgtgaaaaggtaagctgggccaatcacggtctttctctcaagattttgaatgcgaaccagaatcaggtagcagcagctgaaaggattaagagagagatgccatgaaaatctcgtcagaaccatgaagatcttaggcaagtcaaacttttgaggaagaagaatgtgagtaaataggcagaaaataaagcttctctataattttataaagtctaaaagttggcaagaggagaaaagtgcaaatggacagaaagcaagagagaggtgatgaagccatgtgcttgagagaaacaggtagagagacaggagatggccatcttggagctgcttgaactgactgattttcaacttcaatttatgctcttgtctgtgtgtattaccacagtgaaacccgtttctcgttgtatggtcccagtgagtttcagtaacaacaaagctctaaagagatcatatcttttgccagtcatgctaaggtactactctttgttcccagcttaattctaaatcctaaacagaaaaaaaaaatggccatggccatgaagtatcatacatatataccgttaaaagaaaaactgcagcccagttaaatgtaaaggagtgtaattgagcaatgaatga

SEQ ID NO: 113654 - DNA, 1070 bp, Homo sapiens
actcattctgttgatggtttagaaatgattattgcatctagctacttctcctcatctctgcttttatggtctctgtcaggccatagtcatgtcaccttgaatctgttattgcagtactttcctagattcctgaacctgatcctgtcctctctactttgctcatcctctacaacagtggatctcaaattgttggtctaaggtcccctctacaacctagagcatgtttagggacacaaagagctttagtttatgtggcttatactattgaaattaccttattacaaattgaaacagaaatttaaaagattaaatcacttaaaataactgtacggatattaacatgaataacttatttttatgaaaactacattttcaaaaagaaaaaaattaatgaaaagtggggcattgtttaacggtagcaaatcagtttaatggctggtttaatggaagacagcaggattctcttatctgcttctgcattcagtttgttgtgatatattgttttggttgaagtacgtgaagacattatgacttcatgcagacataaaattgaaaaagggaagagtattttaatggccttgtaactgtgaagattcttctttaatgtcatgccaaaatttaaccagtgctagtttcttacaagagaggtgcaatgtgaaatctgaaatcagatcattgaacattttgtcctctgttgcagtaaaatcaactagtctgtcttgcactttgagtggttcttttgtccaattgtgattgattttataacatcatttggaaaatactgattctctgggttttgcattttttccaaatgttgacatattttattatacaacatcaaaaaaatcatatctatctaatatcacttatgatctcattggaatgtctgtgagtgttggaaagctgtcaaactcatggtggctaatattaattttaagattccaatttttgtttggaagttcatattttatcactggcaacaaatagagtagtgtttctcaaagttacaggttctcttcattcacttttgaaaaatattttcctaaatattcaaatctgaattaccacag

SEQ ID NO: 113655 - DNA, 1654 bp, Homo sapiens
aaagtatttctgccaatctaatagaatcctttccaattccatgcctttgtttgagtgtacggaatgaccttaagtaagaagtctgtcatgttctgaatggtgtagaatattcagttcactggaaacactttcttctagtatattattattaagagaagtgtcatcttggcagtaacaaaaatgttttggttctcaaagataccatttgttagtgtgatttatgacagattaatgaaaggcaggacagttgggtaaggagtactattcccaagcaattactaagattgaaatatcattttatcttttcaggtttccagcttctgcagtttctgttttgaagagccagcacttacggcagaaacttcttcagtctctgtttcttgataaagtgtattgggaaagtcaaggaggtagacaaggaattgaaaagcttatcgatgtaatagaacacagagccaaaattcttatcacctatatcaatgcacacggggtcaaagtattacctatgaatgaatgacaaaagaatcttctggctagggtgttagatatatttatgcatttttggttttgtttttaaatcaagcacatcaacctcaagcccgtttagcaatgaggcagtgtagatgaatacgtaaaataaatgactttaaccaagtagctataatgggacttagcactgtatgcatacttaaaaaggttttgaaaaacaaactacttgagaaatatttgtttatatttttctctaacatcatgctatgtgtcagtctgaacatctgacaacagaaatttcagttattattctagctaagttttgaaaacatttgtcatgctgtttaatagaaaactgcaaaccagagacactgactccattaataaaccatattttgtgccgttttgactgttctgaccaaatactaatgggaacaattcttgacgtttttctgttgctgattgttaacatagagcagtctctacactaccctgaggcaactctacattggaacactgaggcttacagcctgcaagagcatcagagctgaccatacatttaaacagaaatgctggtttatttgcaaaatcaccagtatattttctattgtgtctataaaaaatcagtcatttaagtacaagaatcatattttccattcctttttagaaatttattttgttgtccctatggaaatcattcacatctgacaatttatatgttaaagagttttactctctctattttggtccaatttgtatctagtggctgagaaattaaataattctaaagtatgaagttacctatctgaaaatgtacttacagagtatcattttaaaatggatgtctctttaaaaattttgttacttttaccaacaatgtaatataatttatgtatattttattaataatagtgaattccttaaaatttgttctatgtacttatatttaatttgatttaatggttactgcccagatattgagaattggttcaaatattgagtgtgtttcaatatattatctggcttatttcaacatgagtaatatgagcaaaataagttaaaacctgcgtctgatcaattttcctcatgactagaactaaaacagtaaatttggacaatattaagcctcaaataatcatctccaaactccttctaacacttttta

SEQ ID NO: 113656 - DNA, 1516 bp, Homo sapiens
aggaaatatatctaaaaatatcccaccaccaccaccaaaaaatttggctggaacacctgggtttttctgagtataattttagttaggtaaacattgaaaaaatgtattttcctaagaaaggaaagactcattttatggaaaatggtgattggcagtattttaagatgcagaagattagttttggaaaagacattcctgttttaaagaataagatgtgaatttgaacaagcagcaataatgaggactaacactcattattgcttagctgacaaaatgtatccccaaatagccttcttgtaggatagttacctacgcagacacgtagatgtacactacagtgcttaatcatgcagtagttaagtgaatgttttaagtgtgcactaaacaagtatattaaaaccatattatggattcatagctatgtaggatatgctttattaggctttaaaaattagataagctgtcttaaaagtaagcataaatatgctcaatagaaaactaaattaactgcctaacaaaatggcactgaatttaagggtgtagattatgtttttgtggtcaagttatttttggtatattgaatatgaattcaaaaggaaacctataaacaaaattctgagaagagctagagaacatgaattaagaggtacgtaagcccttgctagacaagggcaataatacaaagacgtaatttactatagttggagcataaggaaaacaaagtaaaacctagattatttgagaccttacagctgattttacatctgcaggtgtacacacagtgttcgtgcacgcgcacacacacacacacacacacatatgcccatcaagtacatatatagatctgaaaaaaattagtggcaacattttctataagagaagttgggctgaatgcacacacctgttttcagtaataatgtctcttagatctgaatggcacaacagtctgtcagggaggtggtgaaatcatcacagacagttgagtgattcaaaattagatcagacgaagtactttaaaagtacactgtagcaaacaatctaatgttggtaaggcaataaaaagatgacctaaatcaatcttttcaacctttaacttttaatgcttttgtgtagtttaaaaatagaaaaatataatgtttacagaagtactgaaagggccttatctctaaagagcttattatttaacataaatatatgatattcatggttttgttatagaaacagtacaaatgtagttatgtatcttagtcctttccccactactatgaagtccacaatgatggaagaactaagggtttgaagaagcatttaagaaatgtttggtagcattttctttacgggttatattcaaaacacatatgtccaatataatagactttgatatttagtcaaaattaaataagatttaagtttttttatttttaatgttaatgtaactagataaaacaatgatgataaaatggtacacagattctctgagaatcattagttaatgtgtatttaaaaaaaggggtga

SEQ ID NO: 113657 - DNA, 1044 bp, Homo sapiens
tgccactttataccagttcatgatgagataatgcaaagttacaagtaagcatttagaaactttgataataatttgatagaataattttgcctgctgaatctaacaagatgtttatctggtattttccatttcaaaaactttatttctctgatgattaatcatttttttaaacaaaacaatagtctacatagagaagcactggccaaatacacttattgtatctctaaagatgcctttggatttcttacctccatgcctttgcctggtttttagctaacactgcctggctcttaaaatttaactgtaatgtcatctccttcatgagcttttctctgaaatcctacggaagttctttgtatttctgacgaaacctttataactaatattttaaattcagtatcatttaacgttctacacaaatgcgcctcctttttgcagtatcgttttggagactacccccgagagatacaatcaggatggataagagcatggactttaaagctgtagatacctggactggaatcctgagttgtgtcatttaagagttgagaggccttggggaggtcaactagcccttttctgcctcagtttcctcatttatcaaatgagactattggtatcacctatgtcttaaggttactatgaggattaaatgaaataatacatgtgaagcattaagtatacagttcctggcacatactaaacactcaatataaaactgctattaatatttttattattaatattagcagcattttatatatataaataaaataaaaatatagtactttttttttttttttttttttttgagacggagtctcaccctgtcgcccacgctggagtgcaatggggcgatctcggctcactgcaacctccacttcccgggttcaagtgattctcctgcctcagcctcctgagtagctgggattacaggtgtgtgccaccacgcccggtatctttagtagagatggggtttcaccatgttggccaggctggtctcaaactcctgaccttgtgacccacccacctcagccttccaaa

SEQ ID NO: 113658 - DNA, 1028 bp, Homo sapiens
ttttaatctttctctgcttagtgtttcatattcaagtagcagcgaactttgatgctcctcaaaatcattcctgtcactttttccttttcatttctattaatgttacctcagtcagactttttccaatgtagatcgggatgctgtaagagactcttaactaatctcctggtctttggtcttccccaactgccaattaatgtgcaaatcattgcttaatttatctttcctatttcccttttaatcatattgccacttgcaaaataaaatctctaaagacttccatttgattggaaaataaagtttaaatttttagaacattaaaaaattattatggaaaattaaacatatgcaaaagaagacgggatattataataaacccctatgtgcctgtcactcaacttcaacaattatcagctcataatccatcttgttaaatctctatctctgtctactttccacatccacattaatttcaagaaaataattggcattatattatttcatctgtaaatatttcagtatgtatcactagaagataaaacacataagcacattgctattatcacgcacaaaataaaattgagcagtgatttagtcaaatacccaatcagtggccacatttttgtttcataagtgtcatttatatatttcagtttgtttatttgaatcaagatttaaataatgcccacactttgtgattggttggtgtgtcttctaatcaatggacttcatctctatatcttctctcttccctttcaacagcttgttgaagaaaccagatcatttgttttgtagagttcacactctcaattttgctggttacacttttgtggtgcctttcttttgcgcttcctttgtctatgttccctatagattggtgctgaattgatgatcaaatttagatttgatttattttgtcaagtcttctttgtagatagtggtgtgttcttttatcagaagacatcatatctggttagtcctttttctgataatagcagctattgatgttcacattgatccactagttc

SEQ ID NO: 113659 - DNA, 1046 bp, Homo sapiens
cttggatttttgtggcttgttttcactactttcaagtgactatcaaatctatacatctatctcgtttgcatgcttttaaattttatttttaaaaacatttagtggtgatatttatgaaaggaaatgattactttttttcttgactcttgtagaggaacttaaatggtttgaaattgtgactcagttaactctgtatccattcattcccagaaacaagccgcatttctccttggggagactgataatttaaaaggtttgttgtgtcagaaacattcccagcttcatcaccaaccctttccttccacctctgcccactggagaccacttatatcccgaagcggacgcggcagctgaagtcaggaaaccatgcatcacattagcaggagccaactgcagactttaaactccgttcaacatgtggatgcggcagagaaatgacctgtccagacaagccggggcagctcataaactggttcatctgctccctgtgcgtcccgcgggtgcgtaagctctggagcagccggcgtccaaggacccggagaaaccttctgctgggcactgcgtgtgccatctacttgggcttcctggtgagccaggtggggagggcctctctccagcatggacaggcggctgagaaggggccacatcgcagccgcgacaccgccgagccatccttccctgagatacccctggatggtaccctggcccctccagagtcccagggcaatgggtccactctgcagcccaatgtggtgtacattaccctacgctccaagcgcagcaagccggccaatatccgtggcaccgtgaagcccaagcgcaggaaaaagcatgcagtggcatcggctgccccagggcaggaggctttggtcggaccatcccttcagccgcaggaagcggcaagggaagctgatgctgtagcacctgggtacgctcagggagcaaacctggttaagattggagagcgaccctggaggttggtgcggggtccgggagtgcgagccgggggcccagacttcctgcagcccagctccagggagagcaac

SEQ ID NO: 113660 - DNA, 1364 bp, Homo sapiens
acgactccttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcagtgagtacagccactcaaaggaaagccaagtcgctttgcaggggagcgtctcatgatttttcagaaacgtgctcatggttaaaaagaaaaatcaaggctcggaataaatacattcaagcactgttaattttagcccaaagacaggcggtacttgcctggagatttgggaaaatcaacatgaaactaaaaatgaaattttagttggagtggagcaagcagtattgatcagaacataccaaatacgaattttttcaaagtctgcgtagaagtttaaattactaggaaaaatgtaaaggagaagtatttactaataaatgaaacaaaagtaataaaataaaaatgaattaatatagtttgacaaaatatcagcgaacgctgaaaagaaaacattaaaataatgtttgagactttttaggttttgtgcaggaagaattgggaaaaatgtgctggatggagtgatactgcttttcttttccacaaaaatttcattattttagagagcggtagagcctttttaaagacagtaagttattgccaattcacaatgaaataagatcacatgctctgaaatgtacaagagctgcatgcaataaacttcatttatctataggtaataactgattgatgtttattcagtagtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctatcacccagtcatgtgtctttttagtcataggttagcttttcaagacacttcctgcatctctgacctgttgcacctctgttatcttggcacctctgttatcttagcagcaagcacctgcctc

SEQ ID NO: 113661 - DNA, 1029 bp, Homo sapiens
cattgtggaaagacgctgtacctcctgtgataaaattactttggtggtgcttttttctcatgtatctcgggaaactaaaaatctgaattgtattcagtggccttttccaaatggtaactttatgaaaaaatgtctaattcttggttatttgtggttttagtcctttcttcatagagaagctaaagctgttaaataagcttagcagcgttatccgctaaaactttctgcagtgatggaacctacacaggagaattttttttgtaatgtactaaaaatttgtcttcagggcttgttctttttaaattgtaggctagtgatcaaaaatatttggtgatagaataaattaacatgaagtacaaacattatatatagttgtgtaatatcctatctgcaaaaaggagtcttagcgtgcttttgaaaaattcaataaatataatatgttaatcacaatttggtcacagattcacgtctcaattgtttcattttttcttttatttcagaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggtaattatttttccttgattgttaacgttatattatttttaaaaatgaagttccttttttggtcttttaaaagtatagctacaaaaataaatcatgttgatcttgatacctagtgaatagagcttaaaattagtcatttgacagtgctcataccagtttgtctgaaagtcagaataggagaaccattaaggttgtttcatggtaaagttagggagggtacagtcaggaaatctcttgggccattatatgaatggaagaaatttatagtcagttctactataacacctgttttgaaaacatgaatcttcaacatgattgatatattagagaacaatgtaagcataacagatttttggcttg

SEQ ID NO: 113662 - DNA, 1132 bp, Homo sapiens
ccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgattttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgattttttttgtattatttgatcttagtgacagtgttctattttgcatcctgtatcttatgttgcttttggtgttttgtgttgtgtgtcaacgattaagccaactaattctctaccatatataacttctggacatttttgatacaacatcttaattctttgtagatatggagataggtacagaactatattctaatgccccacaatggggctatgagaggggacagatggatgggcaaagaatagttttgtttaacatattaggtcatagttcttgattagtttttttagttaaagataaacacatagggtgtgatttctataccaaagatatgcttatttcagtattagaaaaatattcttcttacatctcctgaaaattgcaatttttaaaatgtgtaaaaataaattattattaaaagcacattttatttccatttgtttggattcattaccttaaaactttattgacatatttcaaagatataggaaaggtaaatgatttcaagaaaatccgtgtatttctaccatgcagatgtaataaatgttagcatttggctatattttcttcagacacacatatgcatgtaattgcaaatgttagatacatttgaagtttgctttgttac

SEQ ID NO: 113663 - DNA, 1054 bp, Homo sapiens
tctcctcgtgggtctcagccccggaccacaaagacgtttcatttttcgggacagccaatcatatgagtcaattcaccttaggcaactcacggctcctgcgcgagcctccaatcgatctcgaagggcactcgtagagaaaactacacctcccaggaagccgtgtgcgtcgccccgccttctactgcctttcactgcgcgtgcgtcgtgctgtgggattcgcggacccctctggccgcgctgtggctgtttcaccgctccccggctgggacttggagtcccttatctttccctggtttggtacatgacccggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctgggtgagaggaaacgggcggtggggataagtggaggagttagggcaaaagggacaaggccggtcctgggggctgtaggcacctctcgccccttctctcatcagctttctcaggctatctagggcaaaggtcacgcgctgtcagcctgttgggggaccctggcttcctccctctggggttgccccagttggtagaattaatatctaggctaaaggtcaagggcggggaaaacttgtcaacacgccctcggcatcaccaccacctgtcaacacacacacacctcggtggactcctgaactgaggcttcccaaatcctggttctaatcttcaaacctctgttggaaatggaaaaaaaaaaatcgtatttgcccagtttttctccctggtcctgacctgactttcgtcttcggagccattctagttcagtctaaagaaattgaagtctgatctgtcacatcatggttaacattcatatgttgaccaagtc

SEQ ID NO: 113664 - DNA, 1046 bp, Homo sapiens
ctcaaagccaagaattagtttatggaaactgaaataaagtatgtactggaacagaacctaagaatataatcatactaatacagtaatatgcttaatataattattgtgcaaaacacagggagaatttccataaataatactctaaagcacagtggatattttttaactgtcatgtgatttatcatgtgattattgggttatattaatcccagaatttttatttctcccaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggtatgaaaaattgttttttatacaaagtctaatcttttgtaattgtatttcagtaattgttcccaaattactggaatataggaaacccttttcatgtaactctatcttttttttttttctttttttgagatggagtttcactcttgttgcccaggctggagtgcaatggcgcgatcttggctcactgcaacctccacctcccaggttcaagtgattctcctgcctcagtctccctagtagctgggtttacaagcacctgccaacactcccagctaattttttgtatttttagtagagacagggtttcactgtattggccagactggtctcgaactcctgacctcaggcgatccacccaccttggcctcccaaagcactgggattacaggcatgagccaccacgcccagcccatgtaactctaagggaataattatatactttttaaattaaaaaaaaatttatatcagaattgtaatttatgatattaacaaatatttttgtgtaatgctttctacatgtatttatgtaatgggtatatgagaagataacttgagaagacctttgaatatttcttgggaggcattt

SEQ ID NO: 113665 - DNA, 1607 bp, Homo sapiens
agctgtgatcaggccactgcactccagcctgggccacagagtgagaccttgtcttaaaaaaacaaaaaacaaaaacttaagagtttataacttaagagttattaagttattaatgttcctaaaaaacttataattcaagtaaaaagtgtatacaaatgtttcttcaaaatgattttatcttaaaagtgttagttcaggcccattcgggagattgaaaccacagtggggagcatattggaaactagagaaatgtctttctcctccatgtccattcagtgccctctgctgacaaaacttagtgcccactggcagaggagagctatttgcatgtttcagctccattttcacagagcagtgaaggatgggtttggagttgataggcaatgaattgaaatctggcatataagcttaatactttgatataaatactagctttatacttttttgtaggctcttgaactagacccatcaaataccaaagcattgtaccgcagagctcaaggatggcaaggattaaaagaatatgatcaagcattggtaaattttgttccaaatgtttaattttttaaaatagacaactacctttataaatcatacacctaacttaaatgtttttttccaattaaaggctgatcttaagaaagctcaggggatagcaccagaagataaaggtaagttggcagcttttgtagtgaaagttaattttgttatttaaatacttatcctcaggaaccattgttcactttgccagattttagatgtttgttcaacagacactacagaatgcctgctgttgggccaggcattatcatatagcaatgaacaagacagtcaaagtccctgccctcaaagagcttacattctactcccattcaagaatatagtagtttttcacgttatttattcttcaagttatcatctctgtagttttttatatgtctaaatactgtttgtcttatggtatcctttgagactgtgttcctattctggttagtctagtcgagagctcagcattgtaagacacagtattcatggtaaatttaacatttgggaccattcaagttgaatgtggctataaccttagtattgatgtactggttatatgttttaggaaactatgacaaaaataagcttgtttttcaaataaaccaactatgaatagtgacactagatctgggtattacaaaatgtctttggtctcttattactaaaatgaaacaagggaagcaattactgttctctaatgtagaggcagaaggcaaatcttgatgtacttgagttctctcagttgacatcctctaaaattacgtttcatttctgtgtttgtgtgattgctcagattttctgttactagggcttagttactttgtagagaagttttttcaaggggtagttaacattaaaatagtttgttagtcaccataattttttggatattttgagaaataactcacattgcatatttattttacagctatccaggcagaattgctgaaagtcaaacaaaagataaaggcacagaaagataaagagaaggcagtatatgcaaaaatgtttgcttagaaaggattcagttttgcttattgtgtgttgattgtataaatgca

SEQ ID NO: 113666 - DNA, 1392 bp, Homo sapiens
caactttcatttggtgatctttgctagtttacgttaagtcttcctatacctgcaaaactgttcagttggtatgtatagtagtacatagtggaatgaggataataagcccaaaatcttgtctggattgtagcattaactagaggcttggccttgactttgttacttaacttttccacacgtgttttctcctgtctaaattacttatgggtttagactagattatctctgaagacccttgtgtacttaatgtctgtgaatcaaaatgaccttaatattggctgggcatggtagctcatgcttgtaatcccagcactttgggaggctgaggtgggaggatcacttgagaccaggagttggaaaccagctttggcaacatagtgagatgctgtctctattaaaaaaaaaagaaaaaaagaaaaacccctaaacgaccataatactacccagcctaagtgacagggttgtgagtgggagttggaagctcagttacttgtaggaggtaggctgtcactcagtgtatgacaagaatagtagtaaaccggaagctcatgccccacctaatgccacttacatagacaatgataaaattgccaacttattctgtgtttattgagctcctgaatagcaataaaatgcttatgtaaatactaacattgtcgtattagttggaatgtataaaaacagcattatagtacataaatgagccttctcacataaatctgtgaattggacagtgctgcacatgacttcagctgtatagcttttatctctcattattacgatagtgcacttctacaatttagggttatttttacagttgtgcgttattgcagaatgtggagaattgaaggaaggagatgacgggggaatattcccaaaagatggctctggcgacagtcatccagatttccctgaggatgcggatatagatttaaaagatgtgagtactttcagattagtcaaactttaattaatttagtaagtgaaaatatttagtactaaaagtttgagcttttgtttcagtctctcatatgatagaatctagcattaaaccacattacttactaaaatccaacatatttgtatttttttatacaggtagataaaattttattaataacagaagacttaaaaaacattggaaatacttttttcaaatcccagaactgggagatggctattaaaaaatatgcagaagttttaaggtaatattatttctaacaaattatttttaagaaattataaattgaattataaactaaaattaagaattgctcattatatttttgcaaattacttgtggaataaccaggtgtgttgaaatagttgcatttccttttttttcccctcagcttgttttgagaaatttcaaaagacagaagttgaacgagt

SEQ ID NO: 113667 - DNA, 1131 bp, Homo sapiens
tttatgaatttggaagaccgttcaggtcttcccagaaaaaaagagcattcatcataaagagggcaaaatatattacaagagtttcataatgctgcatcttcattttaaaggtgaagtgtaagtattttctcatggccaatttagaaataaccctccccccgactattgtttctgttacctatttactttgataaggttttttaaagtttaaagtgattaagtgccccatgttttgtgaattaaaggttgcagtttataaaaaaataaaaagtaattaaaaaattttataagtgaaaagtaaaaaaaagtagtttgatctaaatggtagtatagtgcaccccagttttatgttcagtaaaagaacagttcagactaacacacaattcagaaaagaacacatctaaccttggttttcttttaatttttatttctacagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaagtaagtaaaaagttacagtgaaatacacttattatcttagttgctatctttttgagacggagtctcgatctgttccaggctggagtgcagtggtgcggtctcggctcactgcagcctctgtctcccaggttcaagctattctcctgcctcagccttctgagtagcagggattacaggcgcgcgctacaacacccggctaattttttctgtatttttaatagagacggggtttcaccatgttggccaggctggtctcaaactcctgaccttgtgatccgcccacctcggcctcccaaagtgctgggattacaggcatgagccaccgcacccagcctgttagttgctatcttaaagaaatataagtaaaaggatcaggtgattattagctggaaaaatgttataataattttgggtataggagccaggatctgccactttttttttttttttttaacttttctacaatgggaaagacaattagggtagttttaaaggagatttttatt

SEQ ID NO: 113668 - DNA, 1060 bp, Homo sapiens
gatgtcaggggatttgcacactagcagatatagttaaatgtccaagctcctaaaggacttcagtggtgcctgtgccttcttgtcttcgttgtcccaagatgtaattggggtatattgcatcattcaagttataagaatggacatgtaagtacaaaagtaaagtgatatttttggaaataaggaatatgagcaagggtattaggataatttgaaaaaatgtcgtcagtcttccagtcagtgtttattgagccactatcactggcaccaaagggtttataaaaatgaaaggccttgatgacaaggaatttataatcctacctcagagacaagattaagatacatgggactactggagaataatagtatataaataaatgctaaattgattgaatatccttgcttgtataacattgctaatactgtctatatactgcaggagaaagatgtgatttatgcagtctgaattattatggaagtcattgaggaggaatggctacttgggctgtgcagactgggtcttgcaaggcggcaacatgtctgagatttggttaggcaggaactgtagtattgatgcagaatttaaaaagggacgtcggtgaggaaagacaaaggcaagagacgttgaggaaataaagttctagttactgttgtaccaaaggaagctaccagaaggatgaaaactaaaggtgatgtgatgatcacattgacatagagaaaaggggcctatagacaagacacatgattcttgctttctataaacgtggtggccttaaaatctgaatttgatttagactgaggggagtaaaaggcattttggtggggtggggggtgtcatgaaacattatataacatgagagttacggtgcatgcaccaacaaggaatacatttagaaagcctaggagataaagtgaaaaggttaagaaattgggtttcatagatcctttgacaggattatgccaaggtagaattttgatttcaagatgtatgcagcagtttcttttgagcactctccgaagaggtgattcatctgggatgaaaacctaatccaaatcctgtatg

SEQ ID NO: 113669 - DNA, 1172 bp, Homo sapiens
agtcaagatgtcgcacccgtccccccaagccaagccctccaaccccagtaaccctcgagtcttctttgacgtggacatcggaggggagcgaggtgagcggagtctgacgctcgcggaaaagccccgaggaggcgggggttcccgggatttgggggattccaagggcggaatgcggctccggccggtgactgctcagtttcgcggaggggatggctgcctaggctggtccgccggagcaggcccggagatctagggctagatcgatccagcgcccttgtatcaatgccatcggtggtgcggaagtttctggaaatttctagttcgggaattgtggcgtcctttaggtttgcctcctgatttggtggcacttccacgccacctttgcactaccaagttagcatgaaatattttatgtttgcaatgggacagttcggaaagcatatcctgggatatgcgtctgctgggccccaggaaactatatttgccacatgagataatatatcagcacgtgctgtgttatttatacgttaaagggacttgtttgctcattgcttttgccttattactgattcttaatttagaggtccgttcagatgagcaaacattttctcttaatttgccattgggaaaatgcgctcaacgtagtgatggtgttgcctaggttacatagccgctcagaagttcctaaggcctggtgaattagggagcgtgttgctttgtaactggattggccttgttctggaacacgttggaattgctggccaggcaatgtgtttgaatgcatgtacaggacacacacacgtttacacgtacattcagtttgttgcaactagctagggctaggtttaatctcacctgtcttagctgctatctagaggaggaatttttacagcttttgcttcagaggttgcatgaggcagtttgctcagagcacaaaggctgcaggtatacgtaacacgtggcaagtccgcccacccaaagactgtttaattttctcccgttggttgcttggtgattggaaattctcagtacctcttgaagaaattactcaggatttaaaactatttgtatttaatgatatctcttacatggtgctaatcttttggctactataattggttatgatccttagtgtaatgtttcaaatctgtttatatacatacatgacagta

SEQ ID NO: 113670 - DNA, 1183 bp, Homo sapiens
ttacaggtgaggaaacttaaagtcacagataacttaggcggcttgcccaaaatccagctgtcagtggtagagcctgtgttttgacccaagcagtttgaccacagattccagtctttaaaatccctatgctattctgatttcaagggctaacttttaaaagacgccttaaaatgtcctatattgcctttgagcacaggtatgttgagaagtttatttaacaatttttcaacacattttaaaattgagcaccaactcccaattctgacactatgctaggtgctttttggccaaaatgtcttgcaaaaacagttcactgttaaacagatctagacccagtataataaacctttaaaagtttcaagtgaaactttgaaataaattctggattaagttttatgttctagattttgcttttcttgaattccatcatttaaaacagtctctcactgtggtcatgtgaaaattaaacgtgtgtgtgtgtgtgcacgcgcgctcatggaaggcatattgtgaggaccttaaactccccaagttaaattctcatgttttctttaggctaacaagccttataatttgagtgggaattctatgccttttgttaggctgagtattagtgatgccatgtaccttctcagaatggtagaattacttcggacctaaggtgtgtaatttcgtcccttccctccctgtaacccagactccatcaggggtacaaagcctggagcggaaggagcatgttacaggtgtctgtactttgacagctcttgccaaggacatttaaagccatttgaatgcaggaggagatagtggcggttacttgtcattgttttctgtgctccttgcctaattgcctaccaccatttccgctatccacaagtttaactgagtgtatttgaacaaaaaaaatatggctatatttagggttttgggccatattagggaaattgattcccacttcatgggaacattttcagtagtgttctgacttctcatttgtgtataatgaagaacagaaaatcgtgccaagtacggtcttttttttgacctcattgggattttctacaagaatttgagatcgatgtttttggagaatttggggatcccagttgaacatcctacttgatgagggcccccttcaatagtgtccctgatagaggtcaccatggaaaagaaagtaaagtag

SEQ ID NO: 113671 - DNA, 1023 bp, Homo sapiens
gatttgggaactggtaatgtgctttatttctccagccactgtttttcttggtgtgggtgaaaaggaacaaatgttttgtactgattgtacaagccccttgcttagtgtgaattgttaggcctggactatgagatcatatacttggctgtaaaagtaagtctttcctttggatgtaagagtgctgaaatatttggtgagttcctacttaccaagcattctttatctcagatttatgaaaaatgattattatgtaaaaaaaggaaaaacaggatggacttttccagctaactgggcatgtaacagtgatttccctcaaccccaccccatctgtaaatggaacatccatgactcactactcatggccacacagacacttttgtaaccagtgcttgaatgggagggtgggatggggatggaaggagatgggctggcaccccacttgtgttcagccagaatctgtccagctgcctttataatggacttctgaaaaggacaatgtgccttctcatgcatcatgctacatatttttttttccttattgcactttctgtttgtgccagaataatacaatatattaagtgcaataaaatgtagccattaatactataatgttgtggataaatgttgtatagcagagtactctttctgttatataagattttagtattagcatgagtttggatccccgattatcatatttctgtctcctgaactgtgtgccttcatttctaggaattatttttctagttatttgtccctgtaaacttgtttaatttgtagattatactttagaatttgtgtccatcatagtgctataagagatttatatattggtttatgaagatgattttattaccacacctaagactttttaatcataaataagagatttctgtatttgatatatatctttaaataaatgattggtgtttggttatgtgctgatgtctaattgaaaatgacaaccaattcatgcagggtgtctaagtgagaatgaacactgaggcagtaggaattcatccc

SEQ ID NO: 113672 - DNA, 1052 bp, Homo sapiens
ggacatttgaactgcattgctctaggctctaggtggcctaaagtcctcacagctggaattctccatctggttccatccagttccagagcctggaccagttcagcttcctagactgaggtttgcatcaaaacttacaagtaatgaagggtttattatgtctaccattgctttctctttcttggggacctaaccggtatggatggaggaatgtacatgagtcacatttcagaggaaagctggacaggatgtggaagtgatggggagatacttgtaaacaaaaagaatagacaaaatcatgatatataaagtaacttccaagttttgagcccgaataatgtgggtagcataattagtggaaatagggaagttacaaggagaagttggttttgtacatgttgaatttaaggtgtagttgaacactctaagttgtgatattcatgaagctgtagttgtcagaagatattaagccaatatttgccaaagagcccagaaaattcatctcttgctctttaagacttttctttttctattccgtcctccaaaattacttctgtagaaattctgttccttcttccaaactcggtttagatgccacctctgattatctttgctgattgccccaaatgggcatgctgctccctttaaaccagtggtccccaacctttttggcatgaggcaacagtttcatggcagacaatttttccacagacagtggagtgggggatggttttgggatgattcaagcacattacatttattgtgtactttatttctattattataacattgtaataaataatgaaataactatacaactcaccaaatgcataatcagtgggagccctgagcctgtttttctgcaactggaaggtcccatctggggttgatgggagatagtgacagatcatcagacattagattctcataaggagtgtgcagcctagctccctcgcgtgcgcagttcataatagggttcgcactactatgagaatccaatgccaccactgatctgacaaggtggagctcaggcagtaatgctcactcgcccacca

SEQ ID NO: 113673 - DNA, 1060 bp, Homo sapiens
acacagaatacagtgtactttttcagttacaggacccacagcattttaccatggaaagatgtagagaaagaatcaagatttgtttactgattaggtttagggagaggaggggaggacaggagtgaatagtcaagagttgttccagtttgactaattgctataagatgctttttgttctacagagtttaatggatgttttacttccagagttgtctttgttatatcataattcttcagttttcagttcccttatcatgtgatttttgttattatgacatttaagattggcgaatgagcatacttatggtttggtaaatagaggtaatgattcctctcagttctgtttgcatgggggttgtggagctaggtcagcttcctcctgactgtctttgaagtttcactgacaattctggacactcagattccagctttccaagctttcctattggccactgggttaggtttcatactccttctattggttgctgtgatggggtttgtaaatggaacggaggcaaatcatacttgtaccctactattgtcatttatgtgaagagttgtctagaactacgctgcccagttcagtaaacaccagccacatgtctagtcggcccttgaaatgtggctagcctgaattgagacattctctaagtataaaattcacattggattttgaagacctagaatgaaataaagaatgtgaaatattctgtgagaaagttaataattttaatattgataacatgttgaattaagattttgtatatgttggattaaacaaaatactaaaattcatttcacttgttttttgtttgtttgtgggtcctgctctgtggcccgctggagtgcagtggtgtgatcatggctcactgcagccttgacctcctaggctcaagcaatcctccggcctcagcctcccaagcagctgggactacaagtgtgccaccatgccaggctaattaaaaaaaaattttttttgtagacacagggtctccctatgttgcccaggctggtcttgaactcctgaactcaagtgatcctcccaagtgagcctcggcct

SEQ ID NO: 113674 - DNA, 1016 bp, Homo sapiens
cagacatgcttctcatgaattaaataattttagtcctgatgtggagattgggagcactgaaaagtggtactaccatagagcagttttctgtgatgaagtaggtagagtaagcaaatgtgttacataagaatttctgcagcaactcttccagacaccttctaccttacttgataacagagtgtcctgatcacatgatttgcagagaatgagagatctgtgaatgattgctgagatgatggccccaacccagtagctcagcttccaacttcttaagcagctctagactactgataccttcctttcctaggtccaaatgctagggacaacctggctcaaaatcaaagttaaactttaaaagttatgtaatattttgttgctgatgtgtttctaacttttggcagtcttcaaaaaataatcccatagctgctattaatttcaggggaattaatgattatatgattataatttaatcatggggatgggttgtaaaaatcattcataaggaaaataggttgtagattgagttctgatattggacctttaaacaaaaaagtcatgaaagtctttatccaaattgctggttatctccctgattctagaaaggttgaatcattttaccgagacaaatagatacgcagtgccttttcttgtgggtggagagttacactgccggcctgacctggccacctctttttggtgttaaagtttagatatgaagtagttacaaacacagctttattgtagctcttctgggccgctgtttcgtttatcaggttggggatttcctggagccttaactttcttttccttatctctgtgttgtctggatgctggtacctggtcagatagcctttcggtagcactttttcaaaaaaacgtataatatgtgtactttaaaaattcctctcattgttatgtatattgcattgctgcttgatactacacaaagtttccaaataaagggaaattgtggagctttgtttagatactttaagagggtaatggctacggctata

SEQ ID NO: 113675 - DNA, 1037 bp, Homo sapiens
tttttaataaactttgattgaattataatatacaaaacactgtacatattcgggttgctgtgtgttcacagtaccagcactgggatcaagaaacagcatcccataacctttttgtgtctttctggggaccgtgcttcgaagtctctggtagaaagatttgtgatcatttgttcttgtgcaaggagaaggcattatggaagatagggaattacccggataaagaggaggatcatttgtgatgctgtggatcttaaacctcccccactccctcctgtcctgtatttatttctcctttttttctcattaatgtaatgtgaatatcagagaaagagggattctttttttttttcctttcaagattggacatactgagaggagaaagattcattattgcaagattcattaaatgagaataatcagaatggactttttagggagctgtattaagtcttagatttttctcctccaagctacgtttctcaattgttgcttctgagttaatttttcattacatatcatgatcattgcttttcatcatttgaagaatgtgaagtcaaggaattacagaaatgcatgaatacttacctagaaactttcatgactttaattctcccaactctaaattaggcatgggaatgggctttttctcaggtgtcaaatcttggattggaggtgggtcctggcagcactgcatccgaaggttttggagaggagtctgggcatcacaggagacaatgtgattgtttagagattttggccacggggaaaagaggttggacttgtgtcttgagtaccagatatttgtctttggtgatctaaatgatactgtgctatttattgattcttaaacttggcactcttctgtaggaccacttaatacctggtacatgagattggaaacagtacaaatagcagctttaaaaaattgaagtagtagtctgccttccttacatataccacatggattcatcatgctttcatacttctgtggtcctcccttccagtgtcttagaaagttcatcagttttgtgaaagta

SEQ ID NO: 113676 - DNA, 2062 bp, Homo sapiens
tctcgccttggcctctcaaagcactgcgattataggcttgatctacagtagttttcatagtgcttgtataagtaatcttttggttctctgttaaaaagagaaagtgactttaaaggcagtttatgggaagaaagaactcatgatcagtggccatgtcagttctaagctcaaaatgtgttcttcttggagaaaggaattcattttctcctaatctggttttatcttgatactatcaatttagcatgtgccacagagaattcaagttgtcatatgtgtgttgcaatttttatttctcaggagagggtgaatttcagctattttttgagtttattttgaaggaattttagggattatatatataagattgtcttaaggtaattgaaggccctgccatgacattagtttttctcacactcatggagtgaaatgtgtggataccgtacattaaaagtaatggcaaaaaccgcaattacttttgcaccaacctagtacaaaggtgcatttaaaaattgctgaagccaaaggaccagacaagagttcatcaggttttaggaatccattaatgttttcttcaccaaattccaggactaagaaaaggaaaagaattggggcaatcccttgtagttttgtatgtaaagatttgacctgtattccagggatcttgatttttatttctaataaaagaaaaatgttttcttcgtgaacccacagaatcatattgattctgtagcattgttctcctttttcagatgaagaatattagtgtcagaagtcaaaattgagctgcttttgtcctcaggttgggctttctcatttgaatatgcctaggaattcagtgcaagagttctgagggtttatggctgctcgttatcattttttttgcttgtattaaagcaaggatatatccctaatctgtgtcccacctccccttgtcatctatacattaagtcctacatttggctgttgtgggtaaccatccctcacttgctgtgggtagaattttgcaagattgcagagtaagacctgtcagctgacactggctcacatgagagccattaagagggtggtgtggccaatgtcagaacaaccttgcagctgaaggcaagtcactgcattgcccagagccatatgaacaggtcttgtgaccaattaattgactactacataatctccagctagggtgcacagatggagtgagtcagtccaagctgctcaacctgttaaatgtcttttctttgctaactggagtataagcttaagaacaaaagtaggacttgtctatgtttgtaatgggattgcagacagcgtgttttgtaatgtgatagatggatctgacttcctaaattattggcaggcttaatttacgtaacaaatgaatgttccacctttttttttttttaaacctttgaaaggggaaattagtacactgctgtcaagtagcttttctcacatactgtatagggagtgaaatgattgtttagaactgctggtcattacagaatgttcctcacataacaaaggaacttcaggatttgtctccaagtccatgtttatggtcaggataaaccagaagaacattaaaccgttcaggagatgtgcggcggcacagcgaacaccacaaaccagccagagagctggcaagactctgccagatgtgtgagtgatgctgttcctggtgctgggaggatttacagggcgcttttatgcacaaagattaaaaaacacaccggagtagacaggagcactgaccacacggaactcgacaacaggtttgaaactttagttgtttcaaagtctcagataattttttatttaatttactgtgtagtaaggagatggaattgtattgatctgaaagttgttgtttctcataagtgcttctaagtaggagaaatggggttattggtggatgtgcagagtcaagtcccttctcttacagaagagatgtaagcatgggtattttttagtgactattgtgacttcactacccatctgttttcttcttttcattacctctactggagccaacttataagaagtgtgtacatctttgtcccatgaa

SEQ ID NO: 113677 - DNA, 1129 bp, Homo sapiens
tctgggacttgccacacatatttgtgaatcattgttgctctggtggcaagagaaaacttgccatgtctttaaagtataccccttacacactgaaaaggaactgaaacagagcacttcagagtcaattgtgctttacagtttcatatcttgaaatttgaattcagaagaaattctctgtactgctttagaatcaccaggatgattctaaatgagtatatccattttatgtacatttttagatgagataattctattaaaaaagggaagtccttagattgtctgtggtagttacttaacaagaaagtaagtacagaaacttgagtgcattgttccctggtgagctgcttcacatagataagctgaccatgattttatgaccagtctttatttatagcagttgggattactgactaggaaatataaaaatagtcacagatttagagagagatatgctaaggcaacagaccaaagaattctgaagagtataataaaaggtcattaaaagtaagcgtaatgcaggtttgtaggaatggaaagaatgtttctcactgctgctcctggaaacagtgtgaaaaccactctaccctgatgctacttaatagaaaatgtagcagttggacaggttgaatgaagtgggtagagagaaaaaacaaaccctagtcagctgatggtcttgtgctttgtgacaagcttcacagagaggtcgtaaatggttgggtgtgactctgatgggttgggtattgtggtcacacgttcttctgcgcttcctgcattccttccctttttactgatttttacgtaccatgagaatttttctttgactagttagaagagtttatttctgctggctgagggtagagattttgagatataattccagactgataagagtgaatgaatcaaggaatgcagtgttgtgtctgatttagggttcaagaacatttgtcttttccctctgaggatacatcacttactaggaataaatcagcaatcttaatataggagattttcatagacgctaacaactgacatcagcttttgtctcggtcatatttggataagcattgatgacataacagggtaaagcacttgttattaatcaccatagctaactgtgtccagaatgaca

SEQ ID NO: 113678 - DNA, 1047 bp, Homo sapiens
cgtgcagtgctccgctattttgtctatgctgtggtggccccagggcagtggcatgtgggtagtggtgctgtaagtgccacacacaaacttcatctgttttagagtttcacttgatgtgatcctgaactcagaaaggaaggaagaaattctgtcttttcctctctgtactttgtagttccttgttcatagcacccaaaccttaggctgtattgtgacacatacgataatgttttgtcactgccgtgtgaacacattatttaaagacttatgtggttttaacttgtgacctttgctaccatttacatattgttttagtggcaaggagggggaaaacaagttcagagctacaactaacctacttacacataaacttttggctgttatttttgttagagatcagttatattcaggaaaatatggggaacctgaaagttatttcagtcttttgtccttttctcagacatggtaatcactaaagtgatcaacaatgctttatcctataattccaaaatcctaaaatttctggaaaatcttttggaattaatctgaactgatgtgaggctgtttatagtctctatctaatccacttagcataagtattcataacttgggctggtgaaatattaatttgtttgttttgggggtttgattacatctcagcccctggaggaagtattatgtaatatgtagtgtagcatctttctgatttctaaaaaaaattctgaattctgaaacatctagccccaaggctctcagttaaggaattgtgtatctgagtagatctttgaattatgctctacagctttaaaagtgctttcataacttaatctctgtttttcccaacagccttgtgaggtagataaggcagatgcattttgggaaagctcagcgctagggttggagcattctaaaatcatctgggttgaaggcagcagagctagagttagaagccctgtttaccctggtgaatcctaatccgtgtcccaagcatcatgtcttctgtgactcacatccatcactcacccaactgtgtggacttgacctctt

SEQ ID NO: 113679 - DNA, 1697 bp, Homo sapiens
gaatgaactcagaagtatggttccatgcttttgctgctgatcaaacatatttattctttcattccacattttcctttacaaaaggaataaaggatttacatatcacctactttcttaaagatggaagaattgtaaccaacatgcagtatagctctgtgttggtaatataacagtggactacatttaattggaattgtttgtaaattaatattaatatctttatgttatcaatatatattaaagcttctgataagaactttaagcacttttcactatactcctgaccacaggatagcaactcagtggtgattttttatgcagttccactgaaattgctccaggcaattcacacagctgaggctgtataagtgcaaaataggggaagaaaggagagccaacacagtcttcctgagagtactaacatagcaaaagataaatgaattccaaatctgttactgccatctatttacgtaagttttttcttgaaataaacagcttttactgggtgggaaataatgtgtattttgtgctgacagggtgaactctcattgctatgtcaagcttaattttcccttttcttccacccccagtcttcatttattttcagggtgtaactctttgggtctccccactcttcttgagcaaaccttttgagagatttctgtttgtacttagaaggtgttttttgagagaataaggaaacggtggaggttggcagagaaaaaagaatatagaatagggttaaagagtggttggaaaatgtaactgcgtttcataggagcagggttatggtttgctcattgctttatctcagaatgcttgccaagtagtaggcatacaggaattgctggttaaatggatagtatttttgccagtttttgttgtcatcattattgtttgtttttgttttgtttcattttgccttttcttggaccattgaaagtttcctatcattcctgactgtttaaatatttaccttcttggatcacaagactgttctttaaactctttatgtaaacttatttttgactgtgtggggaggcttccttgtgtgagaccaggaggaaaaacagagatcatgctttttccacatggggatacccatgaccacttctactctgattcctgtaaaagttcaagagaagaaacaacacccacactagaactggtctcaaaggatatagcaaatcaccctgcaacatgttatacaactactgctcttttgcttattggccattactccttgaaacccaggatttacaagtcactactacctctgcatttgccctgaaaatggtcttctcaaatcactttagttctcttcctaaaacacaggtcagatcgtgtcattctctttcttgaaatcttggaattggcacaccacagcttgtagagcaacagatgcattccttggcataaaatttaaagtccttcacaagtagtcctcaggtgcctttctagcctcatttgctgtgtggttcttctgtaggagacacatcccaagcacccagtgataactgtctttttgtgtttgtgctgtgccctcagtctgcagtgacttccctgttcattattccttctgtgtctttgtccaaaattttctccttcttaggaggacaccagtcattggattagggtgcctactaattcagtatggcctcatcttaacttgattatatctgcagagaccctgtttc

SEQ ID NO: 113680 - DNA, 1049 bp, Homo sapiens
agaacatgttcagtattaactgcctgaaaaaggaaaagaccaaaaatgcacaatttgtgattgagtaccagacactgtattaattttctttaaaaatcataacattaccaatcctctgaggcaattattgccattttggagcacttactgtgtgtcacactttgtgtgaggcactttacgctttgtaggacagctttgtgagggcagccttaatattctcattgtactgatgaagaactaggaggccagaggcatttgggtttgaatccagatgtgtcttatttcatttatatcatctcctagttttacagtttgcttttgttagtctgtctgtgtgtccatctatcctcctctgtcctgtcagagctccccctcagcttctctaagcaaggccccctttcacctcgggcacctctccagtccattgggaaaccggctcaactctgtcctctgagcatgccaccagtgtctgtcccctttcccccacctctgctgctggagctctagccttcattatgaagggccagaactcttattatgaattctgtttggccttcctgcttccagtcttcatctcttccacccccattttccttaacagccagattgaactttcaaaaagtgcagacctgatcttatcaagcgtctgttttccttggcttctcatggagggagaacatgatcctggcccctgcctgccgtcctttccacctcacggcactcactctctggccttttttcttcttccttctccagtgcagcagtcttacaccttaccacctccttctctgttcctatggtgcgcatcatttgttttgcttcttcaggtctgtgtttacatgtcacttcaagtccttagggacttctctgtccctttcccctaccccttcaatctggaaatctgaagctgtttactgctcctttttgtacttttcacagtttgtagtgatacattcgtctgtgattatttgcctaacattccccactgaatcatgaactccataagggtggggaccaggtctgtctggttaattaattgctgagtctct

SEQ ID NO: 113681 - DNA, 3487 bp, Homo sapiens
gtagaaatgaataacagtatctcgggtgtcagtcactgaagcaaaatttagagtttggtgtctcattatattatatgaaattgttagaagtacagttgtttagttacacgggttgagctacctccaaaatagcttttgttttcttccaacaaattcacctgaagttgcaagtttaattccctttggtagatgtgagactttgtttataaagaaaagtattgagtgactgatcagtcgttgtctatatttggaagtctattagaaaacagctttagtagcttcttgacgtttttgtcctctttctccttttcccccccatctccggatatagcttgcaagacagctttgagtacatcaaccaagatcctaatttgggaaaactgaacacaaatcaaaatagtttgggtccttgtcgtactggaagtaacctaggtaaaatcagagatacaaacaaattctttctttctgaatacactattgtgggtgtgtgttttgctttatttgagtttgtcgtgggtttttttttttgcgttatctttaatctgtgtttattttttttgtatgtgtactttgtttgccctcttctatgtgtttccatctctaggtctgctgcaagcatgcagcagcaaactgctgcagggggtagctgaaggaggacctctccggctcacccggagtgcttctttctttgcaggtttgtgtggaatgctgagtacagtgtgacccacacatattaataaatcctgtgcaggttcttaggaaaaatcctacttgtgcctctctagaaatccaaggggctcttgtgatcacagatattggtttcaaatgcggccaaatccatggtgtttcgaaaattctgccaatgaacctctcttgtaaatgtcttcgctaatactctagtgtaagctgattttgatctgaaatgagcccttagtatttccaagaggattgtttttttctgatttttctgggcctcttctgctactatgaactgtttccctttgccttggtgtcttttatccatttattcaactgcatccttacctgcacggagtttcattaaaagtcactctaataagagcatggaagacttctctctctctctctctctctctctctctctctctctctctccctctctaagtagtgtaaatacaatttctaggttatttacaggtatagtcatcttggtgtctctgagatttaacttgtcttagcatgattaaacatgtgaggaacctccattactaacatttaaagttgtgagtatagcaaatggtattttcctttctgttctttgtagcctgaaatatgctaagcaccatagttaactgacaccctgataaaattgacacgctcctacctacttagagtgaggaaaatgcatttaaatactctctttaaaattgtgaaaataaacatgcttcaaaaaaatagctgtcaagtataataatcaggcagagcactgggctgcttgtccatttaaaacttcactacagcagcagcatatctaccttctagcacaataagtatacagcttaggtcaatctgaagcattcctagaagtctgtaatacttcagagtgttttccacagttcatgccagaacatgagtttttctaagtaactctacaataatactgtgtatgggtgtatatggaaagaaatggaggaagaaatatttgaaaatgagtataaatgttttctatctgccaagagagtgggttataaacagagaaacattttttgaatttatgaaatggttttcaagtatttctcttccctaagtcgcctacagttactaccaaaactgattataaagcattttgaaatacattgctatttaaatactactactaatgaggaaaatggctaaaaaaaattacctgagaatgtttattcattgcatcaactgcacgaatcatttattattcagagttttttttttaagagttgaacatcactcagaaaagtttgtatgcttacaattgaatacaggcagatttttatgagatggttacttggttctcttttcttctcatcatctttttatatatttaattttgccttctagttaatctctattaaaagcttatgccaatcatcagtagcagtagcctactttgaaatttaaaaattactgcagtcattttaaaaactttatctctgaagagcccaataacatggttttcttgttcctttatcttagcacacagcacaccagttgatatgccaagcagaggacagaatgaagacagggacagtggcattgctcgatcaggtacttgtactctgtttattggtttaactaacagagtgaactatctacagtggtgtggaaggtgggaaagtagaagacaggtagataaccctcatcctgttctttgttttttccttcctaagatagtctgacatatctaaagatctgaaactttaatgtacagtatccatgagtgattgtgcaacataaactagttttttctaacactcaaatttatatgagactaatgtttgttaagaaatttctttccagaatgaagcttccttgagcccattgtactagtaatgtgcttgcttgactgttgagtatagactcagaggaagagaagggtttgtggaagtaaatctgtcctgtgacagtgggaggaccagccagctgacctggtcaccgtttcttctgttctagagacatgctgatctagattttatcaggtacccttctctccttgcctcaaggcctaaacctttctgttactgcttttaggatctgttggtttcaccttttgtatgtgacctcttttgagttttgacttgtggttcagatctgagattttgtattataagagaagggtggtgaatgagtgaactgaaattcaaggactggaggtggtgtgtggtgctctgcttgatgaatacatatggtacaggcagcccctaccttccagtgagactaggagcaccctgctggtttctcctgtgatacatgacaccttcaacaaatgggccagccaggcgttgctcagactggatgcaggcctcacatgatgttcttcttggcctttcactcatttctctgtccacactactccaaggtccttgtgctcctgtgtagcctcagagccttttaacccactctgtgcaactctgctcttgtgttaataaatgaaatgtgatttgttactgagtctccagtttggtttacatatgtcacataatgtaaagtaatagcattttatttatggttaaaatcgatgtgttttggtgttcataatcttttctgtaaagttgagctgggaacctttggtcagaaactctcattgatcaggccgagcacagtggctcacccctgtaatcccagcactttgggaagccaaagcgagcagatcacttgaggtcagtttgagaccagcctgaccaacatggcgaaactccatctctactaaaaatacaaaaaaaaaaaaaagaaagaaattagccaggcgtggtgg

SEQ ID NO: 113682 - DNA, 2636 bp, Homo sapiens
ttttttttatttccttagtttttcatctaatagccttttctggttctgggacattacacttagttgtcatgttcttcaggcttctcttagctgtggtggtttctcagattttctttgtttttcgtaatcttgaggagtactggttaggtattttgtagattgccccattattagaatttaatgtttttctcatgattacactgaggttgtgggtttggggaaggaagatcatagaagtaaagtgccattttcgtcacatcctataagggtatatatcaccaacattatttatgactgttaatattggccttgattacctggctgaggaagtgtttgtcagtttctccactgtaaagttactctttatttcctcctgtccaggctgtgtactttggagagaagtcaggatgcttaccccatacctaaggggtggggaattatgctgcccctccttgaggacagagtacctacataaattatttggacttctcctgtgtggagatatatctcttctcccatttatttgtttagtcattattctactatggactcaaagatatttatttttcacttttggctaaaacccaatactacttcatttctattatttatttatttattttttggagacggtcttgcttgtccctaagctggagtgctcttgtgtgatcatagctcactgcatcactgcagcctcgaactcctgggcacaagggatcctccctcctcagcgccctgagtagctgggactacagtcatgcaccaccacacccagaatttttttttttcttttatgtagaaacaaggccccactatgttgccccggctggtctcaaactcctgggctcaagcaattttcccacctcacactcccaaaatagtggggttacaggcatgagccacagcaccccacaacttcatttatttgttgctcaaattgtttcggttttgaccattgggagctctctcagtaggctcccatgctcctttaacatacctctatctgtgaggggttggggtgagtattttgagcacttccttactttctggcaagacaagatgctccagagtcatcttatgtatttcctatccctgtcctagaatcagccatttctccacttatagaatgtctttggaaaaagcagcacaagctggggcaggtatggagggaaatgcatcctcattgtattctcttttggatattttgaatatgtcttctttacatatacagatccaaaagatagctttttaaggggttattctagtggttcccattagaaattttcaagtagggtcttgggagagaagagggttgggtgtcagccatactaggaggttgcatcagcaaagttcagtgattaatgggacacaggttatggaggaggaaggaggaaccaaggatgcatctccagtttctaacctgagaaagcgagtggaaggtgagcattatccagtacagggaaagcaggaggccaggtcagggagacagatactgagataattttctagctacagagattgggatacatttttacctagaaatgtctacatgttctccagttgtgcatagtcagctgtaatttagaaataggaaactggctctagtgagatgggttggagtagaagctaaaatttgtttttttgttgttgttttttttttgagacaaggtttcgctttgtcacccaggctggagtgcagtggcgcaatctcagctcactgcaacctccgtctcccaggttcaagctattctcctgcctcagcctcccaagtagctgaaatcacaggcgcacaccaccacacccagctaatttttgtattttcagtagaaacggagttttgccatgttggccaggctggtctcaaactcctgacctcaggtgattcacccacctcagcctcccaaagtgctgggattacaggtgtgagccaccgtgcccagccagaagctaaagtttggaagtcttgagtacatgagtagagtaaggttcagagggctgggattgagaccagtgtcatcaagccttgtctattgacctgaattcagctttaaactcttcctcgtcaaggtgttcacatcattgataagaaaaatactttttccattctgtctgcaactgcatttcctctgttcttaaaagtggtaaaataaagaaagtcagtataaggagaacttacaatatatacttttaaacatttttatttaaatgctttgaaatgaactttcagggtaagaatctacattatcatagtgttcaaataagacatgtgttttggtcactctgcagatacaggatgtataaccatccaaaatttggtgtagatgtcaagattgatgactctacatgcacacaccaagaggatatgaaaaggtttattactcacataatgaggctgttctggggagacaacagggtgggggcttctcaagctggttggagaatgtcttcagagaatgggacaggggattacactggggattttatgatggttgcgagataaggctggggtgagggttcctgcatatggtttgaaattctcactggtaccaaaggagtgagcacctgggctttcctcatcagtttgcccaggtgtggagcagaaagggaagagggagaggagggtaaagcttaaaagc

SEQ ID NO: 113683 - DNA, 1460 bp, Homo sapiens
agaaacctgtagctctaatccagctatggttaggaggaagaaaattgccataagcatcatcttttccctatgtgagaaagaagaagcacaaaggaatttccaggacttcttcttttctcattttcccctgtttgaatctcacatgaacaggctgaagagtgcaattgaaaaggtaataaggatgtaatccaaagtcaaatagagaagtgattgtggggctttgaagatggcagaatttctttgccgatgtatcagatgtctttcctaaggaagttaaatcacctgtagcagtgataaattttaggcatgttgatgttagttaccagatactgggttaccttagggaaggaaatgactgctttttcgtgactgaaggcattattaccttgagtgttgttaattgattacataattttttttattaatacagcccagtagataagttataaaatttcttctcagtaatttgacttgctttctcttcaataaaggctatgatctcctgtaggaaaatagcagaatcaagtctccgagtccagttttatgtcagccgtttgatggaagctctgggagaattcaggtaaagtggcaaagtttggcaaatccaacaggagatgtttatgagcagccatggataaagataaactgtgacttggaagaattgggggcctggcagttattcctcacttttgtggttccgcccttcaagatggaaacagaacaaatgaagcaaaaaatttaaataatttaccgctgagtaatcctcactattgctcaaccgacagtccctgataggattgtttttaacaggatgaatggggaaaactaatgttcaggtatctctcaccagtctattcattatcttatgtcagcctcacaaaagccctaagcactactaaccccattttacagatgtggaaacttgagttcagggatgcttattcaaagcacagatggagaggttatgcatgtcgggaagacatacattccagtttgccaggacagtcctagtttacaccaagtgtcctctggaaactggtgtctagagtccttgctcctagtatctgtgtggaaaggtaaattgtgttgggtagcaggtgggatcctctctgatcatgctgagttgggattgttgcaccatttagagccactttcttgatagggaatggaatcccactccaaagcagtcatgagcgaatgagtcaaactgttattccatagaggaaggataaaaaaaaaatttataatcctttgaatgttagaacacttttatgatgcttaaagtatatgctgatgaactcagtaatgctacctggagcaaaatcgcaagccttttttttactgtggattatgtgttaaagtactcaagtaacatgttacttattatctggtgattgctaagacttaagtcatatatttgagaatgacataaagttgtgctctttgatggcagtctgatg

SEQ ID NO: 113684 - DNA, 2186 bp, Homo sapiens
ttctcctgcctcagcctcccgagtagctgggtttacaggcgcgcgccaccatgcccagctaatttttgtatttttagtagagacggggtttcaccatattggccagaatgttctctatctcttgaccttgtaatccaccaccttggcctcccaaagtgctgggattacaggtatgagccaccacgcccggctgagaatctgggtcctactttaatgaggtgtctatttttcaaaggtcaagaagctgaaagtgaggctttctagttctgtactttcagtttctgtagagtctctgtagtagcaactgaacttagccgttgtcccacagaagcagccatagacaataaataagtaaataaatgagcacggctgtgacccagtaaaactttttatttacaaaaaaaggtggcagtcagatttggcccgtgggccatagtgtgcaacccctgttatgtgtggagcttgaatcttttaaggactacatagattcaagttgttttctcctttattcttttacaccaagattatccaaaatagtatttctgacacttttgtgtttccctctctttctgttctatagaggaactatctggaacttatattctgttccaaggatagctgaacctgtatggcttactatgatgtccggcactttggaaaaaaaccagctctgccagcgctttctcaaggagtttacacttctgatagaacagataaataaaaaccagtaagcttcaactctctggagacttgtatgcaaatctcatggccaatgtgtgtactgcataggatgtgcctctttctgtattgactaagttggttgtatctttttccatttctccaaggttttttgctgccttactgactgcggtgttaacctaccacctggcctgggtcccaactgtcatgcctgtggatcaccctcccatcaaagccttctcagagaaacgtacctcccagtcagtgaacatgctggccaaaacacatccgtataatcctctttgggcacagctgggttagtacctaatttgactattcagagaatatatgggatggaataggaaaaaaatgctagaatttgtagtttataccggctctctcacccagtaattcataggttgtctttgggcagatgaggaataggaagttggtccctggattctaattgtagacccacgaccttcctctcttttttcccctactggcagctttgtgctacactcttaaagcagtataagccaactgtgttctcccattccacagtggctgttcaccctagagcaggatttcttaacctcagcactgttgaccaggtaattctttgttggttgagttgttgtggggtgtgggaagagctctcttacgcattaatggatattgagtggcatccttggcctccatttactagatgccagtagaactgcccctcccacctcccgccccaagttgtaacaatcaaaaatatccacagaaaagcacctcatcctggaaagcagcatgctataataacaataatgaaagctgacactgtgagccaagccctggttttacacatagtcattagattctcatccctacccttattactctcagcctcattttgtaacaatacagatgttgtcttgtccttgtgctcttggtcgtgagatgtataaatgaatacaagctccctcatggttagggggtaaaaggcgtgttctaaatcaattaaagaatttgtggatatttaaatggaattaaggaaggggagatatggagagaggctagttaacaaatataaaattacaactggataggaggaataaagtctagtgttctttagcactggattacgatagttaagaatagcttattttcagagaaagctagaagagaggtttcaaatgttcccaacacaaagaaatgataaaagtttggggtgatggatatgctaattgccctgatttgatcattactcagaacatgcctaactcattcttggtcatacgggaagtttttcctggggaagacagaacatggttgttttgttatggaataataatagtcttgaaaaaaacttagtctcattaagtggagaaggaaagggggctggatattaaggaaacattgtattccatgctgctggatcacccattttaaaacaatgctaattaagtagtgtgcatttagttagataaatgtattca

SEQ ID NO: 113685 - DNA, 1928 bp, Homo sapiens
gggactccagattgggaatataagttatctgttttgctcttgtaaagacggatatatctgtgacatgctaaccccagagaccactgcctttgtgtccacctttgctctctaggtgatctttacggagccataggctctccagtgagactgactcgcaccgtagtggtagggaagcagaaggacttagtccagcgaatactttatgtcctgacctactttctccgttgctctgagctacaagagaaccagctgacctggagtggcaatcatggtgaaggtgaccaagttttaaatgggagcaagatcataacagccttggagaaaggagaggtggaggagtctgagtatgtggtcattacggtgaggaacgagcccgctcttgtaccccccatcctaccaccaacagcagcagagagacacaacccctggccgacagggtttcctgagtgcccagagggcactgacagtagagacctgggtcttaaacctgacaaagaagctaacaggaggccagagcagggttctgaggcttgcagcgcagggtgcctggggccagcatcagacgcttcctggaaacctcagaatgcattttgtggggatgagaaaaataaagaggcaccgcaagatggctcttcaagacttcccagctgtgaagttttgggggcaggaatgaagatggaccagcaagctgtctgtgagctgttgaaagtggagatgcctacaagactgccagaccggtcagtggcctggccttgccctgacagacatctccgggagaaaccttccttagaaaaggtcactttccagattggaagctttgcatctccagagtctgactttgaaagccgcatgaaaaaaatggaggaacgggtgaaggcctgtggcccctccttggaggccagtgaggctgctgatgtggctcaggacccgcaggtttctaggagcccttttaaacctggctttcaggagaatgtttgctgtcctcagaatcggctttcagagggggatgaaggcgagtctgacaagggttttgcagaggacagaggcagcagaaacgacatggcagcagatattgctgggcagctcagccacgctgctgacttgggcacagcctcccacggtgcaggaggaacgggagggaggaggctggaggccactagaggtttgtatgtgaaggctgcggaaggacctgtgctggagcctgttgcccccaggtgtgtccagcggggccctggcctcgtggctggtgcgaatatcccctgtggggatgacaacaagaaggccaacttcaggactgaaggagacattccccgaaatgaaagctcagatagcgccctgggagacagtgacgacgaagcctgcgcttcagccatgctagatctgggtcacggtggtgacaggactggagggtccttggaagtggagctgcctctgccaaggtaactccagcaggctgggaagtagagggaactgggttcaaatcccactttcctggcctgacacctgtgatgttgttagccactactattgtctgctttacacacagtatctttttttccacaaagtactagaagtattattaattctatacaaacggtttcccacctgtccttcttccaaggatggtcactggcttagcaccactgagctcactgggacaggtggccagtggttgtctttgcagctatcgtgatcctttggggaagcctaagggatgtggtggagatgggggagggaatagggagtttaattttctgtcaactgcagagaaggtccgtggctggcagcagatgccttgcttcagaggtggtggattacactcgccgtgtggcctctctcctgccgatcagagcagcgtgaggtggttgggaaacaacacctctttcttaacactccatcaggttgattatttggtctgtaatgactga

SEQ ID NO: 113686 - DNA, 1385 bp, Homo sapiens
agggggtgacttcctgccatccctcctcccattctctggtctctttctggtgcctctcattggctgagcccggctgaaagccagagagcaggggcacagctgatgcagacacacagccttgtggtgcatagaggtcagcctcctggggcccagaacagaacacagaagggcaaggagctgctctgggggtggtgggttagcagataggctgggcaaatggaataaacagcacagatggtgacaattatatgccgtcacggtgaggaccgaagaggtgtcacatgtggtttgttttttatctgatgcttaaacaagttcctaaaagtaatttattttaactgatttgtcattaagttcactttgatggctgcatgaggatgactgtataaagattaataagtctcactgaaaaaattgcctcgtggctgctattaagtgcttttctgctatctgcagggcaacaggaactaagcagttaaggaaactgtcaatctgatgggcctgtttttaactgagctgttattgggcagatgtgcaaaaatagacattttgtattagaaacattttgtatcttgtgcaatagggaaagtcctcatcgcattaagaaaatcagaatttggcctgttacctacctccttggccaacaagtatttttttttttgaggtggaacaaaaggcattgcatgttatctttggccttgagcatctcctctgtgaagaccaaacatcaggcacaggctaaacaggctaagtatatttatgtgaagtgggaaaaaaactcagtagtgaagcagatgtcaacataacctccctcaatggggagggctaagagatgaggatagggccatcagaagctggggaaagccagcccagtgtacacgtgtgtggccaaacgttcctaaccccacccctgctttgtggtcacatgccacccctcaccaggatactcctgggatgaaactatgaagttgcttttgtccctataatatcataattatttaatatcataatttctctttatagttatgaacaccatatagtcatttatcatttcatgagtccatgcatcaatgacccctgtaagaaaaatgccctcattgtataatgctaagttgtccaaaacgatgtctgatgctttggcaatttcacaggctgtatttatgtgtgtttagtaactgcctataacattaaggcaccttttctgtccgctcctattgtttatattcacacatgccaaactgtgagttgtttttttttttctgctctgctatcattttgatttctaacaatattggtgttggttattggaccttccttccatgaagcccagtgagctgcttctgacagaggtaccaagagactacaggggaactaatgggattgtc

SEQ ID NO: 113687 - DNA, 2145 bp, Homo sapiens
tctgtttaaactggcgctctggtctatggtagtgtttttttttttttttttaaaaaacaggcttactttcaacatccatttacaaacatttgttgaaaaatattttaggagtatttgtttaaacattattccgaatttactgctccataaagcctagtgaatatttaaattcttgaatatgttgccagaaaaagaagcagagatccaaaaacaagtatatgaccagagttagagctgaaataatagcttgttgaagaagagaaaattgtaataaattgctttatcaaacttgctttcaaaacctgttttttaagttgggcacagtggctcacgcctgtaatcccagcactttgagaggccaaggtgggtagatcacgtgagctcaggagttcaagaccagcttgggcaacatagcaagacttcatctcaaaaataaaatagcgttaaaaaaaaaaaaagaaaaaacaaacctattttttgaacattaatttcagtgctcatgctagatttcagcaggctttggtactcataattctttttagagaaggatttttaactgtttaaaagcaattgattccagttattgatctcttttctagacctgtgcacaatttggatttaataatctgtcttatgtaaattaaatgtggtggttttttttgttttgttttgtttttgtttttgtttttgttttttttgaggtgggatcttcctgtattgcccaggctggacttgaactgggctcatgtgatcctgcctcattctcccaagtagacaggattataggcacaggccactgtacctggctctaaatgtacacttttataactgctagtttggagtttttctctcattgagagattgctttgtaatgcttccaatgttaagaatttttttgtacttttcttatcctagtctcttatgaaagaaagatatagtaactacttcatcaattttcatttttattactgactttcacatatcaagattcagaagttctttaaatatttaaacacgtattcttgtttagtccatatactacctcttttctgtcatttgaactctctctgcctcctaatatataggttatacagctgccttaaattagtgtaaagtaatacggtttcagtttttttcttgccacatcttgtgcattctttcctctgttttccttttgactttaaatggaaagagagcaggcgtatgcgccagcagcattctatgcctgtgactcctgagtagccttttccctctcctttttcctcttgtgtctggcctgtgaatacagctgactgtatacagggttactgttggggttattgtggggcagtgtaaggtgatgaagatctcactgacttagtgttgatggcttgagtttgagtcctggtattaccactcgtttgttgataatcttaggtaaataaactggcattgctaagccccagaaaaatgtatttagtggaacagatgaaatatgattcagtggttaggaagttaacttctgaagacagacaaacctaagtttgaatcatggttcaccccttagtggctttgtggccttgggcaagtttctttaattttcttatctatactgtgaacagtacttacatcataggtttggtctgaagattctgtgagataatgcatatcaagtggttagcactttgccaggcacattgttaagtgcccaataaatgtgggccaaatgtgatagctcacccctgtaatgccagagctttgggaggatcctttgagatcaccctgggcaatatagcaaaatcccatctctagcaaaaaaaaaaaaatagctaggcatggtggcacatgcctgtagtcccagctactcaggagactgaggcagaaggcttgcttaagccaaatgttcaatgcttcagtgagctgtgatcattgccactgcactccagcctgggtaacagagcaagacctcatctcagtaaataataataataatatatgtaaaagtgctttgtaaatgatacagcaatatatcatgtttttaatatgggagagcagaatgacaaccattattttcgtaaaaatgaaaattactgtcagagataagaaagctatatatgggccaggcacggtggctcatgcctgtgatcccagcactttgggaggccg

SEQ ID NO: 113688 - DNA, 1070 bp, Homo sapiens
cctctctcattttattttggagttccatatctcatcatgtaacttgattctgataccctttctgaccttgagcacctcttctcaacttccgactgaattttactcagcaagtggccagcctgaaagtgcagccattccagaagttatgtacggtatcttcaaggccacggattgaatttgggccctaatcaggtgagcacaggcacagatacacagaagatcagacattttcccggaacccctccagaccatcttgccacactttgaaccctttcttctttccctctacccctaagtcttcatactgtcttcatgtatacctacaaggatcccttagcaatgtcccaaggtccaaaatgattaattttcctcttcctcttgtttaccttagtacaactcttaagcctttagtgactgacattaaacctgtttccaagagaaaaatttctgataagcaaatgcttttagagttatgataaggccatatgtgattgttaccccttctggtattttcatgtgttaaaaatatgtttgatgcactagaaatctccagtggtggcacttcaggtggtcgagataactcgtgtcacctgatggggcagagatgcttttgggttagagtggggagagtcacacctgagagatttatcagttgaaaaatacttatcaggtatcttttatgtgcttggtactgtgtttatagcagtagtcaaaatctgaagtagaattagcaggggcgtgatggctgtgtgcccagggtcccagctactcaggaggctgaggtgggagaatgatttgagctctggaggtcgaagctgcagtaagctatgatggagccactgcactccagcctgggtgaaagagtgagaccccgtctcctcccccaccccccctcacccaccgaccagccaaaaaaaagatctgaggtaggaggattccagcaacatgtactaaactggtgtggatggcatgcctcccctctaaaactatatagtgatggataaaatatcaccatcctcactgctgccccattgttataattcctgtcatgaaaaaaaatggaaatcctt

SEQ ID NO: 113689 - DNA, 1405 bp, Homo sapiens
aagcttcacctccctgctgattttgtaagtactggttcttatatcaccaaagaaatctagttttaaaatgcttttaacgacattttgattataaaatcacaaattcaaaagtactgttttaatataattggagattagcataactaaaactagaacatgcagcataaaactcgcaacaggatagatttcagtagtaatagctcttccgtgaaacaaataacaaggagcggcactggaattttttggaatgaggtatatggtgcagtaaataaggaatgggtggagagatcaagcataaaaggaaactgtaaatcatccactggagaactcatgagttctccttttattagattgatattttaataagtaggccagtttctgaagggattgtagttccttttattaagcaaacattttcacaaaggtgttaaggataaaatagaatatcatttgtgtaaacatttccaacatttccagctttaaagtactatacacatgtaagattatatcaattgttgctttttttttttttttttttttgacagagtctcactctggagtgagtagtgcagtggcatgatctctgctcactgcaacctccgcctcctgggctcaagtgatcctcccacctcagcctcttgagtagttggactagaggcatgtgccaccatgccagctaatttttgtattttttgtagagatgggttttgccatgttgctcagtctggtctcgagttcctgggctcaagcaatccgcttctttccaaatgggattttaaaatcactttcgtaacaatactttaaatacaaacaacagacagagcctatacactcttagaaaagtatcagtagctccccccagccactggaattaacatgcatgacaaaatcttctcagtatctgcgtatgtgcagagaaattgaaagaaagagaaaatacatttagagagggagggggaaaggtttcaaaagaagaaaagcttttccagtggtgatgaacacttaaaaagagagagagaagcttaagggcatatggcatatagctgggtagagcttggatgggctgacctcagagacaggtgtgtgaggaaagagtctgctttctctgctgttccctcctgtctgcacagcgctgttctctgcagcacagccccaaaccaaaacatctgttatctgcttcctggcctccaaaaatgatgcaaacctgtttacccaacaaagcaggaagtttttaaatattaattacctacgctaattgctaatgtaatggtcattgtcctgggtttttatgaccaaatctatacttgtacccattcctcaaaaagagtctagacttttatgactttgaagaaggtgctctgaaataccgtctggttgttatcaaagtcgggacagtgtggcaagg

SEQ ID NO: 113690 - DNA, 1177 bp, Homo sapiens
tggaatgatttcaactatgaaaaaaatacttgtttaaaaagactagaataatacatatgtaaatcttaatagttagcaaaagtaaactttgttttacaagaacctattcttatacctggtagtggtagggtttgagatggcttgtgattttttaagtgtatttgaaactgatgagataaaagctgtgtagttagaaatgaattaagaaaattctgactcttaaaatattggcagagatttgacttctagccctcattgtgaatgttcttggctttgcagtgcatcatgcatcttgaagatagactacaggagatgtaccttaaaagtaaaatgctatctgaatatctccggggacacacacgagtccatgtgaaagaattaggtgtcgtactggggtgagttctgtgaagtgccgtcacttgtccctttgataggtatccctagcattgtacccactaacgtgtttagcctgtgtcaccctaaacctcaggccctggtaacccatcaaagtatgtggagtccatcagatacgtgcctctgcaactccccaatgaacagcatgttccgttatctgatactgggtttcacacctacaatcaatcgcaggactttaggctggtcgtgctttgttgctcttctctgtggattatcttatgcttgaaaagaaaatttaatcccacactgcccgtttctagtaactgaataagatgctgaagtcacaagctgtgggacatgcagcagcagcttgtgtttacatttcacttcctggaggaggagtaggttggcacattccacctggtggcaggaaaggcccttctaggcttgaggagcctgcctgcgtgtctgtggggggacagtgctttccttcctttattataagcccaccaaagaggagacttgtatgttactaaaaatgcctatcatcctccagagggtatttgctataacttctctaggggaagtaattcttacttctgttttactgtcagcttgatttttcaaaagagaacaaaaagacattgtacatttggggaactgcccccgcttatccatgatgatgattcccctcacttgggagaagaaaatatttataatgtcgacgtttaaattatctaagcctcctaagagactggggcctttgtgttttgcttagatttctcatctttcacacccagaa

SEQ ID NO: 113691 - DNA, 3955 bp, Homo sapiens
ctagaaataatactttctcataaaaagaaataatactttctcataaaaccatgctcttttaaagtaatattcttttcttttctcaatattcaggattgaatccaacgacctgcctctgttgactgctattgccagtactcattctccttatgtggctcaaatactcttataagctaaagctcaggacagttcttccttggaagaaaaaaatcaaattctcaactgaaggagaaaggaataagctctctgtgatgtcaaaagcatgagaagagcaaacagaaacagtcattccacctttttgttttgtgtttttgctgtcaagctgatgcttcattgaagacttaggtttacttgacataatagcatttgtgattgtcgtgaacactttaggccatttgttacccatgaatcaacaaagaaactgacctttttggtaggaggaaacataagcactaaacactaagctgttgcaacagattgccttgtgctgtttgggcagaataaagacaagtgacttgagcggggtggtcagcagtgtacataatattccagtaggaaactgcttccaagtttaagcatgagctccccaaactggagaaaacatattttgctattctgagacaacaatcagaatacagactttggattccaggtcacagtttgctttttagacaaggtaaagcaaagaaagccacattgtgccatcttcagctccagtggctttagcagtgactgtttgacataaaacatgtaagaattgcttgttgggaagagtgctttagggacccactgttttcatttcttcttggagtttaccttgtttcagatgcagccatgggtaggtcagagatggattgttggtgcaataaacccaagaatcaatgtagcctcttaatcccatcaagatgtagtttgtagcagcaaagtgtacagtctgaaaccgtatgttttatccttatattttagagctttcagcagcctttttaagagaggccacttaccaaagttatttctataagctcaagagtgtttcggttggtaagttcttccagctgaagccactttttccttatagttaatacaaatgactatttttactttaaaaggcacagctgtcctggtgggaaatgaaacctgcagcagttcaggatgactaatgaaagcaattagcttgaacatttagaaaaaattcatatatgatctaaatttttatattatcatttctgtgccttctaattcctgcatccttttcaaaacatctttccagacattaacttacacattgtataaaaccgaccaaaatgatttcctaaagttcatgcaaaaaaaaaaaaaaaacaacctaattttctgttaatataaaagaaacttcagtttactgaccgtgaaacagactatgtactgacatccagggtaaagtaaaagacttttaaatattggtcattaaaggacaggagctaagctagcaaagcaaaacatctttagcactttgcagatctcaagcagttaaccaggctctgattcccttccactgttttatgaattaattccagttcttttcatgtatctttgaacctaagattatgaagtaatttccctattagggactagaatgacttcagttttttcatttgataaaaatcagaactgctacctttcccttttttaatgatgcaaaatgtagatgagtgcattaagttttgtaagatctttatcattttatgtcattcattgaaaattgaaatgttcattctttttaatgttttcctatttccttttgcctagcatttgactttggtgttttaagttctgtagttccatgacatcattgtttgctgttgtgttacagagagagaaggaacctcacctgtggctcagctcaccccacatccgtttctcattacgtgtaaataaactgtcagagctgatgttacagcttttacagtttaaagcattcccctcgtctctagttccttttttcttgtttacatgttttgggcactttccctcattcaccaccttccagggtttcatagaaaataacttgttacaaaatcagttcaattctaatgtggacatagtggcatgttcataattagacccatataggggacactgagctttaaatcgttgattctaaactctatacattaaaaaaattcagcccaggcccctcaaagcctgagaaaatttaatttgctcttaatttaatgttccaaaactcactcttggaaaaatgcctgttggaaaactacaggtgggtcacatgtgggggctgtctccgtgacactcaggattccagtcagaacctaatcctcatatctattgcctacaaaaatagaccaagaatgttgctgctcttttataatcctttaaatatttaacattcaagttttctttgtcttaaattcagcctcttcctaaaagcaaaaaagaaaaaaaaaacctcacagaattgtgttgagatccaccgctcacacgccgtacaccacccagtggcttcattctggcttagccgcagaggcaagaaagggaccccacttgctcccatgcccacctcaagaaaaaacataaaacaattttttttaaaaaagaaaagaaatctacctcagttgacaggattccacctttagggtttcttcaacttttaagtcttacctgttgagtgtaacttttgtagcatcttgcttttccaagcaagctagtgaggcatgacagagcagaagtctgtaaatgtccctgtgatggacctctttctagcatgttgcagttttatttttaataaattggtaagtgaaatgaatgtaaaggtaattgtgtacgttttagacatgacaatgaaaatttaaaatgtagcttccatacttgtgcataattccaaagtattttattttttatcaatcagtgttaaatagctttttgtacaggcttcaatccatttttcgaagtgtgctgttttttaatgaaagtaactataatcttttcacatcccatggaactgccgtttacacattgcaactttttaaacttaaccatatttttcaaaattaacgtttttggagggagaaaaatccccgcttgctaaatgatactaaaccgttgtttgggctcttataattaggtcctgagattttataaaaatttagtctgtagctttttaggttcttcactagagttggttgtacataaaaataataaagaatataaagtatcccaaaattcttttaaagtctggatttttccgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaacttaagtggtatttcaaaaacgagaaaattctggaatttgtcatttgaagctccataagagaaattgataggacttcgtttttgatcagtctgaatagataccaatgtcattgtgtgggaattttttttaacttgtttatgtattattttgatccatttttctgtggcatttggtgcaataaaacttttgaatttatcttgaacattttcctggtgctgcatgcgatttgttatatttaataaaatgtagaggtctcatttctaataattcgtgctgaaaacaagctgattatttatctcagtggtttttaaccggggtgttttggaaatgcagggacatttttggttagcataatgccaggttagggttactggcacagagaggctgggggctcagatgataggcgagaggtcctgcaccatgtgagacagccccatgggatgaggacttgtcccacccacctcctgcgtaacccttaa

SEQ ID NO: 113692 - DNA, 1096 bp, Homo sapiens
aactgattttaaataacaaaacatatttaaattttccttaaacattgttggttatttgagaaatgaccaagattctcctagcggcctgaacgtctgggaaatggggtaagaagataaaataggcttcagccttcagtgaggaaaggactggctgtgccttacttatataatgtctaaaaccaataggacaaactccactttaattttgacactttagccagagaaaacactccagagggctgaagaagggacccgccggggctgctgctgagctgggtctttggtcttccacctttttgtgacttgagctgggcccacagtagcatccatgtcagccattttgattcacgaccaaacaattcaatgaactctcagtattttggcaaaataaggagcttgaataaacatgttgacttaaatggatcaaaacagatggttattctggataactgaccacccagcttcagtcttgcccagaaacaaaccttatattcttctctttggcattctgacccacaccttctggagattctctggttgactaaaaataattctaataagtggcaaaattaatgtctttttggattccaaaattaaagaaagaaaatcactgtttgtttgagttccagggagtcagtctagttgcctaatataaaccgcagaaacagtcattcacttgagtttcacatagagaaataatgtggaaacttccctttaggacttcaacattttccttgcagcatcagaacgtgatgtaactctgtgtattcatgtatttcaaacttgtgaagaggaccggtgccatatctgtgccgtgacttaaaagcacgacctgtttcctcaacaagctggtttccttcaatgtttgctttctcacagtggtaccgatttctgctctttccatttccaaaagtactaaaaagccattgatggcacatggaaatttttgagaaacacatttagaaaccatttggcaggatctgtgctttctgggagaacaagccttctttccctgttattttccctttggaagattcacaggaaaacaagacctctgctctttaaagatcttttttgtgtgtgatggtgtagtcca

SEQ ID NO: 113693 - DNA, 1001 bp, Homo sapiens
tcctgacacagttcgccccgagcaccccacttcttgcatcaggacccccaacttccaaaggcatcccacctccgagtcttttactccgcctatcctggttttatttttccctctccttgacattctgctccttaactcttccctccccatgactgacctttcccactatgttgcccagccgagagagagagagagagagagagagagagagagagagggagagacagagagagagagagagagagtgtgtgtgtgtgtgtgtatgtgtgtgaatgtgtgaattctctagctttccctctccccagccgccctccgtggcctctgaatctcaggggatggagtctcatctcccctcgggcagcgactcttgctccctctgactccagatccgttcctccccttgcaagtgacccttggagttcagtggtgtttgaaaggtataggaggaaacctgtacggttgtgctaaagacaaatccatgctgaccttcagtaaaacattgaggtgtttgtatgtttactgttttgcttttattttttaaaggatactgctttcaattgaagggaaaaaaagttgaatagctaagttagtgcttttagtttaaattgcagacatagctgcagagcaggcatgttccagtacaccctcgggaagggcaccctgcggattcttttggtgttgcacaaccttgtcaaaattagataagtttgttaacctttatacatttgtttacctgcaggcttactcttctcttacttatagcggctgatagggttggatttggttgtctcaagttttactggagagggggaaattttataaaaatgtggtagcttaattttctccgcctttagttgctgactggataatgacgcatattcctaagcgttgggatggtgactataggagatcctgcctgccaaccctcttaagacaaataagccctcctgatccttgggaccatcagacatttaggatctaatgcttgaaagtgttgcttc

SEQ ID NO: 113694 - DNA, 1087 bp, Homo sapiens
aaatgaactgttaaactttcctgttcccctgccagttgtgtagaatagagtaaaaactgacccaacacagaacttggcctgggccagctactactaacccacgacatgaaagctttattgacagtcggaaggcagcccatttgccctaccaaaccttcatagaaaaagtaaacataaggaaacctaccaaacatttcaaacattcctaagtgtcagccctattaactttgatgttcgtttggttattactacaaatccccacgtttatttcttttcaagagaaagttgttcgaaatgtgaacgttttccatctttacctgactggccaggagtaatcttataaaaatttgaaatttactcaaaaattataaaaaaaaaagtttttgtagaaggtactttttatgttaagaatgctttgttaatggaacgctggaagattttccatacagccttgtcttataaatgtttgtgagttcgaattttataatattagaaaagcaaccatgttaaataagcttgatatcatgaacagaaggacaggaattaggaaagttttgctgttttgcttccttctgtttctgaggatagactcgataaaggagtttgcatgattctcgttataggcaaaaggaaaagaattggggaacatatgtaattttttttcctgctgttcatttctgtttgttttttaaaggcttgctggcctcattcatttcccaagctccgtgaaaacatagttttgtatttaggtcaatcaattgcctagaagtaatcctgatgtcattggtgtaacctaagaagttggctagaagagaatctaggggtgggaagagtaccaggaactttcataaattgggagcttttcatgtccacctgcacaatggaaacgcatttcagttatatctttagagagggggaatagtaaggagaaataccaaaaaaattatcatctaagttttagccaggttatacatactcagtttcaagagactatcactatttcacctgatattgtgagaggaggaggaaaactctaatccaatgtgtgtcccatattgtgtgtctggaaacctggctgagttctagt

SEQ ID NO: 113695 - DNA, 1025 bp, Homo sapiens
gtattttattttttaatgaccagtcttcagtggaatcattatctttcttaaactttttagcttaagataaatgtagattcacatacaattgtaggaaataatggggagagatcctgtgtgtaccctttaaccggtttctcccattagtaatagcttataaaactgtagtgtaatatcacaatcaggatattgacatcagtgcaatcaagaaacaaagcaattccagcaccacaaatggttcttgttggacttttatagccacagtcactcccccaccccacctctggggatcactaatctgttccatttctataactttgtcatttcaaaaatgttattaattggaatcgtacagtatatggcctttggagattgactcccctccccctgcgcagcatcattaaggcttattaccttttggttaaaatgaatttctgttgttagtgaatagtttggccttgtgcttctaaaataccaataatgtctgaggattggggggttggtggtaaaaggtgagatgggtttaatagtgacaatgaagagaaagttctgtgataatgcgtataaatatagagcaaagagcataaggtcttggatgagcaagagttgtgatagcataccacatttgggagattttgatatatgtatttccttttcatattttttttttgtcataatggaagtagtaaggttagccttagccttcatattctccaactgaaatttaaaaaataaaatcagaaggaagtctaatgactgtatatacaaaagggagtcccaatggccaaatttgggacagtttgagaagcaaatcatgacagtaacggactataacccctagggaagaaagtatccatgagcccatactgatataagtaagtagttgaataaataaataaaagcaggagaagagacacctctttgttatagaattctaattagaaaatgaaggaatgatggaaatagaaaatcaccagcaggtaaacaccatagtagcaattgttacaggcaggaatcatcaatgg

SEQ ID NO: 113696 - DNA, 1026 bp, Homo sapiens
aagggtgtgtttaaaaagtctagtcagaggcactgttacagctatggataatagtgttatctaagctgagtgtattgaatactttcatctagatgtcttaaaaggactttagtaggatataaaaagaaaataaaaaggaattttaaaaatcaaattaaggcaaacaatctctacacattttcccccttgtatctatgcctttacatttaggttataaagtcagcccccctccccagtcccacggattagccaactatctttccgtttttgattttttggtagtgagtactggagaatgaatgctgtttttaatattatgtatttttttcataactgaaattggcgttagaagattggattaaaaaacatgagacctaacattttagataattgtaaatatagtgtaagcaggaagatatttactattttcaataataaagacataaatcacttgttttctgtattttaagaaacttttgctggtatttgatattttaaataataagttgcatttgagggcacaaatgaaaaagaaaagagcaggccaggttttgaagtaactaattgtataaaataaaatgaaaaatgtgtaaacatacaggtgtggactaaacctatttgacattcttccatgtattcatatagaaactatttgaattctgcaaagcaataagtttctgattttttttttttcctctaagctacttcatgcattcttacaaactccatttccttttaaacacagtcaaatttattagggaatatttggtcaaattgttaaaagtatttctctgctacctgagttcaaactatactacaaggctacagtaaccaaaacagcatggtactggtacaaaaacagacacatagaccaatggaacagaatagtgatctcagaaataagaccacacacctacaaccatctgatctttgacaaacctgacacaaaaacaagcaatggggagaggattctctatttaataaatggtgctgggaaaactggctagccatatgcagaaaattgaa

SEQ ID NO: 113697 - DNA, 1068 bp, Homo sapiens
tattgaaatctgtcatcattctgtatttaaatttgaatgctgctatgtgatcttagacatggaggcagaaacttgcatagaaatgtaataagaataagaatcttgaatagaaatcttatcgctttctttttgaagaatttgaaaagcaattagaattgctttcatattataaatgctcaccattgaaaggtgcaatattaatgaatctttatattatgcctctagttatctcttaagagttactttgataatatagaccttttgaaagtgccacactgatggtttcaggttgcctgtcagtgtaataatacataatgcttacagttatggtgtcagttctttattttatgtttagggagcacatatctcagaacagttcaggaaagacatagaaaagcagttgtcatttataaagtgtgtgttatgtgccagaaagtcacctagatgttttcttatggtttattcagttctaacatcaaccttataaagcatgaggtactattatcaatttaccaatgaagaaactgagatgcagggattaagtaatttgcttaagaacaaataactgatttcaaagtccctattctatccactctactccccctataataagagcaggtgtaaatgtctatgttgttgttaataaagacttttacaaaatgaagttctaatttagttaggatgtttttctctttttcgagacagtgttactggaaaggggtcccaatccggaccctgaaaagagggttcttggatcttgggcaagaaagaatttggggtgagttcatagaataaagtgaaagcaagtttattaagaaagtatgggaataaaagaacggctactccatagagcagccctgaggactggtggctggctgtttttatggttatttcttgattatatactaaacaaggggtgaattatttatgagttttcctggaaaggggtggggattttccccagaactgaggtgttcctccctattttagaccatacagggaaacttccagacattgccatggcatttgtaaactgtcatggcgctagtgggagtgtcttttagcaat

SEQ ID NO: 113698 - DNA, 1001 bp, Homo sapiens
aagggtgaaagaaacttggtatgcacgagtcaaatgacagactccattaagtgtttccattaaaaggattgttgcttccccagtagcctcttctatacagtttcttcaatctcatttcagatcatatttctgtaataattaaggctttgagaaggacatcctatataatgtaagacacacatttaaagcatagaatgaaaaaatgaaaaccttaggcattttgagcaatatttcctttacctgtcatatatacagcatgttctgaaatacatggagtgtgatactggtgaaattaaaaaaaaaaatgtagcactttaaatttttttccttaaaggttgttttggtaattttaaatcctgaaatataattattacggggatattaagctcaaaattattctaaagttatcttttgttaaatgtggtttgttaagagatttcccattgttcagtgttagtaagtggacagtgaacaaagaggacagatttttgtcaagcataaacaacttttgcatcctgtttattaaatggaaaatacctcaatgaatgtctgtgctaaaagtagattccttcaggtttttagttttgtcctattaggggtggagtcatggaacaggaagaaagacatccagtaaacaggaattgtgtgctaagagatacattttgaaagggaaatggaggctcatgcttagaatttgagttataccatttcaccattatgagtaccttttcaagaatgttagatttaatggagtgctaaatggtctttttcattactgctatgagtgataaattgtcttgaccaagatagcatgttgcagaataaagttttgaaagttgacagaggtattttctcagattcattcattatcatgtttagcttgatgttctcaacgttttatactattaggagataattttccattttgggtagaaatagttttagtgtagttaaatatggttagtatagattcagtaatttagtatagccatttgttttta

SEQ ID NO: 113699 - DNA, 1125 bp, Homo sapiens
tctattcacctattcctgtacatcatttttttttctcttccacaatgaaattttttgagtacgatgtaggaaatcatcttaaagtggagtgtacttacccacatcagggtttaaaaggtaaaatttcttctatagctttgtctatattacatttttacccttccatttgaaactaattagaaatattagtgatcaagtatccgaacctaattagaaattaaagttttttttaatcataggttttgaattcatagcttaaaaaaatgcttctgattgaagataagatgggaatttacatgggataaaagaaaaaagtaccttaaatgaggacattcccatgtatgattaaaaaaacattctggatgtaaacattaaaaacggatttctgtgtgtcatcctaaagattttgagattcatgtattaatttgttttcagaaattaaagggattacaattgttagtaaaattgaacttcgtaataatattttctctggtattagtttcagaaagccagtgattagaagagatgttaactgtgtttggaggtagtttctttatgaatagttaaaattgtattttcaaaaatttgtatcataaacaatatgtagtttccctgtaggttttctttttgcgaagtgttacttaattgaagaaataatttaggctgggcaccgtggtttatgcctgtaatcccagcactttgggaggccaaggcaggtggattgccgagcccaggagtttgagactagcctgagcaacatggtgaaaccctgtttctaccaaaaatacaaaaattagccaggtgtggtgacacttgcctgtagtcccagctactcagggggctgaggcaggaggatcgattgagcctgtgagcccaagaggtcaaggctgcaatgagccatgatcacgccactgcactccagcctgggtgacagagcaaggtcctgtctcaaaaataaaaataaaaaaaatttagattgtgatggcagttatgatagttaatcacagccaaacataattgcttatcttcatacatattaaatttgattccttgtgtgatcaggtttgatgcataaaccaaggatggtgatacctttcaagaatctaactggtgcttaatagagga

SEQ ID NO: 113700 - DNA, 1065 bp, Homo sapiens
tatttccaggtattcttgaagcacacatacctatgcgtgcatttgatagccagaacattacagtgaatgaccagtgaacagtcaggaaacaaatccatccttggcctcccctttttatttttattttccctccccagttcattgcaaaggaggcagactagatgccgggcagccaggccccacacatggttcagcacagctggtggttctgccaagttgggtttcatccccaagagcatgcagatttattagtacattttggcagaagacatcactttatattaaattattattgaactgtcataaatttaaatagtaaaagggtatactttgaaaacgacacctcttttctaatgataaaaggacctgatgatacatgtaggatacggtcacgtttcattatgcgtaggaggtactcagtaacagttttccaatggaaagaatgagaagttatgggtatttattatttttcatataattgctttgtaggtagcttgaggatcaaaggctagaagagaagaatatatgtgataggatatagaagttttgatatcagctggcagcagtggtagagtggaagaaagcatttgtgaatttgggagtaagaaaacttgtcttctgacaaccgttattcataattgaatttctatcttgcattgtggccatttgtgagaatcttttatctattctagcaaactgagtttctttgaggaccagagtatattgtaccaacctttgtatccccaaggcaacatcccagcacagtgctttgcacagagcaagtattcaatactttgaattgaccagtgaactgcaaatgaagggaaaggataacatctgaacagattttggaacccccctcaactcccaatctatgtggaaatttgagactaaataaaagttgtcatttgtattaggaaaaaaaatgtgtgtttaattaaatactcaattacacgtcaaattctgctgttctcttgtttttaaaagtttatttttaaaattgatacataaaaattataggtatttatggtgtacaacgtgatttgaaatatgcatacattgtgg

SEQ ID NO: 113701 - DNA, 1089 bp, Homo sapiens
tactattggtggttgactccttggtaaaacattcaagatgggaaaaacagatgtcaaattatttttgtcttttgtcctagaaaaatggctacaatgaaattttctatatttaaaaccttccattcaaagagtacttcttttttgctaagaggcaataaagaactggtgtcctcagtgacctattccgctttgcttttattaagactatctaaactctaccgtggtaggactattgagatttgtacagtgaatgttcaaaatgagtgctgttgatagtgcctctggaattaggttggtattagaaacttgaggtttcctgagggtgatttgtgcagactctatggccctttgttgcggagataggagttcagtggaatgatgtatagcagcccctgtctgtccacccccagctcaacaaggtttctaggaggtttaactggagccagactgtatttgggaaatgaattgaacaccaagctgaaggttttaactctactgatagaggagaatttgtggggaaggtgtttggttgatgttattttttaattgaaattgaagatagttcaggaatcattttattagagagagagtgtatgtctgtgcctctgttctctgtgtgtatacgcagctgatttctgtttttggttgttttacttaaatgttaaatgtaatcattcacagcctgctaacttttgatggaaaaaaccagtgcaaatatagtatgttaatctacacatgtaaattaaaatttgactacaaatattgcagtctgagagtctattaaaataagatacttttaaaatgaagatatcttttgttaaatgtatttttgctgcctaagagatggcaattctgggaagctgtaggcttggtggtgtaatacattgttctgaaggggaaatatttatactgactcttgaaaacaggaattgcgaactgattttggacactttctcttttcttatttgttaacaaaatgagtttttggtgaaaactaaattgttgcttcttctaatgaaaaatcgtaacttaacaagtgaaacttgcttacgggatcatttttcccagggacgtgacaattaacatggt

SEQ ID NO: 113702 - DNA, 2355 bp, Homo sapiens
aatgtagtaactgcctatcattttctggaaacaggggtgtgaaaaaattgatgtattggagtattatgtttttaatcattttgtaaattaggattgcccaccagtatatctgcttgactcctgtgtattcccttgctgggtgtaggctgacttgaataagtttacattccgatactgagaattgcattccactgggtagttctgacgtacaagaagaatgtggaggcccatacaaagggcaagattagggacactgatagaagaggcttctatgctctgtgactgcctttcgtggaaagctcacactggcagaaagtgctcttgacccaacttgggagaggagaatgtggtcacagaaacttcggacaatttggccttacaacacctgcagcaccctgtctggtgtttcattgcctatgggtatttacgaaaactaggtaagacttcacattcccaaactttcatgcggtgtgggagtcttgaaggaaagttttgttttctctatattatatggaagactacttagtaattgtttgtcttcatatttttggtattacagagtcataccatttgcacctgtagaaatatttaacttagtttcaattttgctaacaattttaattcttaatttttaaattgttttgtataaaaacttcagcaaaaaatttaatgagaatgaaagtctgaattgttatactgtttttagagcagttgttccttagtcatactgagggagtactagcatttaggagtaatctgtttcatatgctgcaagtggtcttttcaataatcatttactggtgggcttaattttttttcttttttgatatggcagagaactcaaagattgaccagaagtgaacctgcatcacttctagttgtcatcttgtggttgtttaatatcagattttaaggacatgctgaaattacgttgagattgaattgttgaaaggcaaggtgtacagcgtatttatacagaacaatttagaagggtttaaattagaccatagtgatcacattttcattctgtgtagaaggagaagactatcagcattcttaaaacacatataccatacttctcccttccaccaccaccttttcctactttatggcctctaactagacacctcttatcaaacgctggtgtctgtttagaaagaactaacaggtttttaaaatattcaggctaactctcattgataactgttaacctacatctttcttgtttctgaaagacagctattcatatgtgtgtgttaatatgtatatgttaatagcatgtcttatatacaaatacacatatacacacaaagactgaaactactagaagaccagaagtaacttttgaaagatatataattcaaagtagaaaaggtaagctatatatctttaaaaattaaggagtctgaattttaaaatacttgtttatcttggtaagtggtattatgagtgccatttcaaagaagcagatgtcctactagttgaagttctggcagtagctccctgaagagatttggtctttataggtttgacattcagatctttgcgggggtaaccctaaagctctttatggtcatttgtaattttgctgaatttgaattgccttctgaattagaaatgctgatttgtgtttttcactcaactagctagtgagtgagcctggtcattgagaattcacctctcaatgaaactcacttctcaacttgtcattgggttatagctgtttgtgtacttgtcatccatggaatataaactacttaagaagagggactatatttagtgagtttttctgtaaacgctgtattgattactgagtttatattggtaatattgattctgttatgtgttcagtgaacatttggaagaggaataaatagcacaataatatatatgtcagaaataatattatgtagtcatgcactgtgtaataatgttttaatcagtaatggaccacatatacagtggtcatcccagaagattataatgtggtatttttactgtaacttttctatgtttagatgtttagatacacatataccattgtgttataattgcctacaatattcagtacggtaacattctttatgggtttgtagcctaggagcaataggctgtatcatctagcctaggtttatagtaggctataccatcttggtttgtgtaagtatattctgtgatggtcacacaacagtaaaatcgccaaacaacatatttcccagaacatatctccattcttaagcaatgcatgactgtatgttaatatatattattactcacacatattattttgttatgtgttatatgttatgtatataatatattctcacaaatacattatatgtcaaatttaaacaa

SEQ ID NO: 113703 - DNA, 1094 bp, Homo sapiens
agtggcgcgatctcagctcactgcaacctccacctcctgggttcaagcaattctcctgcctcagcctcccgggtagctgggattacaggcacgtgccaccacacccagctacttttttgtatctttagcagagatggggtttcaccatgttggccaggctggtcttgaactcctgacctcgtgatccacccgcctcggcctcccaaagtgctgggattacaggcgtgagcaactgtgcctggcctaaaatttttttaaatgaggaattacttttaaacaacactatttataaaaaaagaaaccgaagtcatggaatgaaagtagaaggagaaacccttgcgtaacctaccaaagccattctgttagcactgtttttgagtcattcaggatttggaagtttttacagatttccatcagggtttttttttttttttttttcttttttctacgttgcttaagacagtgtggcagttgctttcataatgtgtggtaatgtatcctgtgagatctttcactaataaatcagtacaaagactgctgaaaatatccttccctttgaaactacaggaaattcaagagttacccatattgtcctaagtggaactgaaaatgcctcctcataaaagaaatgttactcaaaaccagttagttccagagaagttcagagacacttgaagtttgtctagatagttttctacagatgtctttgcaagatgattgaatatgggttatctgtaagtttctttctgtatctaatattaataggaaatgttgtgtttggagaaatgaaattttggggggttttatttcaggtggactatatggatgaaaatgaagaatattttcagcggcaagcttcccatagacagtctcgaaggagatttagaaaaatcaaccagaaaggtgaaagacaaacaattattgacactgtggatccttatcccatgggcaaacctcctttgcctagaggctatcacacggtaagttatacaagtataatatttttatttatttctagttttttgttggggttttgtgaaaagatgtttaagttttccatttttgacaaatcttttcaattatatatatataca

SEQ ID NO: 113704 - DNA, 1055 bp, Homo sapiens
aactttaaagttcaggaatctcaatgggagaacattttgggaggccactggtaaaatttcagtcagatttttttttaaaaggttggtcaaaaaggaaacaaagtttaaaatctcttgtattttcttatttgcactttatttttaacaaggtttcttgcttttatttcattctacattttaattgaggtctgtaataatctccttgctcacttctttgatgccagtacatgactaagtactatactaagtactaaagtacattactaaagtactgtactaagtactaaaatctatgattttcattatgagttctttgaagatctagattacatttggggttatccgggaattttgagtcaaggaagaaaaactgatttatccttgaaaactaattggttaagtaactagtagcattttatgcttgtgttttattgttgtacagggaaaagatcatgaataatttattcacattggggaaatctatcattgatatatctttggctattagagtaactttgcctaaaagtatgaattttatgtataatttttcgaattaaaatgagacagttcctttatgttctatacaagagagtacgtattagaatgccacaggtgtcatgattgctatattggtttttggaagcactactaatttttaaatgatgtggtaaatctaaaacatttttatgtaattttaaaattttaagttcactaaaataattttaaaattgtacagagttttatgtacctcagtgttttgagcttttctctgaaaagagtacacttaaaatatatataacatgatattttaaaagataaatcaatatgtaattgatcttcgtctttttttagcataaattaccagtctaattccaacttagaacttggaattgaatttaaaatgcgcactgagttatgatgtatactttaatgtacactttttaaaattagatgcattgcagtagtttaaagtggattataatgattttctttagaaacatgaatactcatagtccatgtactgtgttttcaggacatttttcaaggcaagtgta

SEQ ID NO: 113705 - DNA, 1559 bp, Homo sapiens
aaagtctgcccgtttttcaagtaagtgcatttttaaaagccccacatgggaatttctcatggacttacaggcttctttgtttttctgcatgtctccatctcatgtcatcttttaatctttcccttctaacatgctccatgtgaatgtttcttatagatagttgccacataattttcgtatatttcttatagatagttgccacataatttttcaattacaaatcagatgccacataaacagtttgccgtcagaaactttttttttttaacatttccttggaacgtatctgtggagtaaatcatggtgatctttttgaactcccagttaggtttttctgatactgaacatgaactcaacagattctttgtgtttctaaagactgtatttagattcacttagatgtttagttagcatttcctatgtgtcagccattgcattggtttctttcacattttatttcataattaaattattcttaataatgaaccagaagtgccatttcactttatgaaagtagaaaaatgaaattttagcccagatttcctctgtgactgctttgggtggggtgtgtcaaggacttgtgtgaggtatacccaaagatgaaatagatgacgtgaaaatgtaagattgagttaaaatataaagtttatcagataatcaacttttcttttaaaagaaaatgcactattaatgggggatgtattggctttaggaaaagagaagtaaaacttctgaccatatctaccatcttttattttgcattggcttagtgcttaattagtttgatgtactcatatagaaaatagcattttaaaatgacatttttggggggaacagtgaaacactaaaaatccagtttgtaaaatttgttgttttctcgtatcaaagaatgacttctttctgctatacccacaagttttccccagcctctatggtttttcctctgtggtagtggggagagggaatatttaactattaagtgaagtaagtggtattaagaaacttagaattctattttgcattcttctatactactaactctataatcttatacactttatttttctattaaagataagtacattattctcttgattcccttgcgttttgatgaagtttaattaaatgtttgtaaagcacattgagatctatggttaaacactgtatatgttctaagtgtgattaatcattactgagaacagaccatttttctcaatttcatagtaattagaaagtgaatactttaggtggaaaaaaaaagaatataatgatattaaatatagcctggaaagcctttgcattaagtagtttcctgaactatataatctccatttttttggagtgttgttactgataatttggaagtcattggatgttattgacagggtagaaagttcttacatggttctttttcttaacaagatctagttaatgctacttggtaatggttaaggaatggggtaaatataacccaaattagagtgaacttcaaggtaagtgtgattttttcttatttgtataaaatctataatatgggtttctcctaaatcctttgttta

SEQ ID NO: 113706 - DNA, 1035 bp, Homo sapiens
tccatacaggccacgattcatttgttagccataagtatcattttcatcatacataagccccttaaccaagaaggatataatgtaacttaaccatattttctaaattgctattggtcacttaaggccctctataatctacattctttcccttataaacatacaagattgtgctcttttattttaggacaagctggcttgattataaacacttcaggctcattttcttttctcatttctcagcttgctgtgttcttggcttgactttgacttggtccttatctcttcatatttatctctatcttaatgaatcaggatcacttaatatgcagtgcttaattttattaattcttctaattggtgcttataaatttgtttggtctttgcagttagatgacagattacatctggaatgaattccatgtgttcaaagggtatggttggaatttaaaactgtttatcagctgttaagagtacagtatagagaaggattttctaggctggaagaataacatgtgagggcccaaggcaggaaactatagaagaatatgagggtttgaggaaaaacaatgaaatcatcactgttagagtagactgtgttagagagaagtaggtcagtacaggtgatggagtggaggatgttagaataccagataaattaatgactattttgaagatgcagcaaaggagtgtaacctctttcttcacctctccttcctatctttcaactggaacagatttaagaaaactcaattaacaaaaaatgtgttatattaccatgacagtttgaccttgtctgtaaacattgggtagagtgtctctttagtatattttgattgatggattttccttagcaatgtagaaaaaaagcaccaggactaattgtagaggctaggttatgcctcttttgggtaagactccacctcttcattatctgatctttattttgtctgttataacagatatatttcctgagatgaaataaacttatctcttggcatgattttccactgtgcttgctagcagaggggactgaga

SEQ ID NO: 113707 - DNA, 1069 bp, Homo sapiens
gatgatggattcttctttcttggcactgctagtggcactatattcggtctctactctctgaaaagagtgtatgtctgatcatgatggctgtggtgttagagtaggtaggacaagagcacttccctgaaggagttcgtgtcaagtgctggctttattagtcacaggtatatacattactcctttctctgtattgttccctcctttaagtgtcatccaaagctgctatggaaaaagatattgtcgtcaagtttgtttataataaagttaatgagtgactttgaattgtgaaccctgagcctgagaacaaactggatctatattgaagtgtcatacatagtgtagcaaaacttattaacaatactcattgtatattatcttcaagcattttaataagcatatttaaaacaaaatcttgatttttttcaactgtggacctctacacagcaataggaaagaactattccaactaggttttttgtgtagtaaaacaataaagtactttatttaccaaggaccttgatttgagttcttgttctgatgttagctagctgtacaatgcgtagacaagtaatttaactacttctttttttttttttttcctgagacggagtctcggtctgtctccaggctagagtgcggtggctccatctcagctcactgcaacctctacttccgcctcccgggttcaagcgattctcctgcctcagtctcccgagtagctgggactacaggcacgcactaccacgtgcagctaatttttgtatttttagtagagatggggtttcaccatgttggccaagatggtctcgctcttttgacctcatgatctgcccgccttggcctcccaaaatgctgggattacaggtgtgagccaccgcacctggccatcatttaacttcttaaagttattgatttctcccttcaaaatggagatcatgattgtaatactggtcttacctcacaatattgttttgaaaattattggctgggcatggtggctcatgcctgtaatcccagcactttgggaggctgaggcaggtggatcacctgaagatcaggagttcaagac

SEQ ID NO: 113708 - DNA, 1031 bp, Homo sapiens
attcagagatttatttttctttatttgattttaacttcatagaacatgattttctgttggacatcttagcttaattacgatttaagatcctttattaactactctttacacattgatgctggtttgcaaaatagctcataaaagatcataattgatatgaaaaatttctattattttttccctaagtacttcaattttttcccacttattaagtgattttgtgcaagtcgagctgcttagtaagacctgtctttgtagtcatttcgtgtgtgtgtgtttgcaaggaggtatttttagatagtttagctgaacagcaatctgacgtctttagaggagacatcagttcattatgtggatacaaattctatgctttcggcttttatacaccaagtcttaatttaaatctgtttttcttgccttttctaacgaaagagactacatcatggtatgtattctatttcttcctaaggcttgcctttctggttaacctttgcttaagaaatgatcaaggtagaaatgtctttatttgctcacaacttaatatagattatagaagcatgggatttggggctgtatttaaatatgccattatacattatgctatacagtgtttttctattgcaatgtgattcaaggatttaaaatagtcattatggggctcataaatgctgcgttcttttaagaagaagaatgtaaaggccaggatgtgggagttctatacttcctataactgcacatactgctgtatctgttaaaaaaaatgcctttttctttgtgaaagataatttaatgttgagtatgtaagaggagcatggttatttgctttcttactgctctaaatacagtgtttataggaagttataatatcttcttttatctggttctcctcacccttttcaaaatactgggaaaacaagctcttaaggcttaagcaaattcatgttagttgtttgtgaccctgatctcaaaagagataatacctttggttaatgatatacatagtacctttggttaatgataaacgtcgaatt

SEQ ID NO: 113709 - DNA, 2099 bp, Homo sapiens
ataatagtttacattgtagaaaatttggaaactactcaaattaatatttttctgtgatataaaagcaaaatctaaattctactttaagcagtggcatagctaattcacctctcttgatatcggttcctacagctgtgaaatgtgaagattatactaaatgaatcctcaagctcttccaggtctatgattgtgctttatacaaaaacttgtatttgcataatgctttatattaccagaattctttcacatctgttttccatttgttctcacaactgtcttgttaggtaggcagtacagaccttgttatgtctgttccacacttgtgagtaaactgaactactaagaatttaaaattattttcttgagttaaacagccatcttggaactagccatgtattctctctataatttcatatcataatctttgacctcctgatgctaattcctggtgatgttaagtacttagtcaaagtaagtatccatatttcataagttaccactgcagtaacttgagaattttaaaaatctgaccttggaaatttggttatccactcacataatctgtaggaagccagtactaaagtattgtagcgatttgtgatatatacctaatcacctttatggtgcttccagcatatcaaatttttacttttttaaaaagttgaatagctgaatacagaggcttctctaaagtaccttcaggttaggttttgaaaggcgatttttaagtttgttgtccagatggcatacctcactccattctaacttgtcttcctacttccattctaaccccttacaagccattttccccaccccctgccagaatgatcttataaaacaaaactgggtcttgttaacttcctgtttaaaaaacccagtgacttctcattgcacttacagagcctactttttggtaggcttaatccctactgcctgaccccatttgtaccactcagcctttctcacgccttaccttccagtgcatgaactcctcagaaccgtcagattctgagtgcatgttttctccctcaacattctcactctttaccttccagtcaccttgaaattgtttctcgaccattcctaggtttatcccacctgaaggtctttactctggatattccttctgtctgtaaagctttccttccacatctttggctggatcctttgtatttattcacctctcacttcagatgtaattttctcagagcagccttctcagatcacccagtcttaaatagtatcctctccattcccagccatcaccatctattacatgctcttcttgtggtattgtctctacagtacttactgatagctgaaatctttttttaaaattttttattgttacatattcctcctttccccttctcccctcaagcccctcctctctttaagggtgtaagtttcagggagcagggattttgctaatcctagtcattgccatatcactagttcctataacagtgaccggcttgttacaggatgtcagtaaatacttgttggataattaagtagatgaatgaatcttatggttctgagtaactttatatatcttcatctgacaggcttcttgttgagatctatgataggaagttaaaaatatgttgagttcagaagttttgtcattaatttttttgatgctggcttccaggaaggctaaactaaatttattgcataactacagttgctgttcattgtgttttagttttattctggtgatcttacctataattgctgatggaagggggtgactatagagctggtaaggaaaagaacattgggatcaaacagtccctgttcaatttctctcagcctcaatatcttctactttaaactaggtagggttaccagttcaatgatctgctcattaaatacttactataccttaggtactatatgagaagctaggaaaagagtgatgaaaaagacacacctagagagggcattggattattaaatcagcagctactgtaaaggtatttaagttctgtgacaggcagcattctgggtatcacaggaacatcttacaagaatttctaacttcaggaggagggttcagagaattagccaggccaggggtgagagtgttcttcccg

SEQ ID NO: 113710 - DNA, 1047 bp, Homo sapiens
gaaagagagaaaagtcagtcttaattctagaacaaaaaatttaaatgtatgtgtcttttaagccagaaaaatatttctagtaaagttgcgtgtgtgaggtgattatgcagtttaatgtttgtgggcttctagaactgcttatccagaagtctagtcctttctttctgagcttgtgatctttctgtctctctttctacacccatgcttcaatctccatggctctcacttacaggaagaagaaatggcggagtttggggtaagtggtggagaccttgcatacccacacacagttcttattctgctcattgcattgttttcttacctgctgtattttctgatgctttgcatttttgcatttttttccttaaccctcgtgctgtagcagaatttcagatggcaaattgacttcaagtttaatctgttggggcttttgcttttgaagtcatgatccatgagagctgtgaaatgattgatgattgttctggggaactacaggccagtttttctgagctcttagaaaaattttattttcatataattggtgtgtctcgaaatgcagaaagctcaaagtagggggaggggaggaaggatattagaagggaaaagttgtgcaattaaaatatttcacagatatgtgagaaataaatatatttaatataaaataggtgcccccaggtgttaaacccaaattttttacagctcaactaactactattttcattctgtataaaccaatcctttttaaaaataattcttaacaattcatgtgctcaatggtttccatacatatatgtttacatttgcatgattgttttattaacagattgaccgtattactttaaaaactcaccacattcaactcaaggcataagaagacaattttgaacattgtagctaattttatttaaatttatgtataatatcctctttaggagaagtaattttaatgttgcaaatcttaatgattatagctgtgtattcttgcatgagcttttacatgtaattattgttttctggcacctgtgagagaactgccttaaatgctct

SEQ ID NO: 113711 - DNA, 1030 bp, Homo sapiens
tctaattgtatttatttaacaataattactgagccgctgcttggtacttggaactgctctatcacagtaaaaaatttatactctattaatgcttatatattattccagaagacagtacacaaaatcagttaagtaaatcatagaagatattagaaaatgataatttctataaagggaaagtaaagcagagaagaatgacagagagtctgtggaatggggtggtaagttccaagttcacatcactcttgtgcctttaggatggaaagcttgtctgtcttcttcaacataggatctccagtcccaacacagtgactgactcataggagcttcttcctaaaatcctggtgcttaataagaacttgttataagaataaaatgcccatgatcactacaagttgttgattctccctgaaaaaaaaatttaatagtatagaatattccacttttataagcaggtaatattttaaatggcaagaggataaacttttaaaacaccatagtgatattttgtttgctcattagtttttttctgaatgcttcgagttttaaccacatttgacctatttttaagaaaaaaatcaaatcaggtcaatgacatttatactagaaatctaaaatatgtattttattcatatatgaaaaatagaaatgcgtttcttcaaaattaaataactgattctattatgagagtcttaaattttttttatttttaagccatgtttatgttctattacttgaagggaatattttgtgttcaaatggggaaagagtaaagtaaaaatttataatcacatattatattatactttaatttgtctttacttatgagattaacatatcaatctttaataagaaaaattaatttcttggctgtcatgaactgtatgtcctcaagtgttaaatctctgggagctcaaagttgtgtctgtataatgataaatgcagtcaattaggttgtcaattcttatcaatgaatcactacatttaaaaaataaacaagttgttaataaaatgtaatgaatctctcatc

SEQ ID NO: 113712 - DNA, 1016 bp, Homo sapiens
aaccgtgacttgaaaaacaatttctctgcatgaggacacaaactaggaaaaactgtgaaatgggaactcttagcatggattttagtcaataaaattacaacaacaataaataaaaatccaccaaactatatagtatcatttaccactggagacataccatgaaatgagaacagagacaaaggcagcctaaaaacagatgcccaaaaccacacaaaccagttgtcaattcaggaagaatgggtggatcgctgataatgaacaggagggaattgagtgaacaatccgaaaactgaaaaacaaaatacggggcaagaacagattaatactctgacacactgcaaccttttataccagtttcttaataaagcagcttgcacttgaaaagtacacctagaaaggtactcagtaaaattgctgctctcctgatttgttaacagggatgcactcttgagtcttaatcaatgtaggttacattgatgttgattagagggctgttaatttgcagctcgtgatcaaaacctgtatgtgtgcatgagtttgtatgtgtgtgtgtgtgtgcctgtgtgtgtgtttccagagcttcaagaaatcctaatgtgaagatcctatttttgcctctatcagtcctcatccaggagcatggtgggcagagctgtttgtccccctactgccctgttcactgctgaaggattcctcacaggcttcagtctccctttctgccagagtacaaaacaggaaaaggaggcacagcccttgtatattcagaggccagaatttcctctgttttcacgaatccaaaaaaaatctgctttccactttatccttaaagactcagtggcttgaaagtctccttcaaacctgaggttctatcattttatgtagtaaacacttccatccgctttttagcaagagattaactatatataatctgaaatctttaaaatagcatttaaaatgatctaaaaatgccaacttttaaggctctctcagaaggaatttcccaaaatctgtcctca

SEQ ID NO: 113713 - DNA, 1030 bp, Homo sapiens
tttttttttaatgacttgaaagtatttcacaaggtatcataaacctattttagcacagatttccaggtcagttgttcatcaaaaatggctctgaaagataaatggaacatgaattctctttttcttggaactggttttgagaggaccctatcacctctaatttggaaatcatagcattttagaaaaattattattttttccctaggataataaaatttgcttaaaaaaattcaacttcagatgacaccaaaatttggctaccaaatgattaaggctaatcaatctgcaaggtttttgggttgatctttatatgatcattcagtaagagtgtatccatgctgttctatccataaacataccagagtgctgacctttacagatagcaacgaataatggatgatgtattcatgcgtgtgtgtgtgtgtgtgtgtgtgtgtgtgtgtgtgtgtattgcttccagggagtttaaaaataataagagaagacttagtatcctaggagacatttgctttccctttctggttttctctactttgtaaaatagttcaggatgagaaagccatctgaggccatgtacttagatttacttgaaagtatgaaaaaaaaaaatagaagcacaaacctgtaaatctcttggagcaacaagtggagaagtacatataagttgctgttaatatttccgttaatgaaccaacctagtgaaattagagagccattgaaatttaatatattcatttattcaatgaacatttgttttgtgcttattattggtcagtcatttgatgctgggaatgcaatcctaagtgcaatattagaaaatggatgaataaagacactaggtgctataatacaagtatatgtttgtacaaggtatggtgggaacatagaggtgagaaaagtctattccaccttgggtacagatgggaagaggaggaaggtagggaataattcacagagaacatgatcttagggctgaatcttaaaaaataaaagataaacctgagaaaagccgtagaactgtaaaacagct

SEQ ID NO: 113714 - DNA, 1049 bp, Homo sapiens
tacgcatattttagttgagtaccctttcatttctactcatataaaggtgaaatgggaataaattttacattgcatatcttacagttagttccattactccatctttcaaacagaacaaactgaccttgtttatgtggtaaaagctttttatttatattgaggatagatgggccaaacattgtttctaacaagagatatgacccaaatagtaaaatagagcagatgcaaagggataaaatattagtatagaattcctattaaaacgtaatagatagatatggtggtgtgtagtgtttggatgatagagatgaacttctaaaatgttctcagtgtcagtagccactacagtgtgcaaaacctattattgcagctctttaaaccttttattattgcagcttttcaagtgttttattgtgtgctcccatgacatacaggagtgctgggaaacatttgcactctcccccaacccacagctcttgcaaatgtctgtttgattatgtatcatgcagcatttcatctcagacatgatttggcactgttaggctcaattatataagctttcttaatagttgatttattcaaagcaaatgattaattttctttaacatcagtttggtttttgtttttgattaggtataattgttcgtatatttgttggcaacaacgtaagttcagatgaattctgtttagcaagattatgggcagaaaaatatttaccggcagaagaaagtagctgtgggcattaattttattcattcaaatcctattaaactatatcaaattgctgttgtgtaggcgatctaatatatgactgtggaatatattactttccatatttatttttattagtccgatctaatatacggactgtggagtatattactttccgtatttttcttcatagaatatcaccctgtaccattattccacagaacacactgggaagtgctgtcatagaagatagctggaagacattcatggcagtgcacatttcttggagatgtgtttagtcttgctaagaagacaattagaagatcatgggagccaga

SEQ ID NO: 113715 - DNA, 1693 bp, Homo sapiens
ggaccttactattaggtgactatgcatttccagagaaatgtggacttttcatattatgtggtaaggatttttttttttcaagagtgattatggagctagatttttaaaaacactgtaaaatactaaatgattccttctgttgtaagttgatatatatttgtaacctttgtgaaattgtattcatatgaaaatgtcagctcaaattcttgggagaacattaaattatgtaatatttaattaaaattttgaattcatgccttctccctcccaaccccacccagttaaactatatatatatatatatagtaatggatatgggacaagtttcatcatgggtaaaatatatggagcacattgattttcttgctataatctgaatataagatgaagtccttttgagagtctttaaactatttttataaatttatactttggaaatcaattttaattataaatgtaatttgtgagtaagtttaaatgaccataatttttctttttaaagcagttgagggatatagaggagaaaattcttatatattggtagaagctctgattatagctaaagtaaaaaatatttattatgcataggcaagcttccattatctgtgcaaaataattcctttatttgggcactgttcagaaggctttactatttaacctcctaaaagggatgcaaagattattcacaataagatctatttagggattttgtcttccatatttgttttccagatcctcacatgcagactaggttccataaataacaaatagttattgaatatctgaattaagagtttttaattaaatgagtaatgactactgctttatattatgaagtgtcaatgtaagggaaattatgagttttagaactagaagagaccattgaaatactccagttttcatttagtaaatgaggagcctaagtgttccaaagaggttaaaataatttaactaagatcactcagctagtgagttgacaaggagttgaacctagttcttctggttttcttattagcagtttccactaagtagatgtttcccaatcttacattcctttacacacttaggaaacagtatttgtatggcacattggagtaatctggagaccacttagcacaagcccatgcgctctggttgcactaaggccccacttttcttccccatgagctgaggggactctttgcagcattcctagtacacaagttgagaggctctgccttggtataccttaactttatcatatgagtactttcttcattatttttaaaaatatttttgcaacttctctttagaagttaccttcacaggttatagcacagtctttttatgattgttagaatattgtaagagttcatgagattatatctaaaagcactaaaagaaaaacccaaatccttttccacaagaatgggaacagtaacatgttattattagtcatcaagctgttctgatcatcatggcatttaaaaacctgtccatttcggccgggtgcagtggctcatgcctgtaatcccagcgctttgggaggctgaggtgggtggatcacctgaggtcaggagttcgagaccagcctggccaacataacgaaaccctgcctctagtaaaaatacaaaaattagccgagcgtggtggcacgtgcctgtaatcccagctactcgggaggctgaggcaggagaattatttgaacctggga

SEQ ID NO: 113716 - DNA, 1033 bp, Homo sapiens
atttgtatacccttattttgccttatttatttataactcttgctctgtacctaaaattatatttaaaaaataagatggtaaacctgtaaagaatgaacctgtgaaatgtttagaacagtgcttgggtgtgtattttgaatgaatgaattatggaacattgtcttctgttttttattggctctgataatatatataatttgcttagtccttgatactcttacctttggcacccttttgcatctgatactatgatgaattttaagtctaaactggaagtcagactcatatctgaaggctgattactggcctgtgttaattaaagtcattaagcatttatcaaaaaatgctttatttttataccatgtctaattcagatatagaaaatattaagtatcaaaaagacaactttttttagagtcattgatgcataataggcttattttcttcacctccaagtatgtactattgaattggcaaattcatgtaacataaacctattatatacttttctctgcaaggccttagattttagtgatgatgaaaaagagaaggaagccaaacagaggaaaaaatctcagattcaaggccggaaaaaactcaaatctgaatttaatgagcctggtgagtgaatacaatatatatactcgttctttatcttcatttacatctatataagtttatcaataataaaactgaaggaaacatctgggttctctctgtttacctcctagcatcctgctaacatttagagccattacatagcaggaggtgtggtagttttatgagcttaagcagtaaaaatggcttcctggggtaacagagagactaaaccttgttactcgtgcttgtcagcacttttttcttaagatacctatttgcttccatttttaggattttatgatcaagtacttgatgaacccctaaatcacagtgtcttatttttaaacatgcattccctttaccttttttgaaaattaaactttctgagataaccatagattcacatacagttgtaaaaataataggagaggtg

SEQ ID NO: 113717 - DNA, 4009 bp, Homo sapiens
ctcaaaagttaccaattataatccttttctgtgtactttacaagttaaatgagcaataatttaaaaaaatcataatttgcatcgagttggtaccatcaaaatgatttgaatttggtgaggaacaaacttgttactattgtttcacattcatagaagggaaatctggaatgagcgagtgcattttaatcaatatatgaagactgaatatgtaaaaatgacataaatataactaaaaaattattttattgccctaacactgacaaaattaccttgttctggcaattatcagtgggatttttaaaagaaaacactgctgacttttcaaatagttattttacatgttaaaagaggcctttatgtttctattacagatattcgagatatttggacctgttgcacatccattttatgtgttacggtttaattcttcagatcacattgagagtaaaggtattaaaataaaggagactatgtattttgctccatcaatgaaagatttcactcaatatatattcacagaaaaactaaaacagtaagtactttaccggcatgttgttcttcacttacctaacgtttatattttaagaataattctcagtgatgtaatttcttacagttatattgtgtgtgtcttgcaaagagttcatttatcttcctaataatatctttgaagcctacaatttattttcagattttgtacgtagaattcatatcttttgtaaaaaatgagatgatcagccattaagagcacatttgagccatgtacactttctgattctagttcagtgttttttccattatgtacattctttaatgtacttactattttagtattagtactaatattattatcatttcttaataacttttttttcagttaagtaaaattctctttggattctatttaggggccttgctcttcaataaaactttaaaatagttttcaagagaaaaaaaatgagtgttatctctttattttgcttataaattttaagtttgtagaagagacaactaacacgtgtccctgaaaaattgtgtagaaagttacggtgtatggagttgacctaaccaacaaaccagtgctctccattttgtctatcaataatgctaagtgatttctgtggcatgtgaccgcaatatttttttatatttgtgctcccattggttgaatatttttcaaatgttagctgttgccagctgttagttgtagagctgtttgtatcagctaaacttgttataattatgttatttaattttttatatcagcaaatagcatatgaatttaagatttttttttaataaaaataacttgaatgctttcgaatgatgtaatgaatatgagccactaaaaatattttcaaattgggagtggaagaaaagactgccaaagactgggggaaggttaaatccagaaagactttgcactcagtttgacacagaagttccttttagttctagctcttcttttattggagacttaaaacctaggcgatacatttttatagatgttgtttttgcaggaaaacaaaggaactttggtcactgagtaactttggtattatgtcaaaggtaccaaccccagttgcatggcataagaagattacttataccacttacatgttaaatcaagtctcaagtcaccaaatttcatttatttcagagatgaaaattttgatcctgataattgatttaactcatgtttaagaatctacataaagatctggaggaatattttgcctaagttattcttcacattgcataaggttattttcttaaataacactgacaagaaagatgaattaaatacacataaagtcttcaagatattaatatgttctaaaatgctttaaatatttagcatttcatcctgctttgaatataaagatactgctgtggatatgccatatatttagctttttaacaaatagagtattttagcttaaaacagataaatttgaagaggttttctgaagatggtttttaaatagattttagataatagactcagtctttggttttgatttgcagttcttctattaagaagcagtagtaaatcagtgaattgggaaattagacctatattgcagaaacctccctctcccaggaaaactgttgtattctagacctcattttggcatctgtcatgggaacttggtggagtactttgtctttgaggtagagaagttcagctcctttccagcttactgttctctaatgaggctattttgatcttagtttctcatgtacttactgtcttgttaaaagtgccttttgaaatgttgcttgatctttcctttagtagattttgattttttgtaatagacgcactagttggggaatttttcccatttatgtctgtgattccaggctaacagcagtccagatcatgagatgtcatatgtgcagaaaggaataccagagatatatttaaggcccatgtgtgaaatgacaattgaggaaatgcttttttcttttaagtgatggaaaagccattgataatggctcatatataatgtcaaagttccgaatcaaaaatttaaagcaaacttaataactttcatgttgtgccagcaaactgacatctgtacattgattttaatggccttaattcctgggaatctcatttatttttgagatctagtttaaaacaataaggacatctagtcctaatactttgtaatattttactttgtgatattttaacataatggaataacaaaatagtagctgaaactatgaaattaacaaaattaaaaagattaaaaatgagctttcacaaattatactgctcataatagatatctgtacttttgttggatgtaaagtgtaaaactctccaccaaaagttgttgattttcagctgcaattacacatttcacacatgccagtcattatattgtccttcagaatctttaaagcagcttctcttcctcttcctccaactattcatagttagcctttgtttgaccctcactgctttgagaatcagtgttggaataagccttggttactcatagaggattgctgacattcctcaggtaaactgaggagaaaataattcatattgatatctctgccattaaacctgtaaaatctgtgaaaagggaatgcctcatagtcatttttatgtccttcgcacatggaacaacttctgatctacagttggcgtgaaataagcattttttttaaactgagttttgtgaaaactgcaaatattatgaaaacaaaaatcaaaagagctgtccatctgctttccactgcacaccatagccttggcttctcattccagttccctaatcctaatatttctacttgctcaacttttgtgtttttcttaggagcttcccacatcttttgaaataaggtaaaagacacataactgtattgcaaaattaaaggttgaactcatgtcctttactttattattttctgtacttttaagttatgagcacttaatagaattgtgatgaatacttttttgactcccatccccaccccactcagggataagggatcagatgcatcatggaagaatgatcaggaaccaccaccagaggtaagtataagtctttttatgcaacattttataaagtagggcaggacttaatcttataaattttatcattcttgctgttagggaagtcattaatactggctagcagccatactgccttatcctgtcctagcgcatgtattctctcaccgtcctagatgactatttcatacctttcagtgaaaggttttgattgatcatttaggaaaaaaacttttttcagttacatttagttgtattttaataattatcaccttatcatttacattgtagtttactatttttgtcaactttgttgatgtctgataaaggcaggctgtcattattttttaaaaatttaattgagtttagtaaatacaccatatgggacatgaagacatggtgcttttaatagctgtccttcttttggaagtacagaatcattggaagcacaagatcattggaagctacctacct

SEQ ID NO: 113718 - DNA, 1055 bp, Homo sapiens
taagcccagcctacgctgggatggaatttggggaactgcatgcactctatatcttctctgcttgtcagttatttttcccagcagatcctacattatagctgtaccacgttgttgttacagtgtgtgttaacctctgtgtgtgataggaatccttggagatcttgtagcaaaaatataatgactttgagtaaaaaatggtgagtattatcacctagagccaagtgaaaggatacctagaaaaccacttctcaatgacagggcaagtataaagcatcagttggattaaatttttatatgaacacctacagaatatatactagttttaaagatataaagaaagctgcttgcccacctcatagtaaaggtctcaggtgctacttttccaaattcagtttcttatactctccttacaatctattacttcctttgcttttatcttgaatcaggtagtatggaagttccagaatcccctaagttgggtggaatgaccaagaagggatatgggtgcctcctatggagctgtatgaggagaagtgggccggcctgagccttgctgtgtcttaagttgctctttacagtttagctctcaggtgttagtcaatctaaactctacactcagaggctaatggttatttaaaatattgttaaattcctcttttctactctggattagccaaattgcttatgtgaacttggtcaagttttcctgtaacatacctattagtattggctcatgccacatactgtctattgtatggcttcctgttatctactgcctgtgatgttgttttacttaaaactttataatgatttcattatagttgtggctcataaacacttcagaacctaggaacagtcaactaaaatactatgctttgcttttgtccaagaattttgaatgtcacttatattttagttcaaaccatactgcacagacctgaagttggcaaggaatttttccactgaaattgtttttcacacttaggaaatggattcatgctatctaggaaacaaatccctgggaaacagtctgtgtaccaggttgcaaacgatga

SEQ ID NO: 113719 - DNA, 1037 bp, Homo sapiens
atttcttctaaaacagttttacaactaaacgtgattacactatttttggtaaaaattacttgagaatatgtacatagcttgaatttgttgaatctttaatggatgattcagattttctgtgggatttgcattttaatttttttcccttagaattatagctttttgtattaaaaataggtataaaaacatttcccagtgctatttggtaataagtagactttgtttactgaagagaaaatggttaatgaggtaataatcccaccttcaatttttttttaaattatgttggaattaaagcttagattttcattaaaattctacattctcttataagtaaatcttgaagtaatctattttatttttcagtaataattgaatctatgactaacctacctccagttaatgaggagactgtaatttttaaaagtgatcgacaagcagcaggaaaggtttgtaaaacatttcaaatcttacaaattattctatttatttattgtttttttctgactttccccatcagttctcagaagagtttatttattttaattgatggacaatctagagctctctaatttcagtacgttcttgatttcctttagtacttcatatctgtctgtaaattggtttaatactgattattactctttgccacatgagttattaaatacacatatatagaattctttcctagtgtttgtcagataacttgctaggcagtgagtctacgtaatgcataacacatcgtttcctaccgtccagatactcagctgagtgaagaagacttcccatagtatagtagctcttaagcatttttgttttgtgagctcctttgaatagtggctctcagacttttcagactttgacttcctcaggtggaagctcggtgtggaatcttttccaagtggaaaaatatttcactgacagcaatgaattgtcactgtaggcacatcctggggaattacaaatatgtgcattcaagtaattactataagatttggtcccttttaacatctttctaatggaacaaccctgcatgt

SEQ ID NO: 113720 - DNA, 1624 bp, Homo sapiens
ttcaggacttcaatgtttcactgataggtgtcatttcctttttcctgaagaggccattcaactcttcttgacacagtcgcagaaaagattgctgcttctgtgttctgtttaatcacagtcaaactaattaactaaccaatttaacaagacagctaaaagaacttatgtggagaaattatagttactagtagaattatttcttttcaaatggaatgtctctgcctgataatagccttttttacaggaagtaggtagtctcttgttcaagtgtgactgaaagaatgtagaatagtacttatgtctgtgttcttagtctaactgaatttggggtgtatacttgagacctgttgagtcacttaggtggagaaatgttggagggagagaagtgctatcacaagtctgcaaccactaaaatgataacattaaagagatgctctaagcacttaaagcattttcagagatgtgtagcacttaaaatggaaaatttattttttttaagttgttgaagctggaggaagtttaatgttttgttttgttttaaattataggaactgccttctgttgaagaactcactattattctgcctgaagatattgagttaaagcctcttgggatggtttcaagtattattgaacaactaggtatgttaagaattctattaataaaaattgtttccaaacacacactaataattgaatcaatgacttttatgactagtaaattttctttgacatacgtaattaacactttattttatagtcattaagtttgaagggataaaattcagttttcatatactaaaattatatataaatacagtttatttatagaaatttaaatgtctgcttttactgacatacttcctccggaatttcctttgatttggtttattagttttctaatgttgctataccaaattactgcaaacttagtgacttacagcagcacaattttatcatacagttctcatgtgggtctcagtgggcttaaaatcaaaggtgttaacagggctgagttattttctgtaggtactaggggagaatcttacttccttgctctttttgggttctagagcctgcccacattccttgacttttggctctctttcttcatcctgaaggccagtaatgtaacgtctgtctctgagccttcttccattatctcacctcactctaaccacatgtggaaaggttctctgcttttaaagactttttagattgagtttacctgcataatccaggataatctcccctatctcgtggtccttaactttaatcacatctgcaaaggctcttaaaaatgtaatgtatttacagattcaggtatttagagtgtggatatctcttggggagccattctgctcaccacctttgattttgtcttaaaaacatgtgagaaagttttgtaatttaatactgttattaatggcatgaaatatgaagttgctgagttataagagaacttaatattttagacttctttagccccaacatgtgagtttgttctgtgagattcttgttaatataggtactattaactcgtagtaggatatgctggagaatagaactcagcactgacaaagtaataggattttggaactgtgaagaggacctagattgccca

SEQ ID NO: 113721 - DNA, 1079 bp, Homo sapiens
attgaaaagaaggacaacttactctttgaaaatatggttgtataataaatatacaagaaaattactaaaagtaaatttcagcatgatgctttcttatgttcaagcaataccctataaagggtctatttgtaatagcaataaaatatattagataggaatttataatagcaagtaatatataaaatagcttggaataagcctaagcatttgtataggaccctttatgaagacaactgtaattaaatgtgatctcaatcaatactgataacactaatatgacaaaatagttctgaagtgtagtgagataaatatgtgagaacagttaaaaaaaattccaaggggaaaaatatttatggattgggtaaaggaactagcccgtcatctcaaatattgaaatgttttatgaaaaccacagttgttaaaatagtttagtactgacactgaactagatcagtgaaattgaatggagattcagtaaaaaacccaaatatataagtgtacttagtatatgttaaagtttgtttttcaaatcagtgagagaaaagatggattattctacagcatgtcaggataactggctagtagtttggataaagataaagccaatcactgctgcacttttatacaagaataaaattgtgaatggaccaaatacacaaatattaaaaaaaaaaaactagagaaataaagaaaacaatagtgaattttcagtgattttgggatagggaggacctttctaaatgtgacacaagtttcaaaagccaaatatgtatatatacttgactacataaaaattaaaatgctaaaggttaactaaatgactgaaattgtttagtttctttagctaaaaaacatgctgtggggtaagggagtggatatttgctacatatttgataaaagacaaatgtccttgaaaatccaaaggttttttttttataaattaataaaagataagcccttaaaaaatatgtaaagttatacaagaaacaattcataacacacataaaaatggccaggatacatgcaaggatgttcactcttctttatgaatgaagaaattcaaattaaagcaagatact

SEQ ID NO: 113722 - DNA, 1984 bp, Homo sapiens
gctgattgctttagaagataaagacaaatatctgttaaagagcaatggaactagagaatgagcatatacactttagctgaaagcaaagtagcaccagagagttaatggttgaatgtcagatgaatggtgtactgcacataagaagtgataggattgagtggaaggggaggtaataaggatttctgaaaaatttaggctaatactctgtggcattttacaattatttggcagtctttttatcttagtgatataaaatcagtgtcttaaagttgatgaaatatgcactcaattaacatgaaagataggcttaaagttatattcattgttggaggtttcttattgagatggactatagttttatatttaagcaaattaaattttgaaagtattatgaactttgtttctcttaacagtaattttagagaaaaacaggataataatgtattcatttaaaaaagaaaaatatcaagacacttcaaagaaatgttgaccctcattttttaattgacttgtctgagtcttaagtttagtgtcatacacaatagggtaattaatgaggggactaatgcttactggtgataaatagctgagtttcatggaaacttgtaaaattacttcccctgaagaagttaatgaattagaatacatgttaagtatggtcatagttgacacaaagtgtacagacctaatccattctttttccaatatgttttaccagctatagagaaaaaaaaaattcagtcatggctctcagtactccagggattggatcctactttccaaccatatctgaaaagtgaaggctcacctaatagcatcaggtaattggctgccacgtgcatgtcctgtgttgggtaatatgagaaaagtggttagataatttcatcccaccttcctcacttttctcaattctccccaaactgacaccaaaaaggtttagttttcatttggaatgtttgattccttctcccaccaacctctgttgtcctttttccatatttgtgagtgaaaatcctactgaaagttctttatataattttactttagaaagtcatcaatttactgatactcttttttgctcaataagccttcacaaatgcttgaaaagtcaacagtgttgtaaattataaatgttaccttttcagagggccacttttgacatattagcttcttccatttttgcattgaaagttttaggcacccattttttgactggtatgtctataacctcatttttaataggatggatttttaatgttatgtggtactcttttgaatattttgcttaactgaataaccttgtagaccatacagatgttagaaaattaaaatataataatcttacaaaacagacaataattgctctttcatggatattccagaagtgtggttaggatcttgcatttctttaatgccatcgttacgagtatctgttatcacagaagcacagtaatttttttattgggatctagtatataatttctgtattaatgtgttgtctttttgattacatgcagttggacatttaaattgtcgttagccatttgtgtaactgtttagaacttgtgctcagtttccttactattcgtaggtaagaaaaatgaaaccagaaagaaagagacttgtctgaagtcatattagtggggaggagcagatctgaactggtaatagatacattccaaactgctgtgtttttagtatttgtggagacctgcatagcaacgttggaatctggtcgtttggactttctcattatttggtttctgaataatcatgtagcatattttctcaaagtgaaggatgaatgtatcatctaatgtaagctttttaaaattgtatttgcttggattatattgcctctcaataaagcttttgacttggaactgtgtagtgtgtgggaaataaatggtggagcttctttagtatgttgaattttagtagttcatttgcgaaatgctgtggtgtttggggatgtttatttcca

SEQ ID NO: 113723 - DNA, 1054 bp, Homo sapiens
ttagcccagtttaacccaattttatgtccaaccactttctaaagagttttctagcagtttcctattgtcactcaggcatgcttagcttaatttttacctccatttagtctgtgcttcaagcaggaatgtcgcctctctggatctatccctttaaatctttccattgtgggttgttcgatctctgcgatctaactatgtacaatgcagatctttaggtagatgagaactacagtgaaataactttatgattgttcttaaaccttagaaagatataatttttaaaattaggttataaccaaatcttgccatcccaagatgtggttataacccagttttttgtttttgtttttgtttttgttttttaatgtgagggtacgttaagggggaagagaataaaagaggaattagcgagctatagtggcaatgaaaaaggagagtcttaagtggctctcttcataatgtcacaattaataagtttaactagataaaattattcttttaaacataaattcttttttaatgctcagaaggtttatatataacctacacagtcactgtaagcagcatacatattacagctttggaactacgttgagccacataggatgtatttagtgttttgatgaattggaaaattgagattctttttaaacaattttatcagcagttgatgctctgaactcttcattcaaatgtatcaagtgtaattaaaaatgtagggtcataaaaatatttgggattataatttttaaagtcttaatcagaaatgagttttataaattagtgcccattgttttctgaaaacctgaaaggcttcacataacatttaaaaattattagcacaatgtttatggagataagaaatggataatacttcagtagggataataatgtgtctttaggcatataatgtagcatgaccaagaaaaaaattaatgcttattggcaattttgggggaaatttagctgtcatactttggtgactgcttattttataaaataagtacgtttggtagttaggttgagtacactctattctcctgattgtggcagt

SEQ ID NO: 113724 - DNA, 1921 bp, Homo sapiens
gatatgtgagagtattgtaataagaggatctgggttatggcaaaggtttgaaaatgttattggtaaactaaatactactttcccaataccatatcagttttgaagtgctagttttgaattagaacagcagtagtaaacatgtagtaaagttgatatttcttaattgcataatcttattttaatattagaataagcaatagtaaacttgtattaaagttgatatttcttaattgaataatcttattttaatattagtataataatactggactatttttttaactgttttcttccctacagtgaaacagattcagatagttcaagttcatcgtcttcctcttcatcttcctcatcgtcgtcttcttcctcttgtatatcacttcctccagtgctgtcagatggagatgatgatttacaaattgagaaggaaaataagaattttcctcttaaaacaaaagatgaattacttcttaatgtaagtacttagatttattaagcttagtttgcatgttttaaaacgtattctggtaccagtattgatctaattttgcctatatctgctccataaatttgaaatttattctcagcctaataggcatgcttttggtatgccttggctttcttatgtaaaagagagtagtgatctggataatttcttaggttgcttctaactctgctgacctttgataattgttccgattatggcatcaacttcagctttgaactttacattttttacattccctagaagaagatatttcttatgtagatttgcttttttttttggtctgcacgtcagaaaattttgctcaatagcaattgaaatttcaatagcaattgaaatcaatttttttggtctgcacgtcagaaaattttgctcaatagcaattgactttttaattgactgcatttagagaagtagaagatgaaattcagagggttgaacttgttaggattcctattgaagtttttggagtgtttttattattacagttggagaaaacttgttaattgtagaatggtatttattggcactcgataggtttggtttgcaaagttaactcttgcaaggttatttcctcttatgctgtaaacatccttaggaggatgatgttagtctgattgaaacctatgacccaagaggaaagccttctcagaatttcagaatgtaggccatattatcacattgttttttttctacccctgcatgtagttttaattattaatgctttaaaaatatttaatggtcactaatcataattcttatataacacttaaattgatgagatagtttaatgcaagatttgaaaaaataaattaaagcctacaggcactcaggagcctttttcatgaatggattctgccagtctgaattatttctctttttctctactcataacaagaaattctcgtctcgcttatgctttataacttgaagacctttggatttgtatgcagcttcatcagtggctcatattttcatgctacagatatgttaatatttcttagtggtctttgtacacaaaggctcccagcataactattttctgaaagtaggagacttgtttggtctttcttgcttgtctcttgatcatttttctacataatttccttattagaatataataacgaacaaagaaaagaccacagtacttctgtaaatgcatacatatcattgtcttactagatttgcaattcttaccttgggaatttcttccaatttaatgcaaagtcttagcatatttgtttaggtatttttctgaacagaatgtccctgttttcatcagaagatcaaaaaggatttgtggccacaaggagtccaagaacaagttctttgaggactgagttcatatgtgatccttgtaattcccatagtccccagtggagtgctttatagataatgggttctcaggccaaagta

SEQ ID NO: 113725 - DNA, 1395 bp, Homo sapiens
ctcggactcggattcggactcggacaggtcgggtgcctaagggacccggagctgtggggagaggtcttgtatgacgggcgggggtggctggggcctaggagcctagaggttgcttgtgtgggccctggagggtgggcaggtcgttggtgctccgggctcacgtgttgaagtattggctccgactgccccttattcgctgcctctcaaagcaggtcgcgttgtgaatctgagcttagtactgacttatttcctaaatttggtggcctgaagggttctatgtatagatcgtatcattttttgttagactttagaaaacccgaggatcttaggttatttccgtaactactcagtttaggctgtacttttgtggttatagttgagttttgtgtcagatctgatttttttttatcatcacatctaggctttgttttttgaaccacatacattggggatcaggaaaagtattattttttgtgtttcaaagctggctcttgatgattacgttaatttatagaatccttgcagggaacacgtgtttatgaaagtagccaaacagtgttatttagtagtatcttatgcttcttacgttttgtgagagcctttcccccttgcccccacacctgtcttttaaatatgaaatctctgggctggagaggactccagcatgtgggatgttactaaaccacactgaacattgtctacaaatagttgagtgtgttgagtggggtactgaacaggttaacaagatagacacgtgttgaggaggtgagaagtttagttttcagggaagtcatcagcggagagtggaagtgaagaaggctgaaggatttgagtagaaggagagggtatgaaatgtactgggagggggaagtaacaactgtaaacaaggttggatttcttggcagtactaagattgcagtataatcatcttgtgggatttcagagctcattttactagcaaagaaaagtaaatggtagatgatttggggatacgttttgaaagcagaagggatatggcgtcataataggccaacttagtgtcaggatactacttctgactctgtgggtgatggcagaggataccaaatatttgaagaagtcaaaaggggtacaactttttgccagttaacagcagtgaaatcaaatggaaactgaagaagcaggtttagttagtataatgcactttttcttgttttaacttgctatgagtgtgggtgtataggccattcgtacaaaggtggccagtatgccgtcagagattggacatggagtttagagatgtcatagctgaagatttaggcgttaattcacatggatgatgactgaaatcattaatgtgtatgggattatccatgaaagtagtagcgaaagaagagaaagtgaggatggaaccct

SEQ ID NO: 113726 - DNA, 1001 bp, Homo sapiens
aacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattactattaactgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtctgaagtcattcagaagtggtttgaggtttctgttttttggtggtttttgtttgttttttttttttttcaccttaagggaggatttaatttgctcccaactgattgtcacttaaatgaaaatttaaaaatgaataaaaagacatacttctcagctgcaaatattatggagaattggggcacccacaggaatgaagaga

SEQ ID NO: 113727 - DNA, 1054 bp, Homo sapiens
atgggagatggcgaatcctcagaaggctctgtgtgggaggcttttgcttttgcctcccactacaacttggacaatctcgtggcggtcttcgacgtgaaccgcttgggacaaagtggccctgcaccccttgagcatggcgcagacatctaccagaattgctgtgaagcctttggatggaatacttacttagtggatggccatgatgtggaggccttgtgccaagcattttggcaagcaagtcaagtgaagaacaagcctactgctatagttgccaagaccttcaaaggtcggggtattccaaatattgaggatgcagaaaattggcatggaaagccagtgccaaaagaaagagcagatgcaattgtcaaattaattgagagtcagatacagaccaatgagaatctcataccaaaatcgcctgtggaagactcacctcaaataagcatcacagatataaaaatgacctccccacctgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaatgggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgagattggccaggccaaggtggtccgccacggtgtcaatg

SEQ ID NO: 113728 - DNA, 1050 bp, Homo sapiens
gggcagggcagggcaaaaaaagactcagtgcaggaaaggacttgcccaaggtaatctagtacgtggaaaagcggagggcaggagcctgtgccgtgcaagagctccggggagccaacaccgagcggcccttttgagagggtcccagcccctgagatgcgggagcccgcaagagggaacctcttgtctgaagaggttgctgcgctctggagtcgtgctctgggacagatgggcaagctccgctcttggggccggaagcgtgtagcgtctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatggtgggccccctcctgctcccccgaaccgctcggttggttccccggaaggctcttgttgagcaggcagagagggagggtgcggtttcgggaacctaggagaggggaggatgcaaagtgtttattttcagggagtgtgcggggtgcggggcgaagcctctgggaggcgagtcccaggcccaacgcctggaccttagagttccgcgtccgagtgctgaagtgctcacacgtcgccttgctcctctttgccttgtgcctaacttctcgctagtcactacttcctgggggaaacccggcacctttccattgtaacgcatcgaggagtttggcaaaacttctgagatcgctggccctacacacctctgcctctctggcctgggtagactcagtatgtgggcttagtcgcctcttcctcggcgtccgttcacctctcgttagtgccctg

SEQ ID NO: 113729 - DNA, 2289 bp, Homo sapiens
agggcaagtaaagtattttgcaggcagaggtaataacaagtgcagtctcaagaagttatgaaatagcttggtatgttctggaatggtgagaagttcagtaagaatggcgtgaagaatcttttatagaggagcatgggaaataatggtggagaagcaggttggggctagattgtttctgtgctaaagacttgggacctaactgtgagctagtagagcactttaagcaggggagagggactttactatattagtgttttatgaagacaagctctgtagctttgccgaagaaaggactagtggggagaatctaaagactatcctgattatgaaagattctgaggattgaattaagcaattgacaataattttgaagaagagtgtaaagccacttggcctttttctggaataggtatgttggagactgccagctgtcccctaatgtattctttctgtttttctatatgaatggatctttttctcacagaataaggattatatttactactctcccttatgtaacactgtgaataaattttggtcagtgggatgtgagcaaaaggatctgcaacttcccaggtcatgctcttaaaaaaaggggatgtaccttcagatttttcttttcctacttcatactggcttgagtgtagacctggtattaggctgtcttgaactagataggaggtatagcctgaggctagtagacaaaaaaatggaaggatcctggatccctaagggctttgtggaacagaaccttcagctcctacttttaacaataaagaaccaaacttaagctgggttatgccattatttggggtttttattacagagagccaaatatgattcctagatcattataggtgaggtaagatacaggattatgtaggaataaaagaaacctgagatgtctagtttggaggacctaatgaattgtgggctgattaactggcataaggcttcagtgggaaaatgatacatttttccttttggatatactaattttgagatggcttctattattttctctattcctaatttgtacaggcaatgagcccagctttgattttgcatgattcattgcccgctttgttccatgtgaaacatctacaatcaagcccctactaataatccaagtcccttctgaccccttaattttcttaactgtaacaaatttctggctgtgagtctcctcactatctgtagtccctgtatcttctttgaagatagaacatgttgttgaagagctgagtttattgactccttctgtgcctttcttctgtcattggagagcacctctgaatatatcgtttctgtcattaccatggcaacagattattagaattatttaatgatcctggcttatctcctgatttttcttgtaatagttttagcttactgtatttctgtcatattactgtttttaaaatttatttgtaaagaatatttttgggactgaaggcacttacatatctgactatatgtgtcatgtgttttcatacattttagcccaaagcaccaaagggaaaaagtgcaggacgggaaaaaaaagtcatccatccatatagtagaaaagcagctcaaattacgagagaggcccacaaacaagaaaaaaaggaaaagtaagtatcttttcatcatttgtattactcgttggtaaaaagcccctttatacttttatctttcaaacatatatcctttcacagtattgtctccctttcataaatatttattaagtgtgttctgtatgcagagggtgaaactgaacaaggactctactcttttagagcttacctaaaacagataagtaatttatgtagcagtaggtgatgagtgccatgaaaaatttaaaaagttatgggatggacagtgagggagaagttgttttacgtgggatagtcatggaagccttctctgaagaagttacatttgaacagagagttgaaaaatgtgaggtctgtatataaggcatgtaggttaaagtgcccatgagacatgtaagaggagatatggaatggatagttagatatgttgagtctagtgttcagagaataggttaggggtattgacacaaatttgggagcgatcagcatccatgtgggatttcaagccgtgagactggataggatcagttcacctaaggagtaactgttgacaggaaagagaagagagccaattactgagttcagtggccctctaccatttagaggttaggaaaagaaggagcattccacaagtgagactgagaaggaggagaaagaaggctgtttcaaagattccttaaaatgaagtgaa

SEQ ID NO: 113730 - DNA, 1048 bp, Homo sapiens
gcagtcaaggaagccatcagattcctcgtctggacaactgtttcctgagatagggaacccaggagatggagggggtttggtggggggtaggtggggacagggtgatgacaagttcagttttgatgtgctaacggtgaagccactaggggacatccagattgagatggtggttgaatgtgagggtctgcagtttgatagaaggctgcgatttggtcactgaagttaaagaaatggtcgagttatccagggaatgggtaaaagaggtttgaggacctgaggaactcagagaaacataaacatttaaaggccacatgaaggctggatactaagttttccattaagtaatgtaagcccaatacatatactttgtatgtaacacaaatcattttcgtatttttcaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttggtgtgctcactgattttttattttccttttatatgacatagcagtatcaatttgtgattgatttcaaaggttttattttagatcttgtttatttcatttgattttcttcctttgatgtctttttctttgtgagggtttagaaaaattttggattctttttttttcccctacattcccaacaaaactatcaagtttgtgacagtgatgtgacatcatgtcttttttaccgtgatagtaatactgattactttcacattgatcttgtcaaccctaacttgtctccagaactccaaatttgcagtatcacatatggatttctcaaactctctacttgcatgtcttttgggcatctcagacttgacatgtcatgaaacaaaggccagcttttctcctaaaacttgctcctcctgcaggtttcttattccagtcagtggcattaccacctgcccagttgctcagatcagaaactctacagtcactttcatagtccacatccaa

SEQ ID NO: 113731 - DNA, 1025 bp, Homo sapiens
ttactttcttttccagagattccagacattctaaatgcaagtaatctgaaaacatttaggtgagtctgtcttgtattgttcccctgaagctgtgtgtaaagtacctgacaggtgaactttcttcccctttgagtctagccggtagaactaaaagaaaatcgggtttcttttaaccttttcttttttatctgaccaagtaagaattttctgaagttgggcgtacaaacagttgatctgcaccaacaggatggtaacctggtgtgctttttgtttttcaaaatggtttaagatacattgttatagtacctcaaagtatgtgatctcactattcctccccagttttatttttttaaaaaagaagtaacagcaacagacgtgatggctcagagtcatatccccaggctgttctgtagcagcctcttttgcagagaagatggttataggaatgactccagggaacaggttaagtcatcaagacccgctttgtccagtggtttctagttgtactcttttgtaaactgggaaactaccgagtaggatttcgattttttaggttttttttttttcttttttcaactttgattttaaattcagaggtacatgagtaggtttattacaaaggtgtactgtgtaatgttgaggattggagtaagaatgaatctacccaggtagtgagcatagcacccagtacgtggtgtttttagctcttacccctttccttcccccaacttgtattacccagtgtctattgttcccttgtttatgaccttgtgtacccaatgtttagctcctacttataagtgagaacatgtagtatttggttttgtgtttctgtgttagttcacttaggataatctgtaaaaatcctagaagaaaacctagtaaatacccttcttgatagcagccttgacaaaaaatttatggctaagtcctcaagcaattgcagtaaaaacgaagattgacaaatgggacctaatttctgcacagcaggataaactgtcaagggaataaatagacaacctata

SEQ ID NO: 113732 - DNA, 1051 bp, Homo sapiens
aaggtgcagttcacttttgagcttatgtatagcatgtatttataatttaagtatgtggagttaagattctttttataccttaattttattttgcctgtaatcttaaatatataaatatgctctttatttctaaaacaatatatcttctacctcctccaaagccagaaacaagaaaagagatgagtatagccttctggttaagagttcagttcccaaaataatattcacattacgtctaaagtaattaatacaatactgaggttgaaaaactgaaaattttccattataagaataacagttgattactgaaacttaactgggatgtacttctgtgtgtgaaaaggaaaacctcttctgactgtattttggagatttgtcaggtatgatacagttcctacttttgattgcaattcttgatctgggtagcatgagagaaggagatactcaggttagagaggatgaaagaatagaacagctttctagtaatttgtgcctaatattttcctttaacgcttttgaagttttgaatatgtaggatcctcagagtttcgaaaatttactatctcctgtttttccacattaactcttaccaacactctgcactcttttttttttttccttttgtctagggaatgggactttgatctgaagaaattaccaaacattaaaatgagaaaaatttgcgctaatgatgcaattcccaagacgtgcaagaggaaaactattataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctg

SEQ ID NO: 113733 - DNA, 1024 bp, Homo sapiens
cgtggcctacatgagtgcggttgggggctgcaggtccacctgcagggtcatcttaaacatcgagcagaagacagacacctccgacaagaagttgcagctgattaaggactaccaggagaaagtggagtctgagctgagatcgatcggcaccatggtcctggaattgttggataaatatttaacagccaatgcaactaatccagagagtggggtcttctatctgaaaatgaagggtgattacttccagtactttgctgaagctgcatgtggtaatgatcaaaaacaaatgatagataattcccaaggagcttaccaaaaggcatttgatataagcaagaaagagatacaatccacacatccaatctgcctggggcttgcggttaacttttctgtattttactatgagattcttaataacccagagcttgcctgcacgctggctaaaacggcttttgatgaggccattgcagaacttgatacactgaatgaagattcatccaaaagacagcaccctcattatggagtttcttagagacaacctaacactatggacctcagacagtgcaggagaagaatgtgatgcagcagaaggggctgaaactaaatccagacagggtgtcatccttcttcccttcaagaaacctttttacatatctccattccttattccacttggatttcctatagcaaagaaacccatttatgtatacggaatcatctgtttacagtcttttcacactgcagcattgggaaaacttcattccttgatttgtcttggccttcctagtgtgtagttactgctgtagaaaagtattaataccttcatttcatataaacataagcaacttccaaacacttaggtagaggactaaaaatgtatctggtatttaagtaatctgaaccagttctgcaagtgactgtgttttgtattactgtgaagatatgaaaatgtagttaattacaatttaaagagtgttccacacaacttctccatttctacattccctcccatactcgtcagggt

SEQ ID NO: 113734 - DNA, 1035 bp, Homo sapiens
tgttatttttatttatttatttttgagacagagcctcactctgtcacccaggtggaatgcagtggcgcaatcactgcttactgaaacctctgcctcaagtggttctcgtccctcagcctcctgactagcaccatgcctggctaatttttgtatttttagcatagatggggtttcaccatctatgctaaaactcctggactcaagcaatctgcctgcctcagcctcccaaagtgctgagattacaggcataagccactgtgcccggccaacatttgttattcttttgacttctcacttccatcaaacctgtcagtcatattgttgctatgagggtaaatgtgtctttgtctctgggtgattttatgatttttcatttgccattattttctttagttttctatatattgctaggtataagttttttggatttatcctccaagtttgcagagcttcttgaatttgtggattgttatctttcatcaggtgaaattcattggtgaattcttgactattatcttctcatagatagctctacttcattgtgtctgttttcctgagatctgagttacatgtttaatagatggtttcactgtacccaacatgctccctgtacttgttttactattttctactttttttttctctctgtgcttgtttgagtattcttttgaccttctcttcagtttactaaccttctacaccatgcctgttatactgctcatccacaggttattactgtaattattgtatttttttaaatttccaagtgtacatttgattttttctatagattccaatttatctgttttctccatcttttcttctatgacttggagcatattaatcaaacttattctaaggttttagtctgctaatgtcagctgtattgccgtgagcctcttttcagcatatctttactcttaattttagttattgtatataaaaattataaagactcagccaggtgcagtggctcatgcctgtaatcccagcactttgggaggcctaggcaggtggatcacctgaggtcaggag

SEQ ID NO: 113735 - DNA, 1045 bp, Homo sapiens
gtaaatatctttgtaatctttattaattgactgttaaaatcacactcagagttctatgccttgcatttgcaaaggtcagaaatgttttgtgcataaatggcatggggggattctataaataatatttctgatttcaaaaggtcacatggaaaggaaaaaattatctttgtactgcatgtgtttcgtggcacattgtgtacttttgtaaatgaatctttgccaacataccatataatatgctcttcttaacactgacattcccctctctttaatctggattttactgtaactgggtaagaaggaaagcgtacacttcataggctcagcaatcaatgcatatctgattagaggaatcatgagaaccaagagacttttaaagttgagagaaatgttaaagattagctcaaaagccttctttcactaaagaatacaggaagaccagacatgtcacatgactagttccagtaagagaactagttatgtcagagtggacctaggacccaggtacctttattcccaattctgtgctctttggtaatgtaatctcaacgaactactggacacacttctttcagggaaaggtcttcacaaagctaattctcaaaaacagagtcctaactagaattgcttatttttattcacattttatttaaaataataaaacctttaataataaaacctaaatacattttattcattaaaataagtttaacatttatttactatagaaataaaccttacttctttttctgtagtaaataaatgtagaaataaataatacatgtatagcttatatatatgaattatcacaaagtaagcatattcatgcaaccaatacacaaataaagaaatagaatattacctgtagcccagaaacctctctctgggtccttttctagtcactacccttaccttctccccaaaggcaaccatgatcttgatttctgtcaccacatactggtttttgcctgtttttgaatttcatatataaatatattgttttgcatctgacaaaatttgttaaatttatcaatgttgtttcaca

SEQ ID NO: 113736 - DNA, 1052 bp, Homo sapiens
ttatatttaagagaaaataagtttatgcctttacattttaaaaaacagttctatataaaacaaaaaatgacaagggttttattgaattccatttggtaacatgttacaaattattacatagtacaaattcacagaccacatttatgataatatcagtgtacaagcaaatgttaaggggatcataaaatcatctgtttaacagtggtgtcatggatgattaataatacaggtcttaaattccagtaagtaggcaatgaaagaccaaactatgcaaatatgcgttactagagaccattgacttaaccaaatagtctcacaaaactaagttgaaataataactaacggttattaagaaaccattatgttccacccactactctaagtgcctgatatgtacttgctttgattctatgagagataaccctgcaaggaaactgggaaataaaaatgttgagcaagttggccaggggcacaggagaaggtcgtctgactctggagccaatactctagcctctgttgctaacatccagagatgataaagagttcataagtggaaataacagcagctaggcatcatgatcatatgaaaactacgcagatgatttgccaataaaccaataacataaaatggtcggaattctccctatttttatgtgggcgtgcatgacggagcttggtatactagttcacctttagtagaacactgaattagagctctctgcaaactgtagtaatgcattcactttaatttataaacactaaattttagtaaacttaacaattcaggaagtccttgtactttacttgtgtataaaaattaaagaagtcttttggagaaaggccttacgcttttggaccagtcagtgtgttacaggtaggtagacaggcatgagcgagataggagaaggtgcttttccccgactcagtaggaatgccaggtgatggtttgacaattaccacattgccagtagctggagctagggagagacaagctcctgatgatccacagctgttaacattaaagtgttaattgaatgcaggcaccaaggagg

SEQ ID NO: 113737 - DNA, 1030 bp, Homo sapiens
tatggcatgtgaacactagctttacttttatttttatccagagggagtctcatctcatttcttcaaaatcagaatttaaaaaaagtattttgaatgcaatcgtgtttcataccaacatgaaagtaccattatagttagtggaacagaagtgaagtgttcattaagacaaatcaatcaagaagacatcccaatagcatccactagagatttattcaaaacacagagcattgacatctgtggaaaagtgccacaaaagataagtcagcctgacggagggaggaaagagcattttaggcacaaagaagtgtaggcggaaaggtgaaagagcctagagaatgccaggaacttaataaagatgatcaatgggaccaagattgggagtgaaggcgggcacagtctgagatgcgggcaggagccctcacagacaccagattttgcacagctgtctggagaaattaaggagttttaacttcatcataactacagtggaaagactggagagttttagggtgtgtctgttgtgggatagggaaggttgggaggtagatgggatgactgggagtcctgtgagtaatgagcgaatttttgaacagtacactagctccatggtggagaacacgtggaggagagccagtgagactgggaggctgcttcccacatgttagtgagtgattattgtcgccggggctcaggcggtggtggtacagggaagaaacacagatgcttcaggtctccaaggttctttgtatacagtttcatgaaaagacaaaggatggccaggcgcagtggctcacgtctgtaatctcagcactttgggaggccaaggcaggtggatcacctgaggtcaggagttcgagaccagcttgaccaatatggtgaaaccctgtctccactaaaaatacaaaaattagccaggtgtggtggtgtgtgcctgtaatcccagctactaaggagtctgacacgggagaatcgcttgaacccgggaggtggatgttgcagtgagctgagattgtgccactgcactccagcc

SEQ ID NO: 113738 - DNA, 1055 bp, Homo sapiens
actttgcagtaagtttggtaaagataaagcatttcagcacatgttctgccacaaagcatttgggactcttatgttagagcttcagaattccttctgaaaaagacaaaagagagacttcctgtcatttccactggtttctgcatgtgggaccaatatgggcaaagtttaaacagatgcaaatggtaaggggaggaggcagtgtcacgtcttgttttacgtatttcttcatatccagattgaatttaagtcattctcttcttggagcttttggagtacacttccactaaagttatagcatgcttgaatggtttatttcaccaatatttgcttatggaaataaaggggagtggccgaggagaaaggagaagaggagtggaggaggggtttgaggctgagggaggctctgaccacagcacagagcaccggcaactttgtctaatgtgatcattaaccttcctgcaaaacacagctggcagttctctgaggtttgtcactagaatgtgaagacagccacacagatattgcacagactatttacagatcgtttggtttacattgagagtcattgctctacttttgtgcggtaggaaaatgagatttcagcaattcctttttgcattttttatttttattatgagtcttctccttatcagcggacagagaccaggtaggcctttgatacatttgtacaagtaacttgttttgcctgtttgcatccctgggtctctgagcatgattgtgtttatctgaaaaccacttaggtgtgcttgcagttagtagtattggggataaatgtgtaggattttgaaagtatgctatctatcctgttgggtctattatttcaatattttaaaaacatctggactttgaaatgataagtattttaccactatttttcctaaatgccaagaaaatagatctctaagctattgcagattatgttgtctttacaagtaaaatgaaacagaagtgttcgtctattcattataaaggtaaataaatgtatagatttttaggtaaaatgcaaactccaaagcagtttatttaaaaagtat

SEQ ID NO: 113739 - DNA, 1086 bp, Homo sapiens
tcccaaaagaaactacctagggaaacattgacaccagtggcgcacacctgtaatcctagctattcaggaggctggggcatgagaatcacttgaactcagaggcagaggttgcagtgagctgagaccgtgccactgcactccagcctgggcaacagagtgagactgtctcaaaaagtaaataaaataaaagtttaaattcagccttttaaagacacataggtgctgcatttctattggaaggtaagaatatataaagttgctttcagcactgataaacactgataaacttccataactcattattaaaaaaaaaattaggcatgtgtttattggtgtgctggatagtatttctttgatgtatttgtttctcccttgcctctcaaatatagatctctctagctaactttactggatctatcagaagaagaagaggagtgaaggaaagacacccagccacacaaaagaacttcatgatgccaacagcgtgattgcttagaagttcctacacaaaaaaaggatcatttgaaagcacctggaatggtttattagcttcacaggattttattcttcttggcttctatttggagggaaaataacataaattcaaaaggattccaatctgaagcccaaatcgtttgcctacataacaaaaatatctcatcttttcctgcacattattattcttttatgggttaaaaagaaaaataccttttagtgttttagaactctctcatggtaaaaagtgcaagaatttaaaatgttgctttcatattcctataattctccaaaagtattaaattcgtatatgtttgagtgattttctaaaaactgctcaacctgaaatcaattgcattgaccatttggcttcgcacaatagggagaaaataattggttcattgattatatagagagaaagactaagaaaagctattaattgctaccaattttatgataagctttaaggtttatgaaagtatgtttttttatttaatgagtaatgtccatttgaagttgaaagaaaacatgaaatcctaattgtagttcattttatgttcaaatgaaaccattgtttttgtttttgttttg

SEQ ID NO: 113740 - DNA, 1038 bp, Homo sapiens
gggagttagcctagatcatgccactgcactttagcctgggtgatagagccagatctcatcttaaaaaaaagaaaaaaaaagatataaacttgtaaatttcttatctggaattaacataaagtaagaaaaattttgtggcactaagctaacaatccttcaataaatacaaattaagaacatcttagcatctggggaacacctagttatcaacacaattcaaatttagacaggatagtttcttttttgagtaatcatatccctaaattccttctgattttttatttccatgtctcagcatctcaggatgaacaccaccaagacaaagcctaataggatgatgagcactcatcttttagatacagatatcaccctgagtgggacttcattggcataactgtattttagatgtcaactttaagtaagacttttaaagaaattatccatacaaaataataaaggacataacaaaacttcaaaggaaatcaaacgttgggttcctataattacatgatgagaaaggttaaaaaatgaatggttccagcctgagttcaagaccagcctgggcaacagggtaaaacctcatctctacaaaaaatacaagaattagctgggtgtagtggtgcacacctgtaatcccagcctataattgggaggttgaggcacgagaatcacttgaactcgggaggtggaggttgcagtgagacaaaagcgtgccacttctctccaccttgggcaacagagtgagactctgtttcaaaacaaaaacaaaaacaatggtttcatttgaacataaaatgaactacaattaggatttcatgttttctttcaacttcaaatggacattactcattaaataaaaaaacatactttcataaaccttaaagcttatcataaaattggtagcaattaatagcttttcttagtctttctctctatataatcaatgaaccaattattttctccctattgtgcgaagccaaatggtcaatgcaattgatttcaggttgagcagtttttagaaaatcactcaaacatata

SEQ ID NO: 113741 - DNA, 1481 bp, Homo sapiens
gaacccagaatgcagagtttgcagtgagcagaaatcacgacactgcactccagcctgggcgaaagagtgaaaatccgtaaaaaaaaataaaaaaagaaaagaaagaaaatgcgctacatatacacaatggaatactatgcagccattaaaaggaatgggatcatgtcctttgcagggacatggatgaagctagaagccatcatcctcagcaaactaacacaggaacagaaaaccaaacaccacatattctcaatcaaaagtgggagttgaacaatgagaacacatggacacaggaggggaacaacacacatcagggccagtcagggggtgaggggcaagcaaagggagaacattaggacaaatacctaattcatacggggcttaaaacctagatgattggctcactctctttctgccaccatcttggttcctcgttccctgcacaaaatgccctgtgaagccacagaaaccgtccctgctacagagcaggagttgccgcagccgcaggctgagacagggtctggaacagaatctgacagtgatgaatcagtaccagagcctgaagaacaggattccacccagacgtccacacaagaagcccagctggtggcagcagctgaaattgatgaagagccagtcagtaaagcaaaacagatttggagtgaaaagaaggcacagaaggctatgtccaaactgggtcttcgacaggttacaggagtcactagagtcgctatccggaaatctaagaatatcctttttgtcatcacaaaaccaaatgtctgcaagagccctgctttggatacctacatagtttctggggaagccaagatcgaagatttatctgagcaagcacaactagcagctgctgagaaattcaatgttcaaggtgaagctgtctcaaacattcaagaaaacacacaaactccaactgtacaaaaggagagtgaagaagaagaggtcgatgaaacaggtgtagaagttaaggacatagaattggtcatgtcacaagcaaatgtgtggagagcaaaggcagtccatgccctgaagaacaacagtaatgatattgtaagtgccattatggaattaacaatgtaaccatctgaaagcaacttttcttggtgtctcaaaggagtaactgcagcttggtttgaaatttgtactgtttctatcataaataaagttatggcttcttgttggaaaaaaaaaacctagatgatgggttgataggtgtaggaaaccaccatagcacgtgtacacctatgtaacaaacctgcatattttgcacttgtaacccggaacttaaagtaaaataaaattaaagaaaagaaagaaagaaagttatcagaagtgttttgatggtgacacaaaagggtatacaggatgctatgggaggatggagaagtgatagaagagtcaacaactttggatgaattacccattctaggactcactttcttctgctttgtataggaggcaattat

SEQ ID NO: 113742 - DNA, 1513 bp, Homo sapiens
gcatattattgtcattatcattatcatcatcactattcctagtactaatatcttaaattagtggaaggaaattaaaaacactttatagctattacttctgagcagtgagaccgaagtgggttggggcagtagtgtaggaaggagttagattttttttgtttgttttatatacttatataatatttttatttgtgtcaggtgcaaaaagatacatttttgtggtatgggagaaaaaaggagaaatgcaaaaataaacaaatgccatacatttaaaaaattgtttcccatggtcagagtagtctattttaatcgtcatctgattattgaatgaattttgcctttatttatctttaaacgccatttaagttgattacttatactcaattatcttactctaacaaattaggatccttcttaaataaagcaatgatggccttttttaaaacatagaggtgtgaaagtttatagcattttaaatttatttcaagagtagaagttactaaaatgatttatgaaaataatcttatttggcaatattaccctggcttctgacatctaagaaaaggtggcaaatacaatatgctttactaaaaactagtaggtactcatttgcaaagacactaatgagtattggtgaatatgtgtaacccatttatatcttgattacttgcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggctgggcacggcggatcatgaggtcaggaaattgagaccatcctggctaacacggtgaaaccctgtctctactaaaaatacaaaaaaaa

SEQ ID NO: 113743 - DNA, 1046 bp, Homo sapiens
tacgccgtgcgttcggccgccctttttctgcacggagaaccccctccgctcccattttccagcgcccccgtcccggcgatccagagacccgctgtgggcggccgccgcccgcgtcccggcctgcgggccagcgtctgggcacgcccgccccgcacccggctggcgcccgcccgcccgcctccagaagcagaagcggcagcggcagcggcagcagcagcagcaggaggaaggggaggcgccgagggaggggtactcggccgccgcgggaggccgcatcgcagtcccgtcacagcgtcggcgccggccggggccgaacccggaagtggccgagcccgcgcgcccgccggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcgtgagtgagcgggcgggcgggctgcgccgctgcggataagcgcgccgctgcggcgcgtgtcgccggccgcgggcgcagctctggggacagccgccggggccggcgggaggtgggagatgcggggcgtgacgaggcgctgtgcccgcagtcctgagcggacgcggacggaaactcagcctggccaggcggtgacttaaaacgctgcccaggatttctggggaagggtcttccccatctcgggcggatagaagattcggggtggggctgtgcatgggtgaccctgcaggtcctgtgtgtacctccctgaaatgcatgggcacctggtgccgagtttgcctacccctttataagagatcaggctaggatgcactgagtccgttgaaaaaaggaaactggaaagtaccagtcacccgctgtctaaatga

SEQ ID NO: 113744 - DNA, 1166 bp, Homo sapiens
tggaaaacttggaatgccagcatggatgaaagaattgttaaaactcctttcaatcaggggtggctaaagttggtgagactttttcattgtttctgtctatttaattataaatacaagtaggtttttattttcatttggttctgtccaggattaaacctaattcaagaactcgttatggtgttatttgccattctgtggatcagaaatagtttttttccttgccaccccttggcctgtttgcctccactcccattaacatccctccaccatggatcccgtgtgccggatttgagacttgcaggcagtgtctttaggaaggaactttaccgggcctcactgccagagctgggctagaacagaggccagtggaaactattaggaagactcagcttttcatgaagttagatttttagcctgagctttaagtcaaagaaagatgacctggacttaaagtgccttatggtatggttggaagcacggccccagattctctttgtgtaagtgtctgtttattaattcattcaatgtgcaaatatttgaatgcctgtctctgcctggcactgtgcgtggtgcttttgcttgtgttctcttttaacatccaaatttacattgttctcagatcccaccttgttctccactggcctgttggcacattgtcttggagggaggtcaggcatctgtacccaccattcctggttccttcaggatggactccttgaaattagcttttgatcttttgtgctttttctattccttgcctccaactttcatcctttttaattctcatataattaaaaattgtcgttggactatatatttgtgcttattgttttttgcatacttgagtatatgtggcatttagattctgttgcattctgggtctgggtgatattgagactgtgttacatttgcttctgatcaaacctgaaagatgtgtaactaaaagatgtagcttagtaaaggaatttcaggtagtaaattgagagatgtagtttagatgtagattagtaaaggaatttcagatggtaaactgagatgtgcaaaaggaaatgtaaattgaccagccctgacctcaggaatgtattttacagtctggcttttatagttatttgtataaaggattttcataataagttgaaggaagactgtgaggtataggcctgagt

SEQ ID NO: 113745 - DNA, 1035 bp, Homo sapiens
ctgtcttgcatgacttctcttctatcactgcttgtgggcagtatttcctcacggaagtaggccttggccagttcttttcaatcacctgttaatcattgagctctagctccatctatatcttaagtcggggctctaggtctgtgctttggtgtggaattttgaacttctcacatctctactcttagctcatgcctctaaacccaatatatccaaaactgatgtttgttcacaaactgacttcattttataacatttccacttattcaatgggataaccattcttctggtccctgataaccaaagcattggaatagtctttgatttctctctctttcttcatcctccacatcttatcagtccccaggaactgtggtcttggtttcaagtgtccattctggttgctactattctgatgaatggatttcatcacttgatacctgaactttttcactggtcttctattgagctctgtgtattctctcctcatccttcagtccccacactgttttaaccctccaacatcttagagtcatgtgaagtgacttatcaaaaccagagactcaggcagtcacagcctttcatcattttatcttatcctatatatccaagatcatcatgtgcttttaaaactctcccttgtccacaagccaggattctccagccttttcctatgcttctcttcttctctcccctgttacaacaacttgaagttcctccaaggccccattggagccccatctccttcaccaagtctttcctctttactccaactcattccagctcatcgttgcattcctatggtgtttgtcactgcacctatgtactgacttgtgccattccttagtggtttcccatgtaccttcctgtttagatggtaaatggaggaagatctcaattcagccttcctaatgtttcttacccttcttagtacatggcatgcagtgggcatctaggcagcacttaaatacttaatttattggctttggtcattttgaatattgctattaactttgaattgaatgttgcaattaaaaa

SEQ ID NO: 113746 - DNA, 1064 bp, Homo sapiens
aatgcttccccacacacttaacatacagccgcacaactgagttctccagagagaatagggtgctctttaatacctccctctgcccttcagtgagttcagggctctgctttttaactgctaatatattttagtaaagtttggcaattcaagcttttctagatgtttccttttcagctctggaaaattggaaaaataatttttaactatatatgtttaaaatattcaatggcattatgatattgtctgaaaggcattctgtgacttgatgcaagatcagaagttttttttttttcttggagaagtaagtaatacaaagaaaaaagagatagaagtttttatctcacaagatacctcatattcagttctacatactgaagacctaatccaagttcttacatgtctatagggcaaatgttaacatttttaaaaagctctatttatttggtaatatgaacatatgtttgtagattagtctactgtttccatacctaataaaagtttaaattccagacatgtgaagaaaatttgcagtgtgtctctttgccttagctaactgcaaaaattgaaatcacaaccctaccatagacccaaacgtgtttccaactgagaaagtcttctaccttcacagcctctaagtaatatagtggttatttgtttgaaggatgtgagagtattttgttgagaaactgtagaatgacataacaaattttagttaaaatgttagttatggttgactctgtacttctgatatcctggatttgtttatgagagcaatgctagtaagatgcctgcttctgaatgcaagtttggctgggaagacagcagagaaatagaagaaatattataaagtaatggagaaacctcaaaacattacagcatggatgttgactttgaaaacaacagctgctgacgtgaacttggcagaaatttgtgagtaatggtgggtgactcattgcaagcaggggagtcttgcagcttttgaggtgaacaggcaaaggggagaacagtgatggtggccacccaagggccaagtatttatgtcctaaatgtcaaaatgtctttga

SEQ ID NO: 113747 - DNA, 1072 bp, Homo sapiens
gtatagctaattctaaaaagggcttgtgtgactcttcatgtgagaaggggtggttatttgtggcttgaaaaaattgcttgggtgattctgatctttctctttcacgctgctgaaaaccattgtttcaaagccaataataaatatctaaagaagttttacttcatttctgtggtgttctcagaattgttacagcaggtttaaacctttgcctggtttggaaatcttgactatttgagagagacagccctgttagagtctttgttttcttcctgtctgagaattcagttatcatcaatagtgtattcttaggcagagtcagaaagtcacctcatctgagaagccacctgtgtccacagctgggaatttgcagaagtcagtcactgaaggaaggctttaggatatctatgataaaacatagcagtacactgggatccaaaccctgggaaacctcaactattttagagtatgtgttgataacaataggctattggataattgccagactacttgaggagtctaagagttgcataaagacttaaaggtgaaaggaacttggaaaaatatcttcttcaggtattttaagggagacagttctcagaatgagaagcttttctggaaaaggctagcactttgcttcagaagagaagcagggcaaaggtgtaattcttcatttaatgtggtacaacctaaagggtaaacctttacctctcacttaactagttattcctagtatgtatatgtatatatgtctcacatctatagttttagacattatgcatcattttctgttctgcttctgaatgagaagccatctaacacaaagccacacagggaatggaaatttatggaaagggcattcgttttgaaaatggacgtttgcagaaggggtgatgtatttgtaagtgactctcggtacagagaacacttaacaaaattcagtgttttttcttacttattcctttaagcctttgaataaagtcttctttgcagggtttctgtagtacatcagaaaaaggaggagctgaaaataggtttaagagagcaccaatgtgggcattgattgttgtatggc

SEQ ID NO: 113748 - DNA, 1036 bp, Homo sapiens
gttttttaaaggaaaagagcaaataatttatcagaagtgtggatggtgtggggctcctctattagtgtggtagccgcttagccacatacagctagtctgatgagatagtttggaggtgaaaaatacacaggggatttctaaatgcaaaaaaaagaaatgtaaatattttattaatacttttaaatatattgattccatgtagaaatgataatatactagatattttgagttaaaaagaatacagtaggccaggtgcggtgactcatgcctataatcccagcactttgagaggccagggcaggaggatcacttgaagccaggagtttgagaccagcctggtcaacacagtgagactctgtccctattttctttctgttaaagttaaaaataagagaatatattattgaaattaatttctcttgtttctttttacctttttaatgtgattactataaaattgtgacttgcattatgtttatattggacagtgctggtctagggcttctaacttactgtggcaaagagtatggaaagaaacttttagagaaaaatgtaaccattgttttgtgggagtggtggtagttttggggggcagtgacctgcctgttgctgaggtaattctcaagtgtactaaggatcactgcaacttttaagtagtattaaaagttgattgaaaaatgagtagctttttttttaattaaaagggtaatatatgtattaagagtcttggttttattttcttagcactttatgaaagatctgctttttcccagcattccgtttgtgaaagtactctacgtatatctatctgaaatgctgaaagcctggctaagaagggattaaaccttcccttaatctttctgtgctgcctaaaagctctcccttttaggcccatcatttgtttgtttcttctttaattaaattagggattcaataaatatttatctgctaggtactgtaggtacaatggtgagcaagaacaaatatggttgccacccttgtgggcccatagctgactgcaggaagcaggcattca
